United States Patent 10,731,166 (OLIGONUCLEOTIDE PROBES AND USES THEREOF) - sequence listing, part 8

SEQ ID NO: 183226 - DNA, 35 bp, Artificial Sequence
  Synthetic oligonucleotide
attgcgtactgccctctctatcgcttgaaacaccc

SEQ ID NO: 183227 - DNA, 35 bp, Artificial Sequence
  Synthetic oligonucleotide
gccgtcacgccgcgaaccgtatgttcatccacccc

SEQ ID NO: 183228 - DNA, 35 bp, Artificial Sequence
  Synthetic oligonucleotide
gcaatatactccgcctgcgccatggcccgtgcccc

SEQ ID NO: 183229 - DNA, 35 bp, Artificial Sequence
  Synthetic oligonucleotide
gacgactggcccgacccccggtgtttcttcttccc

SEQ ID NO: 183230 - DNA, 35 bp, Artificial Sequence
  Synthetic oligonucleotide
gccacgcccttgcctctttctccgtcttgcaggcc

SEQ ID NO: 183231 - DNA, 35 bp, Artificial Sequence
  Synthetic oligonucleotide
cgccaccatacgatgtacggatcactccctttgcc

SEQ ID NO: 183232 - DNA, 35 bp, Artificial Sequence
  Synthetic oligonucleotide
gtgggtgtcagccctacccgttcgtatctttctcc

SEQ ID NO: 183233 - DNA, 35 bp, Artificial Sequence
  Synthetic oligonucleotide
ttccaccatccctgatctgtgttaagcccgcttcc

SEQ ID NO: 183234 - DNA, 35 bp, Artificial Sequence
  Synthetic oligonucleotide
ttgcctcacctctcctggtccctatatgcctaagc

SEQ ID NO: 183235 - DNA, 35 bp, Artificial Sequence
  Synthetic oligonucleotide
gacgcgcaacctctccgcccagcccgcctagccgc

SEQ ID NO: 183236 - DNA, 33 bp, Artificial Sequence
  Synthetic oligonucleotide
tacccggcggagtcctcacctaccccctgtcgc

SEQ ID NO: 183237 - DNA, 35 bp, Artificial Sequence
  Synthetic oligonucleotide
cccaacgccctattgcgattcccccagaccccggc

SEQ ID NO: 183238 - DNA, 35 bp, Artificial Sequence
  Synthetic oligonucleotide
agtagcaccgccccctttggcctccacgacttggc

SEQ ID NO: 183239 - DNA, 35 bp, Artificial Sequence
  Synthetic oligonucleotide
acgttacccaggggcccctcacccgtcgcccgatc

SEQ ID NO: 183240 - DNA, 35 bp, Artificial Sequence
  Synthetic oligonucleotide
gttgcgtcgccgtatcattaagcatctaccccctc

SEQ ID NO: 183241 - DNA, 36 bp, Artificial Sequence
  Synthetic oligonucleotide
tgccacgcctatcgacccgtcgaccactggtgcctc

SEQ ID NO: 183242 - DNA, 35 bp, Artificial Sequence
  Synthetic oligonucleotide
ttcgtagtgcacccgtggtaactgcatttgtcctc

SEQ ID NO: 183243 - DNA, 35 bp, Artificial Sequence
  Synthetic oligonucleotide
gacctgcagtaaaggtgcactccgacctcctgctc

SEQ ID NO: 183244 - DNA, 35 bp, Artificial Sequence
  Synthetic oligonucleotide
tccacctcccagcgcatatccccaggaagtctctc

SEQ ID NO: 183245 - DNA, 35 bp, Artificial Sequence
  Synthetic oligonucleotide
tgagttgcccttccggtcatggatgtccgcccgtc

SEQ ID NO: 183246 - DNA, 35 bp, Artificial Sequence
  Synthetic oligonucleotide
taagcctcattgtcctaacaccactcctctcattc

SEQ ID NO: 183247 - DNA, 35 bp, Artificial Sequence
  Synthetic oligonucleotide
gcgtagcaccgccctgcccttcttactgtcgtttc

SEQ ID NO: 183248 - DNA, 34 bp, Artificial Sequence
  Synthetic oligonucleotide
ggtgccgcccactgtcttctcttccaatgcccag

SEQ ID NO: 183249 - DNA, 36 bp, Artificial Sequence
  Synthetic oligonucleotide
ttctgaccctacctcagctacctccgcctgactcag

SEQ ID NO: 183250 - DNA, 34 bp, Artificial Sequence
  Synthetic oligonucleotide
gttccgctcgctaatgcccgccacctgagtcccg

SEQ ID NO: 183251 - DNA, 35 bp, Artificial Sequence
  Synthetic oligonucleotide
gcagagtgccctgtttgatcgtccgtcgttttccg

SEQ ID NO: 183252 - DNA, 33 bp, Artificial Sequence
  Synthetic oligonucleotide
ggagggtagggtggttcgtacagggggggggcg

SEQ ID NO: 183253 - DNA, 35 bp, Artificial Sequence
  Synthetic oligonucleotide
gcatacctccgacctcaccaagggtgtccccatcg

SEQ ID NO: 183254 - DNA, 35 bp, Artificial Sequence
  Synthetic oligonucleotide
gccccgtcccagaggcacctgcacacccgacctcg

SEQ ID NO: 183255 - DNA, 35 bp, Artificial Sequence
  Synthetic oligonucleotide
gcgagtcgaaccgctcctcctctgtgcaaccctcg

SEQ ID NO: 183256 - DNA, 35 bp, Artificial Sequence
  Synthetic oligonucleotide
gaggggagatcggcgttaagaccggggatggaggg

SEQ ID NO: 183257 - DNA, 35 bp, Artificial Sequence
  Synthetic oligonucleotide
aagtgcaaaggcgggggtagtcaggagatgccggg

SEQ ID NO: 183258 - DNA, 35 bp, Artificial Sequence
  Synthetic oligonucleotide
acacgtactgaaatcctagtcccacccactccggg

SEQ ID NO: 183259 - DNA, 35 bp, Artificial Sequence
  Synthetic oligonucleotide
ttgccgcccccccactgtagcctgtctcctgatgg

SEQ ID NO: 183260 - DNA, 35 bp, Artificial Sequence
  Synthetic oligonucleotide
gtcccattcgctaggctgctctccctgacccctgg

SEQ ID NO: 183261 - DNA, 35 bp, Artificial Sequence
  Synthetic oligonucleotide
tactcctgtgcttttgtccccattgttcaccaatg

SEQ ID NO: 183262 - DNA, 35 bp, Artificial Sequence
  Synthetic oligonucleotide
gacaggttaacggcgggagtgggacgggtacgatg

SEQ ID NO: 183263 - DNA, 35 bp, Artificial Sequence
  Synthetic oligonucleotide
tgccaccgcactggtacctgctccctcctatactg

SEQ ID NO: 183264 - DNA, 36 bp, Artificial Sequence
  Synthetic oligonucleotide
tccacgattcagtgcctgcccacacgaccactcttg

SEQ ID NO: 183265 - DNA, 35 bp, Artificial Sequence
  Synthetic oligonucleotide
tctgtcatccacagctctgagatcccccgccgttg

SEQ ID NO: 183266 - DNA, 35 bp, Artificial Sequence
  Synthetic oligonucleotide
tgtcagtcgacgggtgggttagggaaagggctttg

SEQ ID NO: 183267 - DNA, 35 bp, Artificial Sequence
  Synthetic oligonucleotide
tgccccccctacccagtccctctgacgtctacaat

SEQ ID NO: 183268 - DNA, 35 bp, Artificial Sequence
  Synthetic oligonucleotide
aggggagggaggggggggtacgaggcagggggcat

SEQ ID NO: 183269 - DNA, 35 bp, Artificial Sequence
  Synthetic oligonucleotide
accccccgacgcatcggtatgctttccccgcccct

SEQ ID NO: 183270 - DNA, 35 bp, Artificial Sequence
  Synthetic oligonucleotide
tcaacctccgggtgccgtgccatttgcccttccct

SEQ ID NO: 183271 - DNA, 35 bp, Artificial Sequence
  Synthetic oligonucleotide
gtcggtcaccgttctacgatctcctcccactgcct

SEQ ID NO: 183272 - DNA, 35 bp, Artificial Sequence
  Synthetic oligonucleotide
ggaccgacgtcgcgcctgccttctaagccgatcct

SEQ ID NO: 183273 - DNA, 35 bp, Artificial Sequence
  Synthetic oligonucleotide
acgtggcccgcacaccgtcgatcttggtccgtcct

SEQ ID NO: 183274 - DNA, 35 bp, Artificial Sequence
  Synthetic oligonucleotide
gtctgccggtgtcttcggcccttcaatgtttctct

SEQ ID NO: 183275 - DNA, 35 bp, Artificial Sequence
  Synthetic oligonucleotide
acccactggagcggcctcagctctggtacacttct

SEQ ID NO: 183276 - DNA, 35 bp, Artificial Sequence
  Synthetic oligonucleotide
tccccatctcatctgctccacgtatttggtcttct

SEQ ID NO: 183277 - DNA, 35 bp, Artificial Sequence
  Synthetic oligonucleotide
gatggtagggagaagataaagatatggaggggcgt

SEQ ID NO: 183278 - DNA, 35 bp, Artificial Sequence
  Synthetic oligonucleotide
gccactcgcgccccgactgttcttccatgcctcgt

SEQ ID NO: 183279 - DNA, 35 bp, Artificial Sequence
  Synthetic oligonucleotide
tgtgtcaccacggctgtgcgcttcatatttccggt

SEQ ID NO: 183280 - DNA, 35 bp, Artificial Sequence
  Synthetic oligonucleotide
aagctcactcaagtcacccgcccctccttatcggt

SEQ ID NO: 183281 - DNA, 35 bp, Artificial Sequence
  Synthetic oligonucleotide
acccgttgtagccggttgcccccttttcgtccctt

SEQ ID NO: 183282 - DNA, 35 bp, Artificial Sequence
  Synthetic oligonucleotide
gtccgtagcatttgcgtatccgcaccactttcctt

SEQ ID NO: 183283 - DNA, 35 bp, Artificial Sequence
  Synthetic oligonucleotide
gtaccgctttcatcactcctgcttacgccccgctt

SEQ ID NO: 183284 - DNA, 35 bp, Artificial Sequence
  Synthetic oligonucleotide
gcgagttcatccgcgtacattcttctcttccgctt

SEQ ID NO: 183285 - DNA, 35 bp, Artificial Sequence
  Synthetic oligonucleotide
gccctgtcttagctcggtgttccctttctctagtt

SEQ ID NO: 183286 - DNA, 35 bp, Artificial Sequence
  Synthetic oligonucleotide
gccgggggtgccaatcaaggagggagggacgcgtt

SEQ ID NO: 183287 - DNA, 35 bp, Artificial Sequence
  Synthetic oligonucleotide
gcgcacgctcagtagccttgttcctaccgcccttt

SEQ ID NO: 183288 - DNA, 35 bp, Artificial Sequence
  Synthetic oligonucleotide
gtcatgttcaggacctgctctatcgctccgttttt

SEQ ID NO: 183289 - DNA, 36 bp, Artificial Sequence
  Synthetic oligonucleotide
tacccgcccctcttcgacgaagacatttcgcgcaaa

SEQ ID NO: 183290 - DNA, 36 bp, Artificial Sequence
  Synthetic oligonucleotide
tcatgcggggggagggagcggtatattgttgtgaaa

SEQ ID NO: 183291 - DNA, 36 bp, Artificial Sequence
  Synthetic oligonucleotide
acgatggaacgataggtggaggggattgggtgtaaa

SEQ ID NO: 183292 - DNA, 36 bp, Artificial Sequence
  Synthetic oligonucleotide
gactgcccgcagtctcattttaccgatcacctacaa

SEQ ID NO: 183293 - DNA, 36 bp, Artificial Sequence
  Synthetic oligonucleotide
taacatctccctgcttctatcgccagcctttgccaa

SEQ ID NO: 183294 - DNA, 36 bp, Artificial Sequence
  Synthetic oligonucleotide
ttcacatgcccctcacttgagtcccgtcactttcaa

SEQ ID NO: 183295 - DNA, 36 bp, Artificial Sequence
  Synthetic oligonucleotide
aacgaggatagtagggcaacatagggaggaaaggaa

SEQ ID NO: 183296 - DNA, 36 bp, Artificial Sequence
  Synthetic oligonucleotide
gacaataggggggggtaggagtaaaagggcgatgaa

SEQ ID NO: 183297 - DNA, 36 bp, Artificial Sequence
  Synthetic oligonucleotide
ttaacgcccgaggtctatactctccctctctttgaa

SEQ ID NO: 183298 - DNA, 36 bp, Artificial Sequence
  Synthetic oligonucleotide
ttagcgaccgtcagcccccgttttctcagcctctaa

SEQ ID NO: 183299 - DNA, 35 bp, Artificial Sequence
  Synthetic oligonucleotide
aagagggtgggaggggtctcaaggtgggatccaca

SEQ ID NO: 183300 - DNA, 36 bp, Artificial Sequence
  Synthetic oligonucleotide
tgcttcgcccaccgctacgtgactatcctttccaca

SEQ ID NO: 183301 - DNA, 35 bp, Artificial Sequence
  Synthetic oligonucleotide
gtaaccacacctcactgacgccagacatgccacca

SEQ ID NO: 183302 - DNA, 36 bp, Artificial Sequence
  Synthetic oligonucleotide
gcccatacgatggccccgccccgaggtttgaaccca

SEQ ID NO: 183303 - DNA, 36 bp, Artificial Sequence
  Synthetic oligonucleotide
ttcgacctggccaccctgctaatatgcaaagcccca

SEQ ID NO: 183304 - DNA, 36 bp, Artificial Sequence
  Synthetic oligonucleotide
gctctccgcgcgtacgtggccatcgttttctcccca

SEQ ID NO: 183305 - DNA, 36 bp, Artificial Sequence
  Synthetic oligonucleotide
actcgcccactgttacatacctattgacgcttccca

SEQ ID NO: 183306 - DNA, 36 bp, Artificial Sequence
  Synthetic oligonucleotide
tgtcatgtcgtactctacattttgcctgggcctcca

SEQ ID NO: 183307 - DNA, 36 bp, Artificial Sequence
  Synthetic oligonucleotide
ttgcttggtcggggggggaagggcgaaatgggtcca

SEQ ID NO: 183308 - DNA, 36 bp, Artificial Sequence
  Synthetic oligonucleotide
acctcgcctcgtaggttaccaccgttttttcttcca

SEQ ID NO: 183309 - DNA, 35 bp, Artificial Sequence
  Synthetic oligonucleotide
ggtgtgggtgaaatggccgggggggtgacaaggca

SEQ ID NO: 183310 - DNA, 36 bp, Artificial Sequence
  Synthetic oligonucleotide
gctaaggagggaagggtaggcaaggctaagcaggca

SEQ ID NO: 183311 - DNA, 35 bp, Artificial Sequence
  Synthetic oligonucleotide
gtaagcacgggagggtggttaggcaaaccggggca

SEQ ID NO: 183312 - DNA, 36 bp, Artificial Sequence
  Synthetic oligonucleotide
tgcactccccagtttctgttacgtcttcctcctgca

SEQ ID NO: 183313 - DNA, 36 bp, Artificial Sequence
  Synthetic oligonucleotide
gcgtccgaccagattagcccccctttcccctttgca

SEQ ID NO: 183314 - DNA, 35 bp, Artificial Sequence
  Synthetic oligonucleotide
tcaggtcgctgcctttatccgtaccggcctttgca

SEQ ID NO: 183315 - DNA, 34 bp, Artificial Sequence
  Synthetic oligonucleotide
gaaggtggggccgaaccggggaaggaggtggtca

SEQ ID NO: 183316 - DNA, 36 bp, Artificial Sequence
  Synthetic oligonucleotide
gccacctacccgcgcatggcaaattacgttccttca

SEQ ID NO: 183317 - DNA, 36 bp, Artificial Sequence
  Synthetic oligonucleotide
atccgcggtaatagtatcccgtcacgtctctcttca

SEQ ID NO: 183318 - DNA, 35 bp, Artificial Sequence
  Synthetic oligonucleotide
gccccaatcttcagcctctccgttgctccgcgaga

SEQ ID NO: 183319 - DNA, 37 bp, Artificial Sequence
  Synthetic oligonucleotide
gtggagtagtcacggcggaaaggactgaagggggaga

SEQ ID NO: 183320 - DNA, 37 bp, Artificial Sequence
  Synthetic oligonucleotide
gcaccgggtagtgggttgggtgggcatcagtttgaga

SEQ ID NO: 183321 - DNA, 37 bp, Artificial Sequence
  Synthetic oligonucleotide
gcctgcactcctattgcgtctaccggccccccataga

SEQ ID NO: 183322 - DNA, 37 bp, Artificial Sequence
  Synthetic oligonucleotide
aaggaaccctcacatagtcccgccttccgccctacga

SEQ ID NO: 183323 - DNA, 37 bp, Artificial Sequence
  Synthetic oligonucleotide
gcaaggggcgggagggggtggataccgtagattacga

SEQ ID NO: 183324 - DNA, 37 bp, Artificial Sequence
  Synthetic oligonucleotide
tgactcccctccgttgttctttcctcgtagctaccga

SEQ ID NO: 183325 - DNA, 37 bp, Artificial Sequence
  Synthetic oligonucleotide
ttgcctctgcagccacccccgctattactgatcccga

SEQ ID NO: 183326 - DNA, 36 bp, Artificial Sequence
  Synthetic oligonucleotide
tatgtccccacagtgatgtcgctaacccgctcccga

SEQ ID NO: 183327 - DNA, 37 bp, Artificial Sequence
  Synthetic oligonucleotide
gttaccacagtcttgtacatccgccccctattgccga

SEQ ID NO: 183328 - DNA, 37 bp, Artificial Sequence
  Synthetic oligonucleotide
tcaccggtgccaacgtatacactcttccacactccga

SEQ ID NO: 183329 - DNA, 36 bp, Artificial Sequence
  Synthetic oligonucleotide
gtgcaacgctgtcccatcgtactttcctctttccga

SEQ ID NO: 183330 - DNA, 37 bp, Artificial Sequence
  Synthetic oligonucleotide
ggggggaggggcacataagttatggggtcggtcgcga

SEQ ID NO: 183331 - DNA, 37 bp, Artificial Sequence
  Synthetic oligonucleotide
gtacgtgaggggcaatgggtgggggccgggaatgcga

SEQ ID NO: 183332 - DNA, 37 bp, Artificial Sequence
  Synthetic oligonucleotide
tggagggggggtgcgggaaaaggtgaaagagcgtcga

SEQ ID NO: 183333 - DNA, 37 bp, Artificial Sequence
  Synthetic oligonucleotide
tatcaccgcagctggtctctgtctccctcgtgttcga

SEQ ID NO: 183334 - DNA, 37 bp, Artificial Sequence
  Synthetic oligonucleotide
ttacgagacggggggtagacgaggtgaggctgcagga

SEQ ID NO: 183335 - DNA, 37 bp, Artificial Sequence
  Synthetic oligonucleotide
gatcccaccgctgctaattacgcaccacctacgagga

SEQ ID NO: 183336 - DNA, 37 bp, Artificial Sequence
  Synthetic oligonucleotide
tacaccgctcctctacgtcacaccctcgtcactagga

SEQ ID NO: 183337 - DNA, 36 bp, Artificial Sequence
  Synthetic oligonucleotide
gtcccgttccgcctgcaaacttaatctccctccgga

SEQ ID NO: 183338 - DNA, 37 bp, Artificial Sequence
  Synthetic oligonucleotide
ggtccggcctgtcgtacccatccccccattctccgga

SEQ ID NO: 183339 - DNA, 36 bp, Artificial Sequence
  Synthetic oligonucleotide
agccaagcagggggggcgggctaatatgataaggga

SEQ ID NO: 183340 - DNA, 37 bp, Artificial Sequence
  Synthetic oligonucleotide
tgcctcgggtaaggggaggaggcatgaggtcagggga

SEQ ID NO: 183341 - DNA, 37 bp, Artificial Sequence
  Synthetic oligonucleotide
gcccccccgctgagtaacaggtccgcccttcttggga

SEQ ID NO: 183342 - DNA, 37 bp, Artificial Sequence
  Synthetic oligonucleotide
gtatgtcaggggggaggaattgaagggaaaaagtgga

SEQ ID NO: 183343 - DNA, 37 bp, Artificial Sequence
  Synthetic oligonucleotide
gtgtagggggaggtgaagcaattgagaaagcagtgga

SEQ ID NO: 183344 - DNA, 36 bp, Artificial Sequence
  Synthetic oligonucleotide
gtccgcccattcaccctcctctggttttcccgtgga

SEQ ID NO: 183345 - DNA, 37 bp, Artificial Sequence
  Synthetic oligonucleotide
tttacccaggcggagagaaggaggatggtggggtgga

SEQ ID NO: 183346 - DNA, 35 bp, Artificial Sequence
  Synthetic oligonucleotide
tgccagacgcatgggatcgcccctccctctaatga

SEQ ID NO: 183347 - DNA, 38 bp, Artificial Sequence
  Synthetic oligonucleotide
ttacgcagccacgtcagatcctccgcctccactcatga

SEQ ID NO: 183348 - DNA, 36 bp, Artificial Sequence
  Synthetic oligonucleotide
tgaggcccacacatcggctacacgacctccttatga

SEQ ID NO: 183349 - DNA, 38 bp, Artificial Sequence
  Synthetic oligonucleotide
ttcgccaccctcgccgagcttactgacctcctcactga

SEQ ID NO: 183350 - DNA, 38 bp, Artificial Sequence
  Synthetic oligonucleotide
tcccctcccagtatgcctgtaaccatcctctcccctga

SEQ ID NO: 183351 - DNA, 38 bp, Artificial Sequence
  Synthetic oligonucleotide
tagccccccccctctgagaaggctccctagtcccctga

SEQ ID NO: 183352 - DNA, 36 bp, Artificial Sequence
  Synthetic oligonucleotide
tcccacactactgttgggtaagaatccccgccctga

SEQ ID NO: 183353 - DNA, 38 bp, Artificial Sequence
  Synthetic oligonucleotide
ttgacgtggtcctcctgcttactttacgtagtccctga

SEQ ID NO: 183354 - DNA, 28 bp, Artificial Sequence
  Synthetic oligonucleotide
tttctgccccacccgatccctccgctga

SEQ ID NO: 183355 - DNA, 37 bp, Artificial Sequence
  Synthetic oligonucleotide
gtgctagcgcattgtcccctctttcacgtgctgctga

SEQ ID NO: 183356 - DNA, 37 bp, Artificial Sequence
  Synthetic oligonucleotide
tcccgctcacattaggttttctcgggcccctctctga

SEQ ID NO: 183357 - DNA, 36 bp, Artificial Sequence
  Synthetic oligonucleotide
gatggaggggtaagggggaatcagcagataacgtga

SEQ ID NO: 183358 - DNA, 38 bp, Artificial Sequence
  Synthetic oligonucleotide
tcccgcctctcgttccaattccatactacagtccgtga

SEQ ID NO: 183359 - DNA, 38 bp, Artificial Sequence
  Synthetic oligonucleotide
ttacagtcaaacgctcagggagggtgggaagggggtga

SEQ ID NO: 183360 - DNA, 38 bp, Artificial Sequence
  Synthetic oligonucleotide
ggggcggacattggttaagtatgggggagggggggtga

SEQ ID NO: 183361 - DNA, 38 bp, Artificial Sequence
  Synthetic oligonucleotide
ggggtggggactaaatggtggggaagtggaggtggtga

SEQ ID NO: 183362 - DNA, 38 bp, Artificial Sequence
  Synthetic oligonucleotide
gagggggggaaggacgaagatattaatagcggatgtga

SEQ ID NO: 183363 - DNA, 37 bp, Artificial Sequence
  Synthetic oligonucleotide
gtgggtgaggaccggggggaggaaagcaatgctgtga

SEQ ID NO: 183364 - DNA, 38 bp, Artificial Sequence
  Synthetic oligonucleotide
gcactgcgccacttttgcccatcatcgcgcggacttga

SEQ ID NO: 183365 - DNA, 38 bp, Artificial Sequence
  Synthetic oligonucleotide
gcatgcacgatctggaaaaccccgccgttccctcttga

SEQ ID NO: 183366 - DNA, 38 bp, Artificial Sequence
  Synthetic oligonucleotide
tttcaccgccgtctagcccttacccgcctgtctcttga

SEQ ID NO: 183367 - DNA, 37 bp, Artificial Sequence
  Synthetic oligonucleotide
tccttccgcgctctcgttgcctcccacagtatgttga

SEQ ID NO: 183368 - DNA, 36 bp, Artificial Sequence
  Synthetic oligonucleotide
aaaccgccccgccgagacacgccccgatcactttga

SEQ ID NO: 183369 - DNA, 36 bp, Artificial Sequence
  Synthetic oligonucleotide
tacttgcccacctgtgaatgcctcatgtcccatata

SEQ ID NO: 183370 - DNA, 36 bp, Artificial Sequence
  Synthetic oligonucleotide
tgaaggggcacatcgtccgcacttttgcttcaccta

SEQ ID NO: 183371 - DNA, 36 bp, Artificial Sequence
  Synthetic oligonucleotide
acctcggtcaattcctctcgtgcgcatactacccta

SEQ ID NO: 183372 - DNA, 35 bp, Artificial Sequence
  Synthetic oligonucleotide
acagcgccccttgatctatgtaaaccgcctcccta

SEQ ID NO: 183373 - DNA, 35 bp, Artificial Sequence
  Synthetic oligonucleotide
gctccagcccgcagacccctcctccatgctcagta

SEQ ID NO: 183374 - DNA, 36 bp, Artificial Sequence
  Synthetic oligonucleotide
tcgaaccactgagccccacatctgccctctcgagta

SEQ ID NO: 183375 - DNA, 35 bp, Artificial Sequence
  Synthetic oligonucleotide
agaccacgccttgcggatccactcgtccccctgta

SEQ ID NO: 183376 - DNA, 36 bp, Artificial Sequence
  Synthetic oligonucleotide
accaaacgccgtgccctcgcgaactttccttttgta

SEQ ID NO: 183377 - DNA, 30 bp, Artificial Sequence
  Synthetic oligonucleotide
tccctatccctccctccgcctgccgcatta

SEQ ID NO: 183378 - DNA, 36 bp, Artificial Sequence
  Synthetic oligonucleotide
atcacacaatcgtgccacctagcccgtttaccttta

SEQ ID NO: 183379 - DNA, 35 bp, Artificial Sequence
  Synthetic oligonucleotide
gaaggggggctcaaaatctgggggcgtggttcaac

SEQ ID NO: 183380 - DNA, 35 bp, Artificial Sequence
  Synthetic oligonucleotide
gctgtcccgcaatagcactgtccccctgtttcaac

SEQ ID NO: 183381 - DNA, 35 bp, Artificial Sequence
  Synthetic oligonucleotide
acccatccctcacatgttgtagcggcttttaacac

SEQ ID NO: 183382 - DNA, 35 bp, Artificial Sequence
  Synthetic oligonucleotide
tgtccactgccctgcccacttgcgcccccttgcac

SEQ ID NO: 183383 - DNA, 35 bp, Artificial Sequence
  Synthetic oligonucleotide
tccccgctcggacgacaagcgcactacacctctac

SEQ ID NO: 183384 - DNA, 35 bp, Artificial Sequence
  Synthetic oligonucleotide
actcccatccgcccggtacaatactgtctctgacc

SEQ ID NO: 183385 - DNA, 34 bp, Artificial Sequence
  Synthetic oligonucleotide
atcaccgccattcttttggaagaacctcgccccc

SEQ ID NO: 183386 - DNA, 36 bp, Artificial Sequence
  Synthetic oligonucleotide
acgccgtagatgacttcatataccacgcgccgcccc

SEQ ID NO: 183387 - DNA, 35 bp, Artificial Sequence
  Synthetic oligonucleotide
aattgcgcaacacatctgatatgcttgccttgccc

SEQ ID NO: 183388 - DNA, 35 bp, Artificial Sequence
  Synthetic oligonucleotide
tgcgatcagttggttccctcttgctacatcctccc

SEQ ID NO: 183389 - DNA, 35 bp, Artificial Sequence
  Synthetic oligonucleotide
gagccggacagatccgaccccacgctcgacttccc

SEQ ID NO: 183390 - DNA, 35 bp, Artificial Sequence
  Synthetic oligonucleotide
gacgtctatatcgcttctgcttgttcattttcgcc

SEQ ID NO: 183391 - DNA, 35 bp, Artificial Sequence
  Synthetic oligonucleotide
accgaatcacctctgagaatcacccacttagtgcc

SEQ ID NO: 183392 - DNA, 35 bp, Artificial Sequence
  Synthetic oligonucleotide
tcgccctccggccaataatatgcccccggtttgcc

SEQ ID NO: 183393 - DNA, 35 bp, Artificial Sequence
  Synthetic oligonucleotide
atcgaacgtactgcccgcgttccgcttttccctcc

SEQ ID NO: 183394 - DNA, 35 bp, Artificial Sequence
  Synthetic oligonucleotide
atcgtacctgccccgcttccgatacattggcctcc

SEQ ID NO: 183395 - DNA, 35 bp, Artificial Sequence
  Synthetic oligonucleotide
ataacgcgcgtcggtccgcccgactatactgctcc

SEQ ID NO: 183396 - DNA, 35 bp, Artificial Sequence
  Synthetic oligonucleotide
tgcctccgtccctgtcctcctcggctatgagttcc

SEQ ID NO: 183397 - DNA, 35 bp, Artificial Sequence
  Synthetic oligonucleotide
gatccgctgacactcccagtcgcctctaagaccgc

SEQ ID NO: 183398 - DNA, 35 bp, Artificial Sequence
  Synthetic oligonucleotide
gtgcagtcccgcaccgcctcccgtgcctacatcgc

SEQ ID NO: 183399 - DNA, 35 bp, Artificial Sequence
  Synthetic oligonucleotide
acccccaaccgaagtagctgcttagtctcgttcgc

SEQ ID NO: 183400 - DNA, 35 bp, Artificial Sequence
  Synthetic oligonucleotide
tgagccatagcataccacctgcgtgcttctcaatc

SEQ ID NO: 183401 - DNA, 35 bp, Artificial Sequence
  Synthetic oligonucleotide
gtgctctgacccggatacctattggcctttacctc

SEQ ID NO: 183402 - DNA, 35 bp, Artificial Sequence
  Synthetic oligonucleotide
gcaacatacatcctaaagcatcgcgggtctcgctc

SEQ ID NO: 183403 - DNA, 35 bp, Artificial Sequence
  Synthetic oligonucleotide
gacccccggcatgtgtggcccaactatcccttctc

SEQ ID NO: 183404 - DNA, 35 bp, Artificial Sequence
  Synthetic oligonucleotide
ggacacctcctcgacacgttcggagccaccccgtc

SEQ ID NO: 183405 - DNA, 35 bp, Artificial Sequence
  Synthetic oligonucleotide
ggtgtgcactcagcccttagtcttcatcccccgtc

SEQ ID NO: 183406 - DNA, 35 bp, Artificial Sequence
  Synthetic oligonucleotide
tgctggccgacgctagccaagtattaatccccgtc

SEQ ID NO: 183407 - DNA, 35 bp, Artificial Sequence
  Synthetic oligonucleotide
ttccgaccccacatcgggatcgagccactcttgtc

SEQ ID NO: 183408 - DNA, 35 bp, Artificial Sequence
  Synthetic oligonucleotide
attgccacccgctaatgcttgaaaccgtttcattc

SEQ ID NO: 183409 - DNA, 35 bp, Artificial Sequence
  Synthetic oligonucleotide
acacgcacgccgctctcgtatcaatattgctcttc

SEQ ID NO: 183410 - DNA, 35 bp, Artificial Sequence
  Synthetic oligonucleotide
tgagatgtcgtcgagctgattctcgcgcctcgttc

SEQ ID NO: 183411 - DNA, 35 bp, Artificial Sequence
  Synthetic oligonucleotide
gacgcacccccacggcctagtttacctacctcaag

SEQ ID NO: 183412 - DNA, 35 bp, Artificial Sequence
  Synthetic oligonucleotide
tcccagccccctcagtgacgccccttggttcgcag

SEQ ID NO: 183413 - DNA, 35 bp, Artificial Sequence
  Synthetic oligonucleotide
attcacctccgccgcgctgggcccaacgattcgcg

SEQ ID NO: 183414 - DNA, 35 bp, Artificial Sequence
  Synthetic oligonucleotide
gatccacgtacgggtaggggggggccagttgggcg

SEQ ID NO: 183415 - DNA, 36 bp, Artificial Sequence
  Synthetic oligonucleotide
gcatgtgggtggagggggatacgagtgaatgcaagg

SEQ ID NO: 183416 - DNA, 35 bp, Artificial Sequence
  Synthetic oligonucleotide
gcccagcatattagatagggaggggaatggggagg

SEQ ID NO: 183417 - DNA, 35 bp, Artificial Sequence
  Synthetic oligonucleotide
cccacccgtcactccccatatatcactcgctcggg

SEQ ID NO: 183418 - DNA, 35 bp, Artificial Sequence
  Synthetic oligonucleotide
gcaggtgggtctccctgttgttcccttcgctactg

SEQ ID NO: 183419 - DNA, 35 bp, Artificial Sequence
  Synthetic oligonucleotide
ctgcgccctccggtctccgtattactacacccgtg

SEQ ID NO: 183420 - DNA, 35 bp, Artificial Sequence
  Synthetic oligonucleotide
ttatcccggccggggatctgcctattccacaccat

SEQ ID NO: 183421 - DNA, 35 bp, Artificial Sequence
  Synthetic oligonucleotide
tcagcggtcggtctctcatcgcctctctgtatcat

SEQ ID NO: 183422 - DNA, 35 bp, Artificial Sequence
  Synthetic oligonucleotide
attcgtactgccgccactcaggtccatcccattat

SEQ ID NO: 183423 - DNA, 35 bp, Artificial Sequence
  Synthetic oligonucleotide
tcatcgcctcactgtacccgcttacgttgtgcact

SEQ ID NO: 183424 - DNA, 35 bp, Artificial Sequence
  Synthetic oligonucleotide
gctagcccccgaagctacgtactgccatatgtact

SEQ ID NO: 183425 - DNA, 35 bp, Artificial Sequence
  Synthetic oligonucleotide
ttaggccacccccatgacgtcgccatccgtttact

SEQ ID NO: 183426 - DNA, 35 bp, Artificial Sequence
  Synthetic oligonucleotide
tccaccccccgtctagatgtatcttttcttcccct

SEQ ID NO: 183427 - DNA, 35 bp, Artificial Sequence
  Synthetic oligonucleotide
ggaccaccgctagagaggtcgcacacctttttcct

SEQ ID NO: 183428 - DNA, 35 bp, Artificial Sequence
  Synthetic oligonucleotide
gcaacatccaagcccaccggtctgcacctactgct

SEQ ID NO: 183429 - DNA, 35 bp, Artificial Sequence
  Synthetic oligonucleotide
acctatcgccccgttccctctttcttgattgtgct

SEQ ID NO: 183430 - DNA, 35 bp, Artificial Sequence
  Synthetic oligonucleotide
tacacctcctccgcatttgtagttgacccgttgct

SEQ ID NO: 183431 - DNA, 35 bp, Artificial Sequence
  Synthetic oligonucleotide
ggaacacacgacgctttgtgtccactcctgcctct

SEQ ID NO: 183432 - DNA, 35 bp, Artificial Sequence
  Synthetic oligonucleotide
taagccatcccgtcattaatcgctcgactccttct

SEQ ID NO: 183433 - DNA, 35 bp, Artificial Sequence
  Synthetic oligonucleotide
gagcaagacaaggggtgtggtgggactgggccggt

SEQ ID NO: 183434 - DNA, 35 bp, Artificial Sequence
  Synthetic oligonucleotide
atcgccactgcctagctccattgacctcctactgt

SEQ ID NO: 183435 - DNA, 35 bp, Artificial Sequence
  Synthetic oligonucleotide
ttgccgggaaaaaagtgaaagcggggggtgggtgt

SEQ ID NO: 183436 - DNA, 35 bp, Artificial Sequence
  Synthetic oligonucleotide
gccatccactttcgacaccgcccatgcccatgatt

SEQ ID NO: 183437 - DNA, 35 bp, Artificial Sequence
  Synthetic oligonucleotide
tgttcgcccgctcgtcccccggtagttattctatt

SEQ ID NO: 183438 - DNA, 35 bp, Artificial Sequence
  Synthetic oligonucleotide
gtgagcacagcaatactcgcagcaggtccgccctt

SEQ ID NO: 183439 - DNA, 35 bp, Artificial Sequence
  Synthetic oligonucleotide
gtgtgtcctcctgctatgcctttacaagttgcgtt

SEQ ID NO: 183440 - DNA, 36 bp, Artificial Sequence
  Synthetic oligonucleotide
atgccgaagcgagaggggggaggctcagggaacaaa

SEQ ID NO: 183441 - DNA, 35 bp, Artificial Sequence
  Synthetic oligonucleotide
gtcaggcactcgggtggtgggggtcgggggataaa

SEQ ID NO: 183442 - DNA, 35 bp, Artificial Sequence
  Synthetic oligonucleotide
gttgccctcctgcagtattatttccgccgttacaa

SEQ ID NO: 183443 - DNA, 36 bp, Artificial Sequence
  Synthetic oligonucleotide
gcacgaacctgccggccccatccaatgcacaaccaa

SEQ ID NO: 183444 - DNA, 35 bp, Artificial Sequence
  Synthetic oligonucleotide
ttaagcccacgcaggtgtcattccttcccctcgaa

SEQ ID NO: 183445 - DNA, 34 bp, Artificial Sequence
  Synthetic oligonucleotide
tttgggcctccctcaaccccgcgatttgccgaca

SEQ ID NO: 183446 - DNA, 35 bp, Artificial Sequence
  Synthetic oligonucleotide
tccctccgccggttgcgtaggcaatcaccaaacca

SEQ ID NO: 183447 - DNA, 35 bp, Artificial Sequence
  Synthetic oligonucleotide
aggagaccgcgtccgccctgtcttcctccgcacca

SEQ ID NO: 183448 - DNA, 34 bp, Artificial Sequence
  Synthetic oligonucleotide
tcactcgccgggtgctagttcctccgtttcacca

SEQ ID NO: 183449 - DNA, 35 bp, Artificial Sequence
  Synthetic oligonucleotide
gaacccccgcaactcctgtagttttcgaaacccca

SEQ ID NO: 183450 - DNA, 35 bp, Artificial Sequence
  Synthetic oligonucleotide
gtagtcgccttatctcagctctcgtgaactctcca

SEQ ID NO: 183451 - DNA, 36 bp, Artificial Sequence
  Synthetic oligonucleotide
tagcagaccttgtctgcgcccgatccccgctctcca

SEQ ID NO: 183452 - DNA, 36 bp, Artificial Sequence
  Synthetic oligonucleotide
gtaccactccatgttctggtcaccattctggttcca

SEQ ID NO: 183453 - DNA, 35 bp, Artificial Sequence
  Synthetic oligonucleotide
accgtgaccgccacatttgctcctcctctgttcca

SEQ ID NO: 183454 - DNA, 36 bp, Artificial Sequence
  Synthetic oligonucleotide
gttgctcatccacgttccatccagtgatcccgcgca

SEQ ID NO: 183455 - DNA, 35 bp, Artificial Sequence
  Synthetic oligonucleotide
agcaaatcgcaagcggaggtagggtggagagggca

SEQ ID NO: 183456 - DNA, 36 bp, Artificial Sequence
  Synthetic oligonucleotide
gctcctgccctccttcgctcactaacttgccatgca

SEQ ID NO: 183457 - DNA, 36 bp, Artificial Sequence
  Synthetic oligonucleotide
gtcttgctccgccgctgtacccgccttgccctatca

SEQ ID NO: 183458 - DNA, 33 bp, Artificial Sequence
  Synthetic oligonucleotide
gagtgtgggtggggacgatgggtaacattatca

SEQ ID NO: 183459 - DNA, 36 bp, Artificial Sequence
  Synthetic oligonucleotide
tgaggaggaggaagggaaggcacgagtgcgttatca

SEQ ID NO: 183460 - DNA, 36 bp, Artificial Sequence
  Synthetic oligonucleotide
tctgaaccgactagctcctctatctgaccccactca

SEQ ID NO: 183461 - DNA, 36 bp, Artificial Sequence
  Synthetic oligonucleotide
gggatggagggtgggcgggtatcgatgcaatggtca

SEQ ID NO: 183462 - DNA, 36 bp, Artificial Sequence
  Synthetic oligonucleotide
gtgggccgttcaatggctactccccgctacgtttca

SEQ ID NO: 183463 - DNA, 37 bp, Artificial Sequence
  Synthetic oligonucleotide
tgggttgggtgaggtacgggggggatgaaacgaaaga

SEQ ID NO: 183464 - DNA, 37 bp, Artificial Sequence
  Synthetic oligonucleotide
tggagcagataaatagagggggaaggcgggcgggaga

SEQ ID NO: 183465 - DNA, 37 bp, Artificial Sequence
  Synthetic oligonucleotide
tccctccccgcatgtccataatcgcctgcacaataga

SEQ ID NO: 183466 - DNA, 37 bp, Artificial Sequence
  Synthetic oligonucleotide
gacgcccgccccctcgccccgccgcattgttacacga

SEQ ID NO: 183467 - DNA, 37 bp, Artificial Sequence
  Synthetic oligonucleotide
tgaagaccgccgcacacctaccatcactcgctcacga

SEQ ID NO: 183468 - DNA, 37 bp, Artificial Sequence
  Synthetic oligonucleotide
agtcaccgatgtatgctcctcgcccccccgtatacga

SEQ ID NO: 183469 - DNA, 37 bp, Artificial Sequence
  Synthetic oligonucleotide
tgagccagccctcccacttgctaatatagcccaccga

SEQ ID NO: 183470 - DNA, 37 bp, Artificial Sequence
  Synthetic oligonucleotide
agtacgcccacgctccacggttatagcacgcccccga

SEQ ID NO: 183471 - DNA, 36 bp, Artificial Sequence
  Synthetic oligonucleotide
tatgtccatgctacttatctgtctctgtccctccga

SEQ ID NO: 183472 - DNA, 36 bp, Artificial Sequence
  Synthetic oligonucleotide
gacacgcacattatctggtgtcctcgttctctccga

SEQ ID NO: 183473 - DNA, 37 bp, Artificial Sequence
  Synthetic oligonucleotide
accctgcctcctcctgcacttgtcgtagacgacgcga

SEQ ID NO: 183474 - DNA, 37 bp, Artificial Sequence
  Synthetic oligonucleotide
ggggcgggtgtcgcgtgttggttagggtgggactcga

SEQ ID NO: 183475 - DNA, 37 bp, Artificial Sequence
  Synthetic oligonucleotide
ggtgtcagggagtagggttgggcatgggggcggtcga

SEQ ID NO: 183476 - DNA, 37 bp, Artificial Sequence
  Synthetic oligonucleotide
acccccactccgactgaccccgtactagatacttcga

SEQ ID NO: 183477 - DNA, 37 bp, Artificial Sequence
  Synthetic oligonucleotide
ttgggaagggtggaacagggaaggctgtaaatgagga

SEQ ID NO: 183478 - DNA, 37 bp, Artificial Sequence
  Synthetic oligonucleotide
attcacgcccaaacgttcatctccactccctgtagga

SEQ ID NO: 183479 - DNA, 37 bp, Artificial Sequence
  Synthetic oligonucleotide
gtgtgcgctcgcgacatgtagcacaccctcccccgga

SEQ ID NO: 183480 - DNA, 36 bp, Artificial Sequence
  Synthetic oligonucleotide
tacgccattcccatgttacatccacctccatccgga

SEQ ID NO: 183481 - DNA, 36 bp, Artificial Sequence
  Synthetic oligonucleotide
tccaaagggtagtgagtaagcggggaggcaaaggga

SEQ ID NO: 183482 - DNA, 36 bp, Artificial Sequence
  Synthetic oligonucleotide
acaccccccgagtacatggccttcccacttattgga

SEQ ID NO: 183483 - DNA, 37 bp, Artificial Sequence
  Synthetic oligonucleotide
gccccctcgccgttccaccctcctagagaacagatga

SEQ ID NO: 183484 - DNA, 38 bp, Artificial Sequence
  Synthetic oligonucleotide
acatcgcccaatgcactctacgtacgaccctcacctga

SEQ ID NO: 183485 - DNA, 38 bp, Artificial Sequence
  Synthetic oligonucleotide
ggaaagtgcagagcctctccgtatttgttcctccctga

SEQ ID NO: 183486 - DNA, 37 bp, Artificial Sequence
  Synthetic oligonucleotide
tgagccaacctccatcatttagcactgtgattcctga

SEQ ID NO: 183487 - DNA, 38 bp, Artificial Sequence
  Synthetic oligonucleotide
accctcccgactccgctttgtgtatgtcctgcctctga

SEQ ID NO: 183488 - DNA, 38 bp, Artificial Sequence
  Synthetic oligonucleotide
gggggggacgaagataggaaggggcgggccacaggtga

SEQ ID NO: 183489 - DNA, 38 bp, Artificial Sequence
  Synthetic oligonucleotide
tgatccccccgttctgccaccctagagtccccaggtga

SEQ ID NO: 183490 - DNA, 37 bp, Artificial Sequence
  Synthetic oligonucleotide
accacgggcggggttgtgttttgttggggagaggtga

SEQ ID NO: 183491 - DNA, 38 bp, Artificial Sequence
  Synthetic oligonucleotide
ttccccttccgtgccgtactaggcgctctttcccttga

SEQ ID NO: 183492 - DNA, 35 bp, Artificial Sequence
  Synthetic oligonucleotide
agcatccgggcggagggtgggggttgtaccgttga

SEQ ID NO: 183493 - DNA, 37 bp, Artificial Sequence
  Synthetic oligonucleotide
gactgtgaggtggggatagggtgcatgggagggttga

SEQ ID NO: 183494 - DNA, 35 bp, Artificial Sequence
  Synthetic oligonucleotide
ttcgtggacctcctgtactctttctgtccttttga

SEQ ID NO: 183495 - DNA, 36 bp, Artificial Sequence
  Synthetic oligonucleotide
tccgtaccctctgcccatcattgtttcacgtccata

SEQ ID NO: 183496 - DNA, 35 bp, Artificial Sequence
  Synthetic oligonucleotide
aaagggggccgggcggagcggtagaatgcgtcata

SEQ ID NO: 183497 - DNA, 35 bp, Artificial Sequence
  Synthetic oligonucleotide
tcgcaagccccaagcccctagccccgccagctata

SEQ ID NO: 183498 - DNA, 35 bp, Artificial Sequence
  Synthetic oligonucleotide
tcccgcaccaccttgaggtatgttccgcccaccta

SEQ ID NO: 183499 - DNA, 37 bp, Artificial Sequence
  Synthetic oligonucleotide
agcccggaggtggcggggatggatgggtggaatccta

SEQ ID NO: 183500 - DNA, 35 bp, Artificial Sequence
  Synthetic oligonucleotide
gcgtgacacacgcacatcctcccattcgctctcta

SEQ ID NO: 183501 - DNA, 36 bp, Artificial Sequence
  Synthetic oligonucleotide
gtgaggggtaaagttacgggttgacgggcgggagta

SEQ ID NO: 183502 - DNA, 35 bp, Artificial Sequence
  Synthetic oligonucleotide
aaaggggcaaagaggcggggacataaagggtggta

SEQ ID NO: 183503 - DNA, 36 bp, Artificial Sequence
  Synthetic oligonucleotide
gaagcacgggcctgggaaagggtaacgggggttgta

SEQ ID NO: 183504 - DNA, 36 bp, Artificial Sequence
  Synthetic oligonucleotide
tctgcaccgcctcgaacctggtcctaccctacctta

SEQ ID NO: 183505 - DNA, 36 bp, Artificial Sequence
  Synthetic oligonucleotide
tccatgcgcctatcgctgcatcactccgctggctta

SEQ ID NO: 183506 - DNA, 36 bp, Artificial Sequence
  Synthetic oligonucleotide
attaccgccgccatgtcgcggtgtttcacctcttta

SEQ ID NO: 183507 - DNA, 36 bp, Artificial Sequence
  Synthetic oligonucleotide
ggggagagggggggccgtatcgttggtggagtttta

SEQ ID NO: 183508 - DNA, 35 bp, Artificial Sequence
  Synthetic oligonucleotide
gtcgacactcgccagcccccctgcgaccactccac

SEQ ID NO: 183509 - DNA, 35 bp, Artificial Sequence
  Synthetic oligonucleotide
ggacaatcttcagcaccctgtttctccagttccac

SEQ ID NO: 183510 - DNA, 35 bp, Artificial Sequence
  Synthetic oligonucleotide
tgtacatgttgtgcattcaggcccctcctaccgac

SEQ ID NO: 183511 - DNA, 35 bp, Artificial Sequence
  Synthetic oligonucleotide
actcccctgccatagccgtcactttcctccgggac

SEQ ID NO: 183512 - DNA, 35 bp, Artificial Sequence
  Synthetic oligonucleotide
aacccacttgccgttttattcgtcatgccttctac

SEQ ID NO: 183513 - DNA, 35 bp, Artificial Sequence
  Synthetic oligonucleotide
gcccgaacttcagttcgatgacccaacacttttac

SEQ ID NO: 183514 - DNA, 35 bp, Artificial Sequence
  Synthetic oligonucleotide
gtacgaggagcatatcgtctcgcccccctgtaacc

SEQ ID NO: 183515 - DNA, 35 bp, Artificial Sequence
  Synthetic oligonucleotide
gtatgcagccgtgccgtgcccttcccacacatacc

SEQ ID NO: 183516 - DNA, 35 bp, Artificial Sequence
  Synthetic oligonucleotide
ttccccgccagcctgtctcgttcgatcgcactacc

SEQ ID NO: 183517 - DNA, 35 bp, Artificial Sequence
  Synthetic oligonucleotide
gttgcccgccgcatggcttatgtcttggccgtacc

SEQ ID NO: 183518 - DNA, 35 bp, Artificial Sequence
  Synthetic oligonucleotide
tatgaccctccaatgcaccaacttccggcccaccc

SEQ ID NO: 183519 - DNA, 35 bp, Artificial Sequence
  Synthetic oligonucleotide
ggtcccgtctcatcatcgcatacgttccgccgccc

SEQ ID NO: 183520 - DNA, 35 bp, Artificial Sequence
  Synthetic oligonucleotide
ttcacctccgctaccactcgttcaaatattggccc

SEQ ID NO: 183521 - DNA, 35 bp, Artificial Sequence
  Synthetic oligonucleotide
gacagccagccggtcatcaagtaccccttcacgcc

SEQ ID NO: 183522 - DNA, 35 bp, Artificial Sequence
  Synthetic oligonucleotide
agcatccataccagttacgtgctcacatacccgcc

SEQ ID NO: 183523 - DNA, 35 bp, Artificial Sequence
  Synthetic oligonucleotide
gcccatccttagattagttttctgtcccggtggcc

SEQ ID NO: 183524 - DNA, 35 bp, Artificial Sequence
  Synthetic oligonucleotide
gattcgcacagactatgcctctatccgcgcctgcc

SEQ ID NO: 183525 - DNA, 35 bp, Artificial Sequence
  Synthetic oligonucleotide
gtctgcgcgcgaatctttccccccttttaggctcc

SEQ ID NO: 183526 - DNA, 35 bp, Artificial Sequence
  Synthetic oligonucleotide
atggcggctcattccgctccctgttatctcggtcc

SEQ ID NO: 183527 - DNA, 35 bp, Artificial Sequence
  Synthetic oligonucleotide
gtgccctgccttgggtcccccggatctcgcattcc

SEQ ID NO: 183528 - DNA, 35 bp, Artificial Sequence
  Synthetic oligonucleotide
ggacacgcacttggtctttatcgtgcctgtcttcc

SEQ ID NO: 183529 - DNA, 35 bp, Artificial Sequence
  Synthetic oligonucleotide
actccactgtgccatgtaattatctttgcggttcc

SEQ ID NO: 183530 - DNA, 35 bp, Artificial Sequence
  Synthetic oligonucleotide
gcgacgtgaaatcttgtcgcgtgttctacttttcc

SEQ ID NO: 183531 - DNA, 35 bp, Artificial Sequence
  Synthetic oligonucleotide
catgaaccccgcacgatcttgtcgccatgttttcc

SEQ ID NO: 183532 - DNA, 35 bp, Artificial Sequence
  Synthetic oligonucleotide
tcgcccccactgccttgtctcaaacagagccctgc

SEQ ID NO: 183533 - DNA, 35 bp, Artificial Sequence
  Synthetic oligonucleotide
ttcagaccacctaggccatagaccccccctcttgc

SEQ ID NO: 183534 - DNA, 35 bp, Artificial Sequence
  Synthetic oligonucleotide
aaaccgctacgccggccgcccttctgctcgtttgc

SEQ ID NO: 183535 - DNA, 35 bp, Artificial Sequence
  Synthetic oligonucleotide
taaatccccgccccaccgtgaggtagaaatccatc

SEQ ID NO: 183536 - DNA, 35 bp, Artificial Sequence
  Synthetic oligonucleotide
gcccacgtatccatgcttttatcgggtccctactc

SEQ ID NO: 183537 - DNA, 35 bp, Artificial Sequence
  Synthetic oligonucleotide
atcacagttcgggctagatctgcgcctcatacctc

SEQ ID NO: 183538 - DNA, 35 bp, Artificial Sequence
  Synthetic oligonucleotide
tccgccacgaatcatgtaggctctcccgccttgtc

SEQ ID NO: 183539 - DNA, 35 bp, Artificial Sequence
  Synthetic oligonucleotide
gtccctcctgccgatgagactcctgcccttcattc

SEQ ID NO: 183540 - DNA, 35 bp, Artificial Sequence
  Synthetic oligonucleotide
accgggcctaccggattcctcaatgaaccaccttc

SEQ ID NO: 183541 - DNA, 35 bp, Artificial Sequence
  Synthetic oligonucleotide
gccctccgcgaccccatgagtggccatcattgttc

SEQ ID NO: 183542 - DNA, 35 bp, Artificial Sequence
  Synthetic oligonucleotide
tcacgtgccgtttttgtaagccctaccccttgttc

SEQ ID NO: 183543 - DNA, 35 bp, Artificial Sequence
  Synthetic oligonucleotide
tcctccacctcactacctcacggcaccccgctttc

SEQ ID NO: 183544 - DNA, 35 bp, Artificial Sequence
  Synthetic oligonucleotide
gtagtgcgatgagggcaagtgggggggatattcag

SEQ ID NO: 183545 - DNA, 35 bp, Artificial Sequence
  Synthetic oligonucleotide
acaccctccgcccgggcatcatgccgtagcctacg

SEQ ID NO: 183546 - DNA, 35 bp, Artificial Sequence
  Synthetic oligonucleotide
tcttacgtacccagccgcgtacttcgcttgccccg

SEQ ID NO: 183547 - DNA, 35 bp, Artificial Sequence
  Synthetic oligonucleotide
gtcccctgccatctgcctcaaccaactccgttccg

SEQ ID NO: 183548 - DNA, 35 bp, Artificial Sequence
  Synthetic oligonucleotide
gactcaccgctctccactttgctccccgcattgcg

SEQ ID NO: 183549 - DNA, 35 bp, Artificial Sequence
  Synthetic oligonucleotide
gacagctcactgaatttgtctcccttcccccttcg

SEQ ID NO: 183550 - DNA, 35 bp, Artificial Sequence
  Synthetic oligonucleotide
tcaacgccacggtcccatattggtgcacctcttcg

SEQ ID NO: 183551 - DNA, 35 bp, Artificial Sequence
  Synthetic oligonucleotide
tgtgtcgcccgcctctgcccttctaactctgttcg

SEQ ID NO: 183552 - DNA, 35 bp, Artificial Sequence
  Synthetic oligonucleotide
acaccaccttcaacgggcatgcgcacggccgtagg

SEQ ID NO: 183553 - DNA, 35 bp, Artificial Sequence
  Synthetic oligonucleotide
gtcctgttcccgtgcaaccctaccccatcctcggg

SEQ ID NO: 183554 - DNA, 35 bp, Artificial Sequence
  Synthetic oligonucleotide
tagatgagcgggggggtaatgggctacacgatggg

SEQ ID NO: 183555 - DNA, 35 bp, Artificial Sequence
  Synthetic oligonucleotide
tcctgcccttccttgctatgccagaccatctactg

SEQ ID NO: 183556 - DNA, 35 bp, Artificial Sequence
  Synthetic oligonucleotide
aaaaaggtaaagaggggggaaggggagacactctg

SEQ ID NO: 183557 - DNA, 35 bp, Artificial Sequence
  Synthetic oligonucleotide
gaagtgggggagagtgggtcgaacggcattagttg

SEQ ID NO: 183558 - DNA, 36 bp, Artificial Sequence
  Synthetic oligonucleotide
atcgcaccgcccggcctcatttcgcaccctcccaat

SEQ ID NO: 183559 - DNA, 35 bp, Artificial Sequence
  Synthetic oligonucleotide
gatatcacgcaggtcactcatatgctgccctccat

SEQ ID NO: 183560 - DNA, 35 bp, Artificial Sequence
  Synthetic oligonucleotide
tcgtcccagtccgctataaactctgcccgctccat

SEQ ID NO: 183561 - DNA, 35 bp, Artificial Sequence
  Synthetic oligonucleotide
gcgctcctctcgttttaagctccttcgttcctact

SEQ ID NO: 183562 - DNA, 35 bp, Artificial Sequence
  Synthetic oligonucleotide
atagcaaccctgcgactcacaggccacacacacct

SEQ ID NO: 183563 - DNA, 35 bp, Artificial Sequence
  Synthetic oligonucleotide
aagtccgcccgtcactcatgtctcctattgcccct

SEQ ID NO: 183564 - DNA, 35 bp, Artificial Sequence
  Synthetic oligonucleotide
ccgatcgtcacgtttctttagcgcgcctcgtccct

SEQ ID NO: 183565 - DNA, 35 bp, Artificial Sequence
  Synthetic oligonucleotide
ttgtacctctccgtttgcacctggccttattccct

SEQ ID NO: 183566 - DNA, 35 bp, Artificial Sequence
  Synthetic oligonucleotide
ttctgtcctttccgccctgtcatgcataccctcct

SEQ ID NO: 183567 - DNA, 35 bp, Artificial Sequence
  Synthetic oligonucleotide
tgaagcgcagagcgagccccacgccccaatctcct

SEQ ID NO: 183568 - DNA, 35 bp, Artificial Sequence
  Synthetic oligonucleotide
acagcgccaagcgcacgcgacatacttcccccgct

SEQ ID NO: 183569 - DNA, 35 bp, Artificial Sequence
  Synthetic oligonucleotide
atgatgccgctgccccccgccgccagatcttggct

SEQ ID NO: 183570 - DNA, 35 bp, Artificial Sequence
  Synthetic oligonucleotide
gtacccacgagctggtacttctaccgttcacttct

SEQ ID NO: 183571 - DNA, 35 bp, Artificial Sequence
  Synthetic oligonucleotide
atgctagggcggggtaaataggggaaagtggccgt

SEQ ID NO: 183572 - DNA, 35 bp, Artificial Sequence
  Synthetic oligonucleotide
ttgctgaccccgccctccacgcccacgctcgtcgt

SEQ ID NO: 183573 - DNA, 35 bp, Artificial Sequence
  Synthetic oligonucleotide
tgctacctacttgctactacccctgttcatacggt

SEQ ID NO: 183574 - DNA, 35 bp, Artificial Sequence
  Synthetic oligonucleotide
tctgtggataggccgtggaggggtggggattgggt

SEQ ID NO: 183575 - DNA, 36 bp, Artificial Sequence
  Synthetic oligonucleotide
gagatagcaaacggggaggggaacgggggtagatgt

SEQ ID NO: 183576 - DNA, 35 bp, Artificial Sequence
  Synthetic oligonucleotide
gctgatccgccggcacgccacacccggttaacatt

SEQ ID NO: 183577 - DNA, 35 bp, Artificial Sequence
  Synthetic oligonucleotide
tacgcccctgacactgtaacccctcgatctacatt

SEQ ID NO: 183578 - DNA, 35 bp, Artificial Sequence
  Synthetic oligonucleotide
tccgatccaccaaccagcctggcatatcaatgatt

SEQ ID NO: 183579 - DNA, 35 bp, Artificial Sequence
  Synthetic oligonucleotide
aacgcaagaccgccacacatccggccgcccttgtt

SEQ ID NO: 183580 - DNA, 35 bp, Artificial Sequence
  Synthetic oligonucleotide
aggtgatgccagataggttgtccgccccccccttt

SEQ ID NO: 183581 - DNA, 35 bp, Artificial Sequence
  Synthetic oligonucleotide
gttcagcatcatctatcggtctttcgcccagcttt

SEQ ID NO: 183582 - DNA, 35 bp, Artificial Sequence
  Synthetic oligonucleotide
tgcccaaggtcagacctcacgccgtcccaactttt

SEQ ID NO: 183583 - DNA, 35 bp, Artificial Sequence
  Synthetic oligonucleotide
ggagtcacagtctgacgccgccccccaattaccaa

SEQ ID NO: 183584 - DNA, 28 bp, Artificial Sequence
  Synthetic oligonucleotide
gtaacctaacccgccgagtcgcccccaa

SEQ ID NO: 183585 - DNA, 36 bp, Artificial Sequence
  Synthetic oligonucleotide
gacgtccctccgccgctcgctgtacctgtattgcaa

SEQ ID NO: 183586 - DNA, 32 bp, Artificial Sequence
  Synthetic oligonucleotide
ggatcgaccccccgccttgtcaagtatctcaa

SEQ ID NO: 183587 - DNA, 36 bp, Artificial Sequence
  Synthetic oligonucleotide
aatccgccagtcggttatctacgacccttctcctaa

SEQ ID NO: 183588 - DNA, 26 bp, Artificial Sequence
  Synthetic oligonucleotide
gaggacctaccaaccgccgcccttaa

SEQ ID NO: 183589 - DNA, 36 bp, Artificial Sequence
  Synthetic oligonucleotide
gttcgctcgcccatctttgtcccagttatacgcaca

SEQ ID NO: 183590 - DNA, 35 bp, Artificial Sequence
  Synthetic oligonucleotide
tgcaagggccactcgcacggcatccaccctctaca

SEQ ID NO: 183591 - DNA, 36 bp, Artificial Sequence
  Synthetic oligonucleotide
agagaccccgccccgttactgcttttattcgcacca

SEQ ID NO: 183592 - DNA, 36 bp, Artificial Sequence
  Synthetic oligonucleotide
acccacgctcacctctcaatttgcggctaccgacca

SEQ ID NO: 183593 - DNA, 33 bp, Artificial Sequence
  Synthetic oligonucleotide
gtgccatccagcacaagttccttacgtacccca

SEQ ID NO: 183594 - DNA, 36 bp, Artificial Sequence
  Synthetic oligonucleotide
aaccaggcctcagctcccgtatcatctccatcgcca

SEQ ID NO: 183595 - DNA, 36 bp, Artificial Sequence
  Synthetic oligonucleotide
ttgtcctctcagctcctggttttcctccttcatcca

SEQ ID NO: 183596 - DNA, 35 bp, Artificial Sequence
  Synthetic oligonucleotide
aacacctccgattgccggttacccgtgcccctcca

SEQ ID NO: 183597 - DNA, 35 bp, Artificial Sequence
  Synthetic oligonucleotide
tctgaccccccccgttagccattgggtgcttagca

SEQ ID NO: 183598 - DNA, 36 bp, Artificial Sequence
  Synthetic oligonucleotide
gacattgcctatgtatccctgtttccgtgtctcgca

SEQ ID NO: 183599 - DNA, 36 bp, Artificial Sequence
  Synthetic oligonucleotide
aactcatggcggaggagggtgtcctgggtggtggca

SEQ ID NO: 183600 - DNA, 36 bp, Artificial Sequence
  Synthetic oligonucleotide
tgaccactacgtgccctccccagtgcaatacctgca

SEQ ID NO: 183601 - DNA, 36 bp, Artificial Sequence
  Synthetic oligonucleotide
tgccgcaactatgttctgtactccgtctctctatca

SEQ ID NO: 183602 - DNA, 36 bp, Artificial Sequence
  Synthetic oligonucleotide
gatgaccacaaatacgttttagccccgccattctca

SEQ ID NO: 183603 - DNA, 36 bp, Artificial Sequence
  Synthetic oligonucleotide
ttgctcgctcgcccgcactccccagtgattgcttca

SEQ ID NO: 183604 - DNA, 36 bp, Artificial Sequence
  Synthetic oligonucleotide
ggtgcggcgcctcgctctctcttgttctgcatttca

SEQ ID NO: 183605 - DNA, 37 bp, Artificial Sequence
  Synthetic oligonucleotide
acgcggagggaggggattcaagcaggggcgattgaga

SEQ ID NO: 183606 - DNA, 36 bp, Artificial Sequence
  Synthetic oligonucleotide
tcgacgccccctccccccgcttgaagaacaagacga

SEQ ID NO: 183607 - DNA, 37 bp, Artificial Sequence
  Synthetic oligonucleotide
tagcccctcttgttcctgttaacgccctggcctacga

SEQ ID NO: 183608 - DNA, 35 bp, Artificial Sequence
  Synthetic oligonucleotide
atccgtcacccacttcatctggttcgctcctacga

SEQ ID NO: 183609 - DNA, 36 bp, Artificial Sequence
  Synthetic oligonucleotide
gatgcaccacctgtcttaaaacggcttttaccccga

SEQ ID NO: 183610 - DNA, 36 bp, Artificial Sequence
  Synthetic oligonucleotide
aaccccccgtgaccatcttatctggtgccagcccga

SEQ ID NO: 183611 - DNA, 36 bp, Artificial Sequence
  Synthetic oligonucleotide
ttcaagcaccatatcctcagcgctccctcgttccga

SEQ ID NO: 183612 - DNA, 37 bp, Artificial Sequence
  Synthetic oligonucleotide
gatgctacatcggccttcgctcctccatcggttccga

SEQ ID NO: 183613 - DNA, 36 bp, Artificial Sequence
  Synthetic oligonucleotide
tccctcatgtcccgcctttccccaacgcttccgcga

SEQ ID NO: 183614 - DNA, 37 bp, Artificial Sequence
  Synthetic oligonucleotide
ttgtccgtcgccgatcgctcccttttacaccgcagga

SEQ ID NO: 183615 - DNA, 37 bp, Artificial Sequence
  Synthetic oligonucleotide
acgaagtggggcgggtggtgattaagctggggaggga

SEQ ID NO: 183616 - DNA, 37 bp, Artificial Sequence
  Synthetic oligonucleotide
gaggggtggaggcaaacgggtaaagggggggagggga

SEQ ID NO: 183617 - DNA, 37 bp, Artificial Sequence
  Synthetic oligonucleotide
atcaaaaacggggcaggggggaattgctgggagggga

SEQ ID NO: 183618 - DNA, 37 bp, Artificial Sequence
  Synthetic oligonucleotide
gaggaaagtgcgaatgggggatgaaggaggtatggga

SEQ ID NO: 183619 - DNA, 36 bp, Artificial Sequence
  Synthetic oligonucleotide
gaccgacttctcttgcctacccgccttagccctgga

SEQ ID NO: 183620 - DNA, 37 bp, Artificial Sequence
  Synthetic oligonucleotide
gcaagaagtaggggcggaaggattgtcggggcgtgga

SEQ ID NO: 183621 - DNA, 37 bp, Artificial Sequence
  Synthetic oligonucleotide
catggagggggaggggttcttatattcggaaggtgga

SEQ ID NO: 183622 - DNA, 37 bp, Artificial Sequence
  Synthetic oligonucleotide
tggggagtggcggtttccatcctagggcggtggtgga

SEQ ID NO: 183623 - DNA, 38 bp, Artificial Sequence
  Synthetic oligonucleotide
aaaaacggagggctgcaaagaggaggagggcgggatga

SEQ ID NO: 183624 - DNA, 37 bp, Artificial Sequence
  Synthetic oligonucleotide
gagggcggagggaggggggtggatttggacggtatga

SEQ ID NO: 183625 - DNA, 38 bp, Artificial Sequence
  Synthetic oligonucleotide
gaaggggtggtggatggtagtatcggccggtggtatga

SEQ ID NO: 183626 - DNA, 38 bp, Artificial Sequence
  Synthetic oligonucleotide
gaccccgaagttgactatccgctctccgctatcactga

SEQ ID NO: 183627 - DNA, 38 bp, Artificial Sequence
  Synthetic oligonucleotide
tacgcgccctctcgttccttataacctctacggcctga

SEQ ID NO: 183628 - DNA, 38 bp, Artificial Sequence
  Synthetic oligonucleotide
tcagacccctgcgtcggcctggaccactccttctctga

SEQ ID NO: 183629 - DNA, 38 bp, Artificial Sequence
  Synthetic oligonucleotide
gcacgaagcagggagggaaaaagaatagcgcgaagtga

SEQ ID NO: 183630 - DNA, 35 bp, Artificial Sequence
  Synthetic oligonucleotide
gacagggaacgaatcggggaagtggacggaagtga

SEQ ID NO: 183631 - DNA, 38 bp, Artificial Sequence
  Synthetic oligonucleotide
tgcccggacgggcagggtgggctcataagggagagtga

SEQ ID NO: 183632 - DNA, 38 bp, Artificial Sequence
  Synthetic oligonucleotide
gcgagtatcgggtgggacggaagcaagggcggcggtga

SEQ ID NO: 183633 - DNA, 38 bp, Artificial Sequence
  Synthetic oligonucleotide
aaggtcagatcagggacggtagagagagggaggggtga

SEQ ID NO: 183634 - DNA, 38 bp, Artificial Sequence
  Synthetic oligonucleotide
agaggggcagatgaagaagagggtggaaagcggggtga

SEQ ID NO: 183635 - DNA, 35 bp, Artificial Sequence
  Synthetic oligonucleotide
agagttaagtggggtgagcaagggcggtatggtga

SEQ ID NO: 183636 - DNA, 38 bp, Artificial Sequence
  Synthetic oligonucleotide
gcgggtggtgggtcgggggagcgaggggcagttggtga

SEQ ID NO: 183637 - DNA, 38 bp, Artificial Sequence
  Synthetic oligonucleotide
tagccccaccaccatgcatccagctccaccacttgtga

SEQ ID NO: 183638 - DNA, 37 bp, Artificial Sequence
  Synthetic oligonucleotide
gtgtaagggtacgtgggtgggggggcgcaaagattga

SEQ ID NO: 183639 - DNA, 36 bp, Artificial Sequence
  Synthetic oligonucleotide
tctacccgcctgttaaacatcacactcgtcgcttga

SEQ ID NO: 183640 - DNA, 38 bp, Artificial Sequence
  Synthetic oligonucleotide
gacgggcgagggagacggaatgggaggcggaatcttga

SEQ ID NO: 183641 - DNA, 38 bp, Artificial Sequence
  Synthetic oligonucleotide
gttcacagcagtgtgcccgccctttcttccgctcttga

SEQ ID NO: 183642 - DNA, 36 bp, Artificial Sequence
  Synthetic oligonucleotide
atggtggtcggttgcgcctgttctcctcccgcgata

SEQ ID NO: 183643 - DNA, 36 bp, Artificial Sequence
  Synthetic oligonucleotide
gtcatgtccggcgcattcaccaccgtattcatccta

SEQ ID NO: 183644 - DNA, 36 bp, Artificial Sequence
  Synthetic oligonucleotide
gagaaagtggtgggggtaggaaagacgacataggta

SEQ ID NO: 183645 - DNA, 35 bp, Artificial Sequence
  Synthetic oligonucleotide
gcggggcctctatctccatcctgaccttcttggta

SEQ ID NO: 183646 - DNA, 35 bp, Artificial Sequence
  Synthetic oligonucleotide
acaccaccgacccccacccaacatttattggtgta

SEQ ID NO: 183647 - DNA, 36 bp, Artificial Sequence
  Synthetic oligonucleotide
gtacccctagcccacgccttataagctaccgcatta

SEQ ID NO: 183648 - DNA, 36 bp, Artificial Sequence
  Synthetic oligonucleotide
tcctgcctcacgtactctgttacccaccctgtatta

SEQ ID NO: 183649 - DNA, 35 bp, Artificial Sequence
  Synthetic oligonucleotide
agccacatcactttcccacgctgcattgctctaac

SEQ ID NO: 183650 - DNA, 35 bp, Artificial Sequence
  Synthetic oligonucleotide
tctcactcgaccacttttggtccacggtcccacac

SEQ ID NO: 183651 - DNA, 35 bp, Artificial Sequence
  Synthetic oligonucleotide
tttgccaccctccacgtgtctttttcggattccac

SEQ ID NO: 183652 - DNA, 35 bp, Artificial Sequence
  Synthetic oligonucleotide
gcctacgtctggtcggtacccatccacatctgcac

SEQ ID NO: 183653 - DNA, 35 bp, Artificial Sequence
  Synthetic oligonucleotide
aaatcgcaggtctgtccgccggaatttcccccacc

SEQ ID NO: 183654 - DNA, 35 bp, Artificial Sequence
  Synthetic oligonucleotide
gaatgccgctccggtctttttacagaattgccacc

SEQ ID NO: 183655 - DNA, 35 bp, Artificial Sequence
  Synthetic oligonucleotide
atcgccaatgtcctgcccgcagtgcttcgctaccc

SEQ ID NO: 183656 - DNA, 35 bp, Artificial Sequence
  Synthetic oligonucleotide
gtcgatgactttgttcacttatagcctgttacccc

SEQ ID NO: 183657 - DNA, 35 bp, Artificial Sequence
  Synthetic oligonucleotide
ggagaggttcaggccctgttatctcgctcgccccc

SEQ ID NO: 183658 - DNA, 35 bp, Artificial Sequence
  Synthetic oligonucleotide
gatgtccgtcgctcgttctgcaagaaatctgcccc

SEQ ID NO: 183659 - DNA, 35 bp, Artificial Sequence
  Synthetic oligonucleotide
gtgcgttaggaatgacgatccttcccctgtgcccc

SEQ ID NO: 183660 - DNA, 35 bp, Artificial Sequence
  Synthetic oligonucleotide
tgcgctcgacttgtcgaatcaaccttggtctcccc

SEQ ID NO: 183661 - DNA, 35 bp, Artificial Sequence
  Synthetic oligonucleotide
gtgtggtgggggggcacacacgggggttatcgccc

SEQ ID NO: 183662 - DNA, 34 bp, Artificial Sequence
  Synthetic oligonucleotide
gcctacccccccggttccgcttacattgtcgccc

SEQ ID NO: 183663 - DNA, 35 bp, Artificial Sequence
  Synthetic oligonucleotide
taacttggtgccgtcccttgcctttagtcgttccc

SEQ ID NO: 183664 - DNA, 35 bp, Artificial Sequence
  Synthetic oligonucleotide
atgcgatgtgcacctgccaccgttcttctaaagcc

SEQ ID NO: 183665 - DNA, 35 bp, Artificial Sequence
  Synthetic oligonucleotide
attaccccgctcatagcccttccacgaacgtagcc

SEQ ID NO: 183666 - DNA, 35 bp, Artificial Sequence
  Synthetic oligonucleotide
acaacagtagacctcgctccttccaggcccccgcc

SEQ ID NO: 183667 - DNA, 35 bp, Artificial Sequence
  Synthetic oligonucleotide
tgccgcacacctgcctgctccattgatgacatgcc

SEQ ID NO: 183668 - DNA, 35 bp, Artificial Sequence
  Synthetic oligonucleotide
gtgccctgcccaatcgtattctgcggctgcactcc

SEQ ID NO: 183669 - DNA, 35 bp, Artificial Sequence
  Synthetic oligonucleotide
attccgatagcgccgccaccatctagttcccttcc

SEQ ID NO: 183670 - DNA, 35 bp, Artificial Sequence
  Synthetic oligonucleotide
gtcacaccatggctatcacctgcaccaacatccgc

SEQ ID NO: 183671 - DNA, 35 bp, Artificial Sequence
  Synthetic oligonucleotide
gtggaccctcgcatccgtgacaatcaattcgcatc

SEQ ID NO: 183672 - DNA, 35 bp, Artificial Sequence
  Synthetic oligonucleotide
accgctcgcacctcgccgtgagctcattagttatc

SEQ ID NO: 183673 - DNA, 35 bp, Artificial Sequence
  Synthetic oligonucleotide
acccttgtcctctttcatacgatcacctggaactc

SEQ ID NO: 183674 - DNA, 35 bp, Artificial Sequence
  Synthetic oligonucleotide
gcagtagggactactgtcgatatttccgcccactc

SEQ ID NO: 183675 - DNA, 35 bp, Artificial Sequence
  Synthetic oligonucleotide
gacctgcacatgttcatcgcttatcgccctccctc

SEQ ID NO: 183676 - DNA, 35 bp, Artificial Sequence
  Synthetic oligonucleotide
gtcgaaggctagtcgacctccccgtttcttgcctc

SEQ ID NO: 183677 - DNA, 35 bp, Artificial Sequence
  Synthetic oligonucleotide
gccgtgccatcacccgggtcttactaacgctcctc

SEQ ID NO: 183678 - DNA, 35 bp, Artificial Sequence
  Synthetic oligonucleotide
tctatccgcgcctagccgtctgatagtctcttctc

SEQ ID NO: 183679 - DNA, 35 bp, Artificial Sequence
  Synthetic oligonucleotide
tcgcgtaacgctgagtttctccttccatttctgtc

SEQ ID NO: 183680 - DNA, 35 bp, Artificial Sequence
  Synthetic oligonucleotide
gacgctcctgctcgtgccgcatttatacccttgtc

SEQ ID NO: 183681 - DNA, 35 bp, Artificial Sequence
  Synthetic oligonucleotide
ttttaacccccgcccgctgaactccgtgagctttc

SEQ ID NO: 183682 - DNA, 35 bp, Artificial Sequence
  Synthetic oligonucleotide
atcgtcgaccttgcttgtcctgcttttacggtttc

SEQ ID NO: 183683 - DNA, 35 bp, Artificial Sequence
  Synthetic oligonucleotide
tccgccacgcacagcccgtttccaccaaaccgcag

SEQ ID NO: 183684 - DNA, 35 bp, Artificial Sequence
  Synthetic oligonucleotide
gagcgccccctgaccccatgcctgactggactacg

SEQ ID NO: 183685 - DNA, 35 bp, Artificial Sequence
  Synthetic oligonucleotide
taacatcctgtcgtgaccattcgcaaccactcccg

SEQ ID NO: 183686 - DNA, 35 bp, Artificial Sequence
  Synthetic oligonucleotide
ggagacctcaagccatcctgttttcccatgtcccg

SEQ ID NO: 183687 - DNA, 35 bp, Artificial Sequence
  Synthetic oligonucleotide
gtcaccagcctcctattcttcgcctccgccctccg

SEQ ID NO: 183688 - DNA, 35 bp, Artificial Sequence
  Synthetic oligonucleotide
gcccccgcctgccccagaacagatccttgtgcgcg

SEQ ID NO: 183689 - DNA, 36 bp, Artificial Sequence
  Synthetic oligonucleotide
ggggtgggcgcatgccataatatagtgaaagagggg

SEQ ID NO: 183690 - DNA, 34 bp, Artificial Sequence
  Synthetic oligonucleotide
aacccccccccgtgtgacgtgaatgaccaccatg

SEQ ID NO: 183691 - DNA, 35 bp, Artificial Sequence
  Synthetic oligonucleotide
tcgtccctcccgatggtctccctgccgcatcactg

SEQ ID NO: 183692 - DNA, 35 bp, Artificial Sequence
  Synthetic oligonucleotide
gactattcccaacgccgacgctccacccggtgctg

SEQ ID NO: 183693 - DNA, 35 bp, Artificial Sequence
  Synthetic oligonucleotide
taacaggcctgttccatctttccgtcctcccggtg

SEQ ID NO: 183694 - DNA, 35 bp, Artificial Sequence
  Synthetic oligonucleotide
ccacaatacccgccgatctgctccccccgcctttg

SEQ ID NO: 183695 - DNA, 34 bp, Artificial Sequence
  Synthetic oligonucleotide
gaggggtgggtgtgggtgggccactccttgtttg

SEQ ID NO: 183696 - DNA, 35 bp, Artificial Sequence
  Synthetic oligonucleotide
aatcccgttcatgtgcgactccccccgtccccaat

SEQ ID NO: 183697 - DNA, 35 bp, Artificial Sequence
  Synthetic oligonucleotide
tccacctgtccatttggactttatgacttccccat

SEQ ID NO: 183698 - DNA, 35 bp, Artificial Sequence
  Synthetic oligonucleotide
tcacgcccctgacgccaatagcggaggttctccat

SEQ ID NO: 183699 - DNA, 35 bp, Artificial Sequence
  Synthetic oligonucleotide
agatccgccgcacacccagtttaccgcttcttcat

SEQ ID NO: 183700 - DNA, 35 bp, Artificial Sequence
  Synthetic oligonucleotide
tataatcagcgacaccgctcctctcgcctcactat

SEQ ID NO: 183701 - DNA, 33 bp, Artificial Sequence
  Synthetic oligonucleotide
tggtcatggcgggggggggcggaggtaacctat

SEQ ID NO: 183702 - DNA, 35 bp, Artificial Sequence
  Synthetic oligonucleotide
acttacacacctgatggctctctgccacccgcact

SEQ ID NO: 183703 - DNA, 35 bp, Artificial Sequence
  Synthetic oligonucleotide
actccgccgaacacacttcaatgaagactgtcact

SEQ ID NO: 183704 - DNA, 35 bp, Artificial Sequence
  Synthetic oligonucleotide
gattgactcgcccattcagatcttacctgtgccct

SEQ ID NO: 183705 - DNA, 35 bp, Artificial Sequence
  Synthetic oligonucleotide
tgccaccccggacccaataggacatccatcagcct

SEQ ID NO: 183706 - DNA, 35 bp, Artificial Sequence
  Synthetic oligonucleotide
actcgctcccccttggtttttatgcacaccctgct

SEQ ID NO: 183707 - DNA, 35 bp, Artificial Sequence
  Synthetic oligonucleotide
atgtgcctacagacgcttatctatctgccgctgct

SEQ ID NO: 183708 - DNA, 35 bp, Artificial Sequence
  Synthetic oligonucleotide
gcgatacctctggcccccgctattattgttaatct

SEQ ID NO: 183709 - DNA, 35 bp, Artificial Sequence
  Synthetic oligonucleotide
tcatcacaccctcaatgagtgccgcttatcgctct

SEQ ID NO: 183710 - DNA, 35 bp, Artificial Sequence
  Synthetic oligonucleotide
gacacccgatattttagtccccgcctacccagtct

SEQ ID NO: 183711 - DNA, 35 bp, Artificial Sequence
  Synthetic oligonucleotide
gtctccccctgtgcatgcactctcgcgttacttct

SEQ ID NO: 183712 - DNA, 35 bp, Artificial Sequence
  Synthetic oligonucleotide
atgcacgcatgcacagcctggcttccgcccccagt

SEQ ID NO: 183713 - DNA, 35 bp, Artificial Sequence
  Synthetic oligonucleotide
gcccacacgggtgtattctgtggcctttccctcgt

SEQ ID NO: 183714 - DNA, 35 bp, Artificial Sequence
  Synthetic oligonucleotide
acacgatcactccttgcacccgccttgtacttcgt

SEQ ID NO: 183715 - DNA, 35 bp, Artificial Sequence
  Synthetic oligonucleotide
agaccatccccaccgtcattttcaacacacacggt

SEQ ID NO: 183716 - DNA, 35 bp, Artificial Sequence
  Synthetic oligonucleotide
gacgcactcttcccgcccccattctctctagtggt

SEQ ID NO: 183717 - DNA, 35 bp, Artificial Sequence
  Synthetic oligonucleotide
tcacgtcaattatgttcggccccccctctgcatgt

SEQ ID NO: 183718 - DNA, 35 bp, Artificial Sequence
  Synthetic oligonucleotide
acagccacccccctccttaggcacggattgcactt

SEQ ID NO: 183719 - DNA, 35 bp, Artificial Sequence
  Synthetic oligonucleotide
taccccgcgagccgcacatgtacgctccactcctt

SEQ ID NO: 183720 - DNA, 35 bp, Artificial Sequence
  Synthetic oligonucleotide
ttcgctgtcgagagtagcgttgccgggcccctctt

SEQ ID NO: 183721 - DNA, 35 bp, Artificial Sequence
  Synthetic oligonucleotide
gattcgcccatgctgtgccctttatgtttctggtt

SEQ ID NO: 183722 - DNA, 35 bp, Artificial Sequence
  Synthetic oligonucleotide
acacaccacctaacatgttcgccgttccgctcttt

SEQ ID NO: 183723 - DNA, 36 bp, Artificial Sequence
  Synthetic oligonucleotide
aagggggtcaggaggagggttttagggtggtggaaa

SEQ ID NO: 183724 - DNA, 36 bp, Artificial Sequence
  Synthetic oligonucleotide
tctacgcactctgatcttatctatcgcccttcacaa

SEQ ID NO: 183725 - DNA, 36 bp, Artificial Sequence
  Synthetic oligonucleotide
gcagagcgcaagtgttcctcccccgccgtgatgcaa

SEQ ID NO: 183726 - DNA, 36 bp, Artificial Sequence
  Synthetic oligonucleotide
tcacgaagcatgcctggggaggaggggggataataa

SEQ ID NO: 183727 - DNA, 36 bp, Artificial Sequence
  Synthetic oligonucleotide
gccgccgtccattattcatggctgaccccccgttaa

SEQ ID NO: 183728 - DNA, 35 bp, Artificial Sequence
  Synthetic oligonucleotide
ttacgtcctagctccacacggcctctagattcaca

SEQ ID NO: 183729 - DNA, 35 bp, Artificial Sequence
  Synthetic oligonucleotide
atcgaaggagtgggcggggggtatcgagcgagaca

SEQ ID NO: 183730 - DNA, 36 bp, Artificial Sequence
  Synthetic oligonucleotide
tctcgcgcctagccgcaccgtagaccacctctgaca

SEQ ID NO: 183731 - DNA, 36 bp, Artificial Sequence
  Synthetic oligonucleotide
gagccccccgtcccgccttcaccgtccagttcacca

SEQ ID NO: 183732 - DNA, 35 bp, Artificial Sequence
  Synthetic oligonucleotide
tcacccaaccatctgcttaactgcgatctgtacca

SEQ ID NO: 183733 - DNA, 35 bp, Artificial Sequence
  Synthetic oligonucleotide
tcgaaactgcgtcgcttacccctgaccatccgcca

SEQ ID NO: 183734 - DNA, 36 bp, Artificial Sequence
  Synthetic oligonucleotide
gtcgatggcgcccgtcacctggtaatgtcacctcca

SEQ ID NO: 183735 - DNA, 36 bp, Artificial Sequence
  Synthetic oligonucleotide
ttgtgccatccgacggtagcgcgctgtcatggtcca

SEQ ID NO: 183736 - DNA, 36 bp, Artificial Sequence
  Synthetic oligonucleotide
tgcctacttcctgtccctcctccgtacgtatccgca

SEQ ID NO: 183737 - DNA, 36 bp, Artificial Sequence
  Synthetic oligonucleotide
tcgttccagttcgcctgtcccggtcaccctttcgca

SEQ ID NO: 183738 - DNA, 36 bp, Artificial Sequence
  Synthetic oligonucleotide
accacgacgtcagccttctctgtctgtctgccctca

SEQ ID NO: 183739 - DNA, 34 bp, Artificial Sequence
  Synthetic oligonucleotide
tgcgttacgtccagctcatacactgcgtccctca

SEQ ID NO: 183740 - DNA, 35 bp, Artificial Sequence
  Synthetic oligonucleotide
tttgccctccactgctagctgacacccgttcctca

SEQ ID NO: 183741 - DNA, 35 bp, Artificial Sequence
  Synthetic oligonucleotide
tcgcacttcaatcccgtctatccttcgcctgttca

SEQ ID NO: 183742 - DNA, 37 bp, Artificial Sequence
  Synthetic oligonucleotide
acgtggacaagggtggcgggggtgttaggggagaaga

SEQ ID NO: 183743 - DNA, 37 bp, Artificial Sequence
  Synthetic oligonucleotide
tctgctctccgcctgcatgcccctacatacacctaga

SEQ ID NO: 183744 - DNA, 37 bp, Artificial Sequence
  Synthetic oligonucleotide
gacctccttgctgttactcgcaccatagtctttacga

SEQ ID NO: 183745 - DNA, 36 bp, Artificial Sequence
  Synthetic oligonucleotide
atccagtgccctagcccgctgttattatctccccga

SEQ ID NO: 183746 - DNA, 37 bp, Artificial Sequence
  Synthetic oligonucleotide
tgcgtagcccatcttgtactcgcgaacccatcctcga

SEQ ID NO: 183747 - DNA, 36 bp, Artificial Sequence
  Synthetic oligonucleotide
gccccgatcctcccccacctaaagcaggctattcga

SEQ ID NO: 183748 - DNA, 37 bp, Artificial Sequence
  Synthetic oligonucleotide
agcatcatccatgttcgcaaaccgccctcaccttcga

SEQ ID NO: 183749 - DNA, 37 bp, Artificial Sequence
  Synthetic oligonucleotide
gtaccttcccgagtgatcggaacctcgcccttttcga

SEQ ID NO: 183750 - DNA, 37 bp, Artificial Sequence
  Synthetic oligonucleotide
gtgtcagagtgtggcggggggagctaaacgggaagga

SEQ ID NO: 183751 - DNA, 37 bp, Artificial Sequence
  Synthetic oligonucleotide
tcagtacgggagtgggggggtacacaagctcggagga

SEQ ID NO: 183752 - DNA, 37 bp, Artificial Sequence
  Synthetic oligonucleotide
acgcgggaggccggagcatggaaaggcgcagggagga

SEQ ID NO: 183753 - DNA, 37 bp, Artificial Sequence
  Synthetic oligonucleotide
taccaaccccatcctctgtgtgacacctccttgcgga

SEQ ID NO: 183754 - DNA, 37 bp, Artificial Sequence
  Synthetic oligonucleotide
accacccacacgctgatagtctcgtgcccccctcgga

SEQ ID NO: 183755 - DNA, 37 bp, Artificial Sequence
  Synthetic oligonucleotide
gtctccgccctgaccactgcctcacgtctcgaaggga

SEQ ID NO: 183756 - DNA, 36 bp, Artificial Sequence
  Synthetic oligonucleotide
gccccatcctcctttgctaatgtctccgctagggga

SEQ ID NO: 183757 - DNA, 37 bp, Artificial Sequence
  Synthetic oligonucleotide
gtgggcgggccggggagactactaacgtactatggga

SEQ ID NO: 183758 - DNA, 36 bp, Artificial Sequence
  Synthetic oligonucleotide
gttgatgccccctcgtaactgttctgtcctggtgga

SEQ ID NO: 183759 - DNA, 38 bp, Artificial Sequence
  Synthetic oligonucleotide
aacgctccccgctcctactagggtcgccattctaatga

SEQ ID NO: 183760 - DNA, 38 bp, Artificial Sequence
  Synthetic oligonucleotide
tctgggccggacagtggagaagggggtgcgagggatga

SEQ ID NO: 183761 - DNA, 38 bp, Artificial Sequence
  Synthetic oligonucleotide
tccatccgcccgactcctgcacatgtccaatgacctga

SEQ ID NO: 183762 - DNA, 37 bp, Artificial Sequence
  Synthetic oligonucleotide
tcgtggtggccgtttctgtttctcaatcctcccctga

SEQ ID NO: 183763 - DNA, 37 bp, Artificial Sequence
  Synthetic oligonucleotide
gcatgtccatttcatcctagcccacttccgtgcctga

SEQ ID NO: 183764 - DNA, 37 bp, Artificial Sequence
  Synthetic oligonucleotide
tcgccttgcaccatcctctatacgatcactatcctga

SEQ ID NO: 183765 - DNA, 35 bp, Artificial Sequence
  Synthetic oligonucleotide
tagaccgggccctcctcaagttatcactgccgtga

SEQ ID NO: 183766 - DNA, 38 bp, Artificial Sequence
  Synthetic oligonucleotide
tggggccggtcggaggctgccatcacgggaggaggtga

SEQ ID NO: 183767 - DNA, 38 bp, Artificial Sequence
  Synthetic oligonucleotide
agggaggggtcagtaaggggtatcaaatcagggggtga

SEQ ID NO: 183768 - DNA, 37 bp, Artificial Sequence
  Synthetic oligonucleotide
ttgtccgccactccgattccgtccggccccccattga

SEQ ID NO: 183769 - DNA, 38 bp, Artificial Sequence
  Synthetic oligonucleotide
acgatcgccccttgatcctatattgccactgtgattga

SEQ ID NO: 183770 - DNA, 37 bp, Artificial Sequence
  Synthetic oligonucleotide
tcatctgaccgtggttcataccgtgcctcccccttga

SEQ ID NO: 183771 - DNA, 37 bp, Artificial Sequence
  Synthetic oligonucleotide
atcaccctcattgtagaccattgtccccccgatttga

SEQ ID NO: 183772 - DNA, 35 bp, Artificial Sequence
  Synthetic oligonucleotide
ttgccccgtcacagcgcccccccaccatttgaata

SEQ ID NO: 183773 - DNA, 36 bp, Artificial Sequence
  Synthetic oligonucleotide
atccccgccccgttccatgtctcctcattattaata

SEQ ID NO: 183774 - DNA, 36 bp, Artificial Sequence
  Synthetic oligonucleotide
gtgacactcgcgccctagctattaaacgttcccata

SEQ ID NO: 183775 - DNA, 36 bp, Artificial Sequence
  Synthetic oligonucleotide
gacccactgtattgttttttgccctactggtaccta

SEQ ID NO: 183776 - DNA, 36 bp, Artificial Sequence
  Synthetic oligonucleotide
agcaccgccaagctctgttttttctgatcctgccta

SEQ ID NO: 183777 - DNA, 35 bp, Artificial Sequence
  Synthetic oligonucleotide
ttgtgctcaccgttgcgcccgtatctttgttcgta

SEQ ID NO: 183778 - DNA, 36 bp, Artificial Sequence
  Synthetic oligonucleotide
acaaaaacgagggatggcctgagagggggggaggta

SEQ ID NO: 183779 - DNA, 35 bp, Artificial Sequence
  Synthetic oligonucleotide
tccccctctcgccctctcgtgtctaatgccctgta

SEQ ID NO: 183780 - DNA, 35 bp, Artificial Sequence
  Synthetic oligonucleotide
taacagtctgccgctgaccgaccgcccccgtatta

SEQ ID NO: 183781 - DNA, 35 bp, Artificial Sequence
  Synthetic oligonucleotide
gtcatcctcgttcctggtaaagacccccgccgtta

SEQ ID NO: 183782 - DNA, 36 bp, Artificial Sequence
  Synthetic oligonucleotide
tcacccgccactcgctatctgtgagcgatcgcttta

SEQ ID NO: 183783 - DNA, 35 bp, Artificial Sequence
  Synthetic oligonucleotide
gatccatcgcaacacatatcgcccacgccttgaac

SEQ ID NO: 183784 - DNA, 35 bp, Artificial Sequence
  Synthetic oligonucleotide
gcccaactgtctctggaaaagctgcccccctacac

SEQ ID NO: 183785 - DNA, 35 bp, Artificial Sequence
  Synthetic oligonucleotide
tatgcgctacaacttgactcggccgtcgctcgcac

SEQ ID NO: 183786 - DNA, 35 bp, Artificial Sequence
  Synthetic oligonucleotide
accgcccctaatcgatcttgcgtacgacctccgac

SEQ ID NO: 183787 - DNA, 35 bp, Artificial Sequence
  Synthetic oligonucleotide
ttgaggtcagtgttgctcctacattccacctcgac

SEQ ID NO: 183788 - DNA, 35 bp, Artificial Sequence
  Synthetic oligonucleotide
tatgccgccaccgtcttggctatcctaagttctac

SEQ ID NO: 183789 - DNA, 35 bp, Artificial Sequence
  Synthetic oligonucleotide
acgtctcgatcccgtgcccgccatgtctgccgtac

SEQ ID NO: 183790 - DNA, 35 bp, Artificial Sequence
  Synthetic oligonucleotide
accgacatatgcgccctgctccgttcgcctggtac

SEQ ID NO: 183791 - DNA, 35 bp, Artificial Sequence
  Synthetic oligonucleotide
accgagtcctccgtcagcctacgcgcccgcacacc

SEQ ID NO: 183792 - DNA, 35 bp, Artificial Sequence
  Synthetic oligonucleotide
gacacaattcgatgcccctgccctaacggtccacc

SEQ ID NO: 183793 - DNA, 35 bp, Artificial Sequence
  Synthetic oligonucleotide
agcacgatcggagccgatatcacacccaccgtacc

SEQ ID NO: 183794 - DNA, 35 bp, Artificial Sequence
  Synthetic oligonucleotide
gtttcgaccatcgcccacttcgctaccgtacaccc

SEQ ID NO: 183795 - DNA, 35 bp, Artificial Sequence
  Synthetic oligonucleotide
tgcataccgcccgaacgaaatgattggcaccaccc

SEQ ID NO: 183796 - DNA, 35 bp, Artificial Sequence
  Synthetic oligonucleotide
gacgccactaactataagctcgtactatcataccc

SEQ ID NO: 183797 - DNA, 35 bp, Artificial Sequence
  Synthetic oligonucleotide
tgtgtacatcgtcggttcctcttcaccgggccccc

SEQ ID NO: 183798 - DNA, 35 bp, Artificial Sequence
  Synthetic oligonucleotide
tacaacagatggtcataccgccctcatgattgccc

SEQ ID NO: 183799 - DNA, 35 bp, Artificial Sequence
  Synthetic oligonucleotide
gctggctcagctcacgttcaccaatgcacttcgcc

SEQ ID NO: 183800 - DNA, 35 bp, Artificial Sequence
  Synthetic oligonucleotide
gccatgcccgcctgtccgtccgtcgctccgttgcc

SEQ ID NO: 183801 - DNA, 27 bp, Artificial Sequence
  Synthetic oligonucleotide
atttacccgttcatgcctatcacatcc

SEQ ID NO: 183802 - DNA, 35 bp, Artificial Sequence
  Synthetic oligonucleotide
tacgtgcatcgcttgaatctcacccagccgcatcc

SEQ ID NO: 183803 - DNA, 35 bp, Artificial Sequence
  Synthetic oligonucleotide
tcgactacccctgcctgcacgaacgctacacctcc

SEQ ID NO: 183804 - DNA, 36 bp, Artificial Sequence
  Synthetic oligonucleotide
gagccgagcccccactttgtcatcgattacccctcc

SEQ ID NO: 183805 - DNA, 35 bp, Artificial Sequence
  Synthetic oligonucleotide
gtgtcccgcggccgatactgcccctctgcgtctcc

SEQ ID NO: 183806 - DNA, 35 bp, Artificial Sequence
  Synthetic oligonucleotide
gttcacgtccggacgctaaagcgcttactctgtcc

SEQ ID NO: 183807 - DNA, 35 bp, Artificial Sequence
  Synthetic oligonucleotide
gttgacatgtccacttgttttcctggactcctcgc

SEQ ID NO: 183808 - DNA, 35 bp, Artificial Sequence
  Synthetic oligonucleotide
tatgccgtggcatcagcgtactttctccctctcgc

SEQ ID NO: 183809 - DNA, 35 bp, Artificial Sequence
  Synthetic oligonucleotide
gcaccaccacaagcccgcctcctaacaaccacggc

SEQ ID NO: 183810 - DNA, 35 bp, Artificial Sequence
  Synthetic oligonucleotide
tcactggattcctgttggtttcacgcacctcctgc

SEQ ID NO: 183811 - DNA, 35 bp, Artificial Sequence
  Synthetic oligonucleotide
gatgccatcccgccttgttccgctcaccctgctgc

SEQ ID NO: 183812 - DNA, 35 bp, Artificial Sequence
  Synthetic oligonucleotide
gggatgtgaatacatcctggatccgccccctctgc

SEQ ID NO: 183813 - DNA, 35 bp, Artificial Sequence
  Synthetic oligonucleotide
accatcacccgtggctattctaacccgctagttgc

SEQ ID NO: 183814 - DNA, 35 bp, Artificial Sequence
  Synthetic oligonucleotide
gccctctcatcctcctatccgagtcatgacgcatc

SEQ ID NO: 183815 - DNA, 35 bp, Artificial Sequence
  Synthetic oligonucleotide
ttctaagccgcccttcccatcctcgatgcactatc

SEQ ID NO: 183816 - DNA, 35 bp, Artificial Sequence
  Synthetic oligonucleotide
gagtgcgccaactccgtacttaacacctgcttatc

SEQ ID NO: 183817 - DNA, 35 bp, Artificial Sequence
  Synthetic oligonucleotide
gccgtacgtcccatcctgaccatgatttaaccctc

SEQ ID NO: 183818 - DNA, 35 bp, Artificial Sequence
  Synthetic oligonucleotide
atggtcgaccgtcctttcgtctgcagatggccctc

SEQ ID NO: 183819 - DNA, 35 bp, Artificial Sequence
  Synthetic oligonucleotide
gcccgcactaagtgccatcccaccgatcaccgctc

SEQ ID NO: 183820 - DNA, 35 bp, Artificial Sequence
  Synthetic oligonucleotide
tccgacaactaccgtgatactagtctctccctctc

SEQ ID NO: 183821 - DNA, 35 bp, Artificial Sequence
  Synthetic oligonucleotide
ttgtccgcccgctccgttcagtatgagcccgtctc

SEQ ID NO: 183822 - DNA, 36 bp, Artificial Sequence
  Synthetic oligonucleotide
aacggtccctccacccgccttcacgcgtgttttgtc

SEQ ID NO: 183823 - DNA, 35 bp, Artificial Sequence
  Synthetic oligonucleotide
tacatggaccgccctgccccctgtgtactgacttc

SEQ ID NO: 183824 - DNA, 35 bp, Artificial Sequence
  Synthetic oligonucleotide
aagcaaagtcacatacccctttgcagcctcccttc

SEQ ID NO: 183825 - DNA, 35 bp, Artificial Sequence
  Synthetic oligonucleotide
atgttgaggccacctgccctagaactgctctcttc

SEQ ID NO: 183826 - DNA, 35 bp, Artificial Sequence
  Synthetic oligonucleotide
tagactcccctccgatttcttcgtgaacatatttc

SEQ ID NO: 183827 - DNA, 35 bp, Artificial Sequence
  Synthetic oligonucleotide
tgtcaccgtacttcggttaggtccgaccccttttc

SEQ ID NO: 183828 - DNA, 35 bp, Artificial Sequence
  Synthetic oligonucleotide
tccgttgccttcgccgtcttccgttaccaccacag

SEQ ID NO: 183829 - DNA, 35 bp, Artificial Sequence
  Synthetic oligonucleotide
gcctgccaccccccttccatacgtcccggccacag

SEQ ID NO: 183830 - DNA, 35 bp, Artificial Sequence
  Synthetic oligonucleotide
atgcctctgaccctgcgcgctctcccctccggtag

SEQ ID NO: 183831 - DNA, 33 bp, Artificial Sequence
  Synthetic oligonucleotide
gtgggggaggcgacgtgagggagcaacgggtag

SEQ ID NO: 183832 - DNA, 35 bp, Artificial Sequence
  Synthetic oligonucleotide
gtccggttctcgatcgcctttctcacatgttcacg

SEQ ID NO: 183833 - DNA, 35 bp, Artificial Sequence
  Synthetic oligonucleotide
tagcccttgccgtattgcggtgctgtacctccccg

SEQ ID NO: 183834 - DNA, 34 bp, Artificial Sequence
  Synthetic oligonucleotide
tgtatgccaccgtcccaccagaacccatgtcccg

SEQ ID NO: 183835 - DNA, 35 bp, Artificial Sequence
  Synthetic oligonucleotide
tgtattacatcctgcgtgtctttagcacccctccg

SEQ ID NO: 183836 - DNA, 35 bp, Artificial Sequence
  Synthetic oligonucleotide
atctcgcaccactttacctgcaccgttccattccg

SEQ ID NO: 183837 - DNA, 35 bp, Artificial Sequence
  Synthetic oligonucleotide
gtgcgccccagaccatctagattatgatccttccg

SEQ ID NO: 183838 - DNA, 35 bp, Artificial Sequence
  Synthetic oligonucleotide
tccagcctccccccggtcatattcacctgtcatcg

SEQ ID NO: 183839 - DNA, 35 bp, Artificial Sequence
  Synthetic oligonucleotide
gacacccacgatccgttagcaaatctaccgcctcg

SEQ ID NO: 183840 - DNA, 35 bp, Artificial Sequence
  Synthetic oligonucleotide
gccgtcatcccgctccgtgcttctgtaattctagg

SEQ ID NO: 183841 - DNA, 35 bp, Artificial Sequence
  Synthetic oligonucleotide
tgtccaccctcaacccccccacgccagttcaccgg

SEQ ID NO: 183842 - DNA, 36 bp, Artificial Sequence
  Synthetic oligonucleotide
aggaggagggagtcgggggggtttgggagtccaggg

SEQ ID NO: 183843 - DNA, 35 bp, Artificial Sequence
  Synthetic oligonucleotide
taccacacgggacagggcgggtaattttaagtggg

SEQ ID NO: 183844 - DNA, 35 bp, Artificial Sequence
  Synthetic oligonucleotide
tatcctccctcacatcgcactatcggacaaataat

SEQ ID NO: 183845 - DNA, 35 bp, Artificial Sequence
  Synthetic oligonucleotide
tcaacaccttccgccatacgctccgtgcttcacat

SEQ ID NO: 183846 - DNA, 35 bp, Artificial Sequence
  Synthetic oligonucleotide
tacgtccggatcttcccttgtagcttaccatccat

SEQ ID NO: 183847 - DNA, 35 bp, Artificial Sequence
  Synthetic oligonucleotide
tgtctgctcactgttcccgtcctggtctagcctat

SEQ ID NO: 183848 - DNA, 35 bp, Artificial Sequence
  Synthetic oligonucleotide
gcaccccctcgcagccctgcctcgaatctccttat

SEQ ID NO: 183849 - DNA, 35 bp, Artificial Sequence
  Synthetic oligonucleotide
tcctcactgcgcgcttgctcattctttgccatact

SEQ ID NO: 183850 - DNA, 35 bp, Artificial Sequence
  Synthetic oligonucleotide
ttcgtgaccactgctcacgagctatcacacaccct

SEQ ID NO: 183851 - DNA, 34 bp, Artificial Sequence
  Synthetic oligonucleotide
ttgcagactggcacttgcaccgcctttcgcccct

SEQ ID NO: 183852 - DNA, 35 bp, Artificial Sequence
  Synthetic oligonucleotide
tacccaggggccatgctcctgacctcctcgttcct

SEQ ID NO: 183853 - DNA, 35 bp, Artificial Sequence
  Synthetic oligonucleotide
tctgtgccaagcaatacggtaacatcccctccgct

SEQ ID NO: 183854 - DNA, 35 bp, Artificial Sequence
  Synthetic oligonucleotide
tagtcctcacggcgtctcctctgtctataccgtct

SEQ ID NO: 183855 - DNA, 35 bp, Artificial Sequence
  Synthetic oligonucleotide
ggattgagatgtgcgattgcccgccccctacttct

SEQ ID NO: 183856 - DNA, 35 bp, Artificial Sequence
  Synthetic oligonucleotide
attgcccacttatgctctgtccgaatttcttgagt

SEQ ID NO: 183857 - DNA, 35 bp, Artificial Sequence
  Synthetic oligonucleotide
tccgccgccccttatgacaaatcactcaccagcgt

SEQ ID NO: 183858 - DNA, 35 bp, Artificial Sequence
  Synthetic oligonucleotide
gccccacagtacagtcctccttgtcgatccttcgt

SEQ ID NO: 183859 - DNA, 35 bp, Artificial Sequence
  Synthetic oligonucleotide
ttgccgagccacgttctatatcccaagtccccggt

SEQ ID NO: 183860 - DNA, 35 bp, Artificial Sequence
  Synthetic oligonucleotide
gaacgtggttcacctacttgcctctcttagccctt

SEQ ID NO: 183861 - DNA, 35 bp, Artificial Sequence
  Synthetic oligonucleotide
tgagaacgctcctgttcgtatatcctttctccctt

SEQ ID NO: 183862 - DNA, 35 bp, Artificial Sequence
  Synthetic oligonucleotide
acttgctcaacatttcgtacacatggcttctcctt

SEQ ID NO: 183863 - DNA, 35 bp, Artificial Sequence
  Synthetic oligonucleotide
taaacacgtcgaccttacattgccaccgttatctt

SEQ ID NO: 183864 - DNA, 35 bp, Artificial Sequence
  Synthetic oligonucleotide
tatccgaccgccctgatttaccacctgcgtacgtt

SEQ ID NO: 183865 - DNA, 35 bp, Artificial Sequence
  Synthetic oligonucleotide
acctcgtccaagcccgttgcgcccccacacgattt

SEQ ID NO: 183866 - DNA, 34 bp, Artificial Sequence
  Synthetic oligonucleotide
acgatgcctacctccgcgtcaccacgtcactttt

SEQ ID NO: 183867 - DNA, 35 bp, Artificial Sequence
  Synthetic oligonucleotide
acgacctcagtcgtccgccttttagcttccaccaa

SEQ ID NO: 183868 - DNA, 36 bp, Artificial Sequence
  Synthetic oligonucleotide
ttggtcccgaacccatatgccttgttgccccccgaa

SEQ ID NO: 183869 - DNA, 34 bp, Artificial Sequence
  Synthetic oligonucleotide
gtcctccaccgttaacgggccccttgctctctaa

SEQ ID NO: 183870 - DNA, 35 bp, Artificial Sequence
  Synthetic oligonucleotide
tgcccacccgcgcccgaaggttcacactatcaaca

SEQ ID NO: 183871 - DNA, 36 bp, Artificial Sequence
  Synthetic oligonucleotide
ggtagtggtcgctgttcatcgtttctgcccttcaca

SEQ ID NO: 183872 - DNA, 35 bp, Artificial Sequence
  Synthetic oligonucleotide
acccactccctgaccctcaccccagaggtttcaca

SEQ ID NO: 183873 - DNA, 35 bp, Artificial Sequence
  Synthetic oligonucleotide
tctggtcgggggagtcatagggggggggggggaca

SEQ ID NO: 183874 - DNA, 36 bp, Artificial Sequence
  Synthetic oligonucleotide
accggtccgtcactattatctatcatgttggcccca

SEQ ID NO: 183875 - DNA, 35 bp, Artificial Sequence
  Synthetic oligonucleotide
tccccggtgtaccggatgctagtttcgttctccca

SEQ ID NO: 183876 - DNA, 36 bp, Artificial Sequence
  Synthetic oligonucleotide
ttcggtcagtattactcctcgctgtttccgccgcca

SEQ ID NO: 183877 - DNA, 36 bp, Artificial Sequence
  Synthetic oligonucleotide
gaggaggataaaggtggaggaagatcattggcgcca

SEQ ID NO: 183878 - DNA, 36 bp, Artificial Sequence
  Synthetic oligonucleotide
tgctccgccgagccctttatgtctgtctctttgcca

SEQ ID NO: 183879 - DNA, 35 bp, Artificial Sequence
  Synthetic oligonucleotide
actgcgcacggtaacgtctcctgctcatcactcca

SEQ ID NO: 183880 - DNA, 36 bp, Artificial Sequence
  Synthetic oligonucleotide
gagagaggaacgatcgaacactagggggattaggca

SEQ ID NO: 183881 - DNA, 35 bp, Artificial Sequence
  Synthetic oligonucleotide
acgcacggttagcaccgtaattcccccctgctgca

SEQ ID NO: 183882 - DNA, 36 bp, Artificial Sequence
  Synthetic oligonucleotide
tcaacgcgctgcatgctcgcgccctccctacaatca

SEQ ID NO: 183883 - DNA, 36 bp, Artificial Sequence
  Synthetic oligonucleotide
tagaccggttcatcatgcctgttttttctgctatca

SEQ ID NO: 183884 - DNA, 36 bp, Artificial Sequence
  Synthetic oligonucleotide
acctaccccgctatgaccagtcgcattatgacctca

SEQ ID NO: 183885 - DNA, 35 bp, Artificial Sequence
  Synthetic oligonucleotide
tgtgtgccttcactctagtgcacttaacctcctca

SEQ ID NO: 183886 - DNA, 36 bp, Artificial Sequence
  Synthetic oligonucleotide
tacgcacattgggtgcgcttagggatccatctttca

SEQ ID NO: 183887 - DNA, 36 bp, Artificial Sequence
  Synthetic oligonucleotide
gccaacgtccacctctctcgctgtctttgtctttca

SEQ ID NO: 183888 - DNA, 37 bp, Artificial Sequence
  Synthetic oligonucleotide
ggaacccacctcagactgccgacccttccttgccaga

SEQ ID NO: 183889 - DNA, 37 bp, Artificial Sequence
  Synthetic oligonucleotide
ggggaggaggacacaacgaacaggcgacaggggcaga

SEQ ID NO: 183890 - DNA, 37 bp, Artificial Sequence
  Synthetic oligonucleotide
tcactgcctcacttcgcaatccgggccctatctgaga

SEQ ID NO: 183891 - DNA, 37 bp, Artificial Sequence
  Synthetic oligonucleotide
ttagtcccccgctccctgatatctagaatgtcctaga

SEQ ID NO: 183892 - DNA, 36 bp, Artificial Sequence
  Synthetic oligonucleotide
aaccttgccgcacccaccccgcctaacagacaacga

SEQ ID NO: 183893 - DNA, 35 bp, Artificial Sequence
  Synthetic oligonucleotide
gcccttcacgcgccaggacccttctcgtagcccga

SEQ ID NO: 183894 - DNA, 37 bp, Artificial Sequence
  Synthetic oligonucleotide
gcaccacctggatcataagcctgccttcattgcccga

SEQ ID NO: 183895 - DNA, 36 bp, Artificial Sequence
  Synthetic oligonucleotide
gggaaggagagggggattggaggaaacgtttcgcga

SEQ ID NO: 183896 - DNA, 37 bp, Artificial Sequence
  Synthetic oligonucleotide
gaggtgaaggggcatgggggagtaagacatcatgcga

SEQ ID NO: 183897 - DNA, 37 bp, Artificial Sequence
  Synthetic oligonucleotide
agagaagggtggctagaggactggggatgggcaagga

SEQ ID NO: 183898 - DNA, 37 bp, Artificial Sequence
  Synthetic oligonucleotide
gtaccgtccctctcgcgcctttgttgtccatccagga

SEQ ID NO: 183899 - DNA, 37 bp, Artificial Sequence
  Synthetic oligonucleotide
gccctacccctcccgtgcgcataatacgggtcacgga

SEQ ID NO: 183900 - DNA, 37 bp, Artificial Sequence
  Synthetic oligonucleotide
cccgacctccgttagtctcttcttgctctcccccgga

SEQ ID NO: 183901 - DNA, 37 bp, Artificial Sequence
  Synthetic oligonucleotide
taccgtcgcaccggtgtgtcgagccctcccatccgga

SEQ ID NO: 183902 - DNA, 36 bp, Artificial Sequence
  Synthetic oligonucleotide
gaaacggagaggtacgaaaggaagataacggaggga

SEQ ID NO: 183903 - DNA, 37 bp, Artificial Sequence
  Synthetic oligonucleotide
acccgcccccgacctacctgacgtaacgaactaggga

SEQ ID NO: 183904 - DNA, 37 bp, Artificial Sequence
  Synthetic oligonucleotide
gggggcggagggaatgggagctcggattcggcgggga

SEQ ID NO: 183905 - DNA, 37 bp, Artificial Sequence
  Synthetic oligonucleotide
accacaccgattttgctctgagccctcccagactgga

SEQ ID NO: 183906 - DNA, 37 bp, Artificial Sequence
  Synthetic oligonucleotide
atctcccgatccgacgtaccacactctccacgctgga

SEQ ID NO: 183907 - DNA, 37 bp, Artificial Sequence
  Synthetic oligonucleotide
gacgccacatcacccgctctctttgatcccttcatga

SEQ ID NO: 183908 - DNA, 37 bp, Artificial Sequence
  Synthetic oligonucleotide
acaccacctgcccctttgtcagaccggatcttcatga

SEQ ID NO: 183909 - DNA, 38 bp, Artificial Sequence
  Synthetic oligonucleotide
ttcgtactccctgaactgtaacgcccctcctgttatga

SEQ ID NO: 183910 - DNA, 37 bp, Artificial Sequence
  Synthetic oligonucleotide
gcgaccaagcccggccgtttttagtactctcaactga

SEQ ID NO: 183911 - DNA, 37 bp, Artificial Sequence
  Synthetic oligonucleotide
ttcagcccctgcctgtcttcttctttgtcttagctga

SEQ ID NO: 183912 - DNA, 37 bp, Artificial Sequence
  Synthetic oligonucleotide
gttcacagctcaccgcctacttcctgctgcattctga

SEQ ID NO: 183913 - DNA, 37 bp, Artificial Sequence
  Synthetic oligonucleotide
tgaactacgaggggggttggaaaagggggtagagtga

SEQ ID NO: 183914 - DNA, 37 bp, Artificial Sequence
  Synthetic oligonucleotide
aacgcccacccccccgtctaagtcgctctaatagtga

SEQ ID NO: 183915 - DNA, 38 bp, Artificial Sequence
  Synthetic oligonucleotide
gtcgatctcatttgccattctgcctccgcctccggtga

SEQ ID NO: 183916 - DNA, 37 bp, Artificial Sequence
  Synthetic oligonucleotide
tcaaccatcctcatcttagtgacccccgtacccttga

SEQ ID NO: 183917 - DNA, 36 bp, Artificial Sequence
  Synthetic oligonucleotide
gcctcccgcctaaggtgggtctctgcccgcccttga

SEQ ID NO: 183918 - DNA, 37 bp, Artificial Sequence
  Synthetic oligonucleotide
actcgcacccacgtgcctgttccgagttattccttga

SEQ ID NO: 183919 - DNA, 37 bp, Artificial Sequence
  Synthetic oligonucleotide
ttcgacaatgggaggtacggggggtgagaggagttga

SEQ ID NO: 183920 - DNA, 37 bp, Artificial Sequence
  Synthetic oligonucleotide
actggccccctcgtgacgtattctttcccccggttga

SEQ ID NO: 183921 - DNA, 38 bp, Artificial Sequence
  Synthetic oligonucleotide
actcccctcaattgcctaattcgtcaaccgcatgttga

SEQ ID NO: 183922 - DNA, 37 bp, Artificial Sequence
  Synthetic oligonucleotide
tctggagggataacggtggagggcgggaacgttttga

SEQ ID NO: 183923 - DNA, 36 bp, Artificial Sequence
  Synthetic oligonucleotide
agccacctcggcgccccccatcgatcgtaactcata

SEQ ID NO: 183924 - DNA, 36 bp, Artificial Sequence
  Synthetic oligonucleotide
atcatgcgctaggactatccggtcactccctaccta

SEQ ID NO: 183925 - DNA, 36 bp, Artificial Sequence
  Synthetic oligonucleotide
gtcccctgccgcaactcgttctagtttgtcccccta

SEQ ID NO: 183926 - DNA, 35 bp, Artificial Sequence
  Synthetic oligonucleotide
gtctgtaggccagacacgctctcttcctgatccta

SEQ ID NO: 183927 - DNA, 36 bp, Artificial Sequence
  Synthetic oligonucleotide
tcgccgccccacgccatgtcctaaaagcctacgcta

SEQ ID NO: 183928 - DNA, 35 bp, Artificial Sequence
  Synthetic oligonucleotide
tcttgatgccaccatgcgtgcacgacttctctcta

SEQ ID NO: 183929 - DNA, 36 bp, Artificial Sequence
  Synthetic oligonucleotide
gcgtgtgcccccgctatcttggtcaaactcctcgta

SEQ ID NO: 183930 - DNA, 35 bp, Artificial Sequence
  Synthetic oligonucleotide
aactgagggagggtggtttgggggaggctgtcgta

SEQ ID NO: 183931 - DNA, 35 bp, Artificial Sequence
  Synthetic oligonucleotide
gtgggaaccgaagaaggggtgcggggggcgctgta

SEQ ID NO: 183932 - DNA, 36 bp, Artificial Sequence
  Synthetic oligonucleotide
gtggaagacgtatgagggggaggcggaggttgtgta

SEQ ID NO: 183933 - DNA, 37 bp, Artificial Sequence
  Synthetic oligonucleotide
ttgacatactcccccgcacctactctagactgttgta

SEQ ID NO: 183934 - DNA, 35 bp, Artificial Sequence
  Synthetic oligonucleotide
atgtccgtcacctcccgttccttccgtgtagctta

SEQ ID NO: 183935 - DNA, 35 bp, Artificial Sequence
  Synthetic oligonucleotide
accacccccgttacctcgacgtctgactggcttta

SEQ ID NO: 183936 - DNA, 35 bp, Artificial Sequence
  Synthetic oligonucleotide
atccccgcccctaatcccgtgcgcggttcacaaac

SEQ ID NO: 183937 - DNA, 35 bp, Artificial Sequence
  Synthetic oligonucleotide
aactacggcgccctgccctcttctaattgctgaac

SEQ ID NO: 183938 - DNA, 35 bp, Artificial Sequence
  Synthetic oligonucleotide
ggtctacctcggcccgctgctcctatcggacccac

SEQ ID NO: 183939 - DNA, 35 bp, Artificial Sequence
  Synthetic oligonucleotide
ggacgccgcccggtcttcagcgttttgacccccac

SEQ ID NO: 183940 - DNA, 35 bp, Artificial Sequence
  Synthetic oligonucleotide
tgcctgaccgccattgcgacgtagtagtactccac

SEQ ID NO: 183941 - DNA, 35 bp, Artificial Sequence
  Synthetic oligonucleotide
acccccaaacgtggtttcctgctcccatggctcac

SEQ ID NO: 183942 - DNA, 36 bp, Artificial Sequence
  Synthetic oligonucleotide
ttcatcgcacccttcgcctccaagagttcatttgac

SEQ ID NO: 183943 - DNA, 35 bp, Artificial Sequence
  Synthetic oligonucleotide
tgctcgttcagggtcttttgctcaatcactcctac

SEQ ID NO: 183944 - DNA, 35 bp, Artificial Sequence
  Synthetic oligonucleotide
gaacacgtctcgcctgtgcccgctcctacctctac

SEQ ID NO: 183945 - DNA, 35 bp, Artificial Sequence
  Synthetic oligonucleotide
acttgcgccttgtactgtttccgcccgctgcaacc

SEQ ID NO: 183946 - DNA, 35 bp, Artificial Sequence
  Synthetic oligonucleotide
ttgacggacctgatcgttacgccctttttatcacc

SEQ ID NO: 183947 - DNA, 35 bp, Artificial Sequence
  Synthetic oligonucleotide
ttgatcgtacagctcgccgtcccgcgccccctacc

SEQ ID NO: 183948 - DNA, 36 bp, Artificial Sequence
  Synthetic oligonucleotide
aagtccccctcagcctacagtccgtccatggatccc

SEQ ID NO: 183949 - DNA, 35 bp, Artificial Sequence
  Synthetic oligonucleotide
aacgccgccccggtcccgttctttaagtcgctccc

SEQ ID NO: 183950 - DNA, 35 bp, Artificial Sequence
  Synthetic oligonucleotide
gaacctcacgcacacgaccagctacgcatgctccc

SEQ ID NO: 183951 - DNA, 35 bp, Artificial Sequence
  Synthetic oligonucleotide
gttgcgtcgctatgcggctccaatgttcttctccc

SEQ ID NO: 183952 - DNA, 35 bp, Artificial Sequence
  Synthetic oligonucleotide
aacgcagacaatctgtgccgactgtccccggtccc

SEQ ID NO: 183953 - DNA, 35 bp, Artificial Sequence
  Synthetic oligonucleotide
gtcggtgcccctatgcatacattcccccatgcgcc

SEQ ID NO: 183954 - DNA, 35 bp, Artificial Sequence
  Synthetic oligonucleotide
agtaacatcaacggctctgcacgtcccattgctcc

SEQ ID NO: 183955 - DNA, 35 bp, Artificial Sequence
  Synthetic oligonucleotide
ttaccacctctcccgagccgcccgcattacggtcc

SEQ ID NO: 183956 - DNA, 35 bp, Artificial Sequence
  Synthetic oligonucleotide
gggacggtctcctacagcgctgttacatcacttcc

SEQ ID NO: 183957 - DNA, 35 bp, Artificial Sequence
  Synthetic oligonucleotide
gacccgcacaccgctccccatcgctcccctagagc

SEQ ID NO: 183958 - DNA, 35 bp, Artificial Sequence
  Synthetic oligonucleotide
gtgcttctcctcatggctctgtttgggccccccgc

SEQ ID NO: 183959 - DNA, 34 bp, Artificial Sequence
  Synthetic oligonucleotide
tcaccccgcatgatatgctgctctctttgctcgc

SEQ ID NO: 183960 - DNA, 35 bp, Artificial Sequence
  Synthetic oligonucleotide
gtcaacgggcgggcgagggacggggtctgggaggc

SEQ ID NO: 183961 - DNA, 35 bp, Artificial Sequence
  Synthetic oligonucleotide
taagggtgggggggttaagcgggacacatacgggc

SEQ ID NO: 183962 - DNA, 35 bp, Artificial Sequence
  Synthetic oligonucleotide
gagggaggggtgctcatgggggactattagggggc

SEQ ID NO: 183963 - DNA, 35 bp, Artificial Sequence
  Synthetic oligonucleotide
gccagaccagtttattccgttcctagcaccttggc

SEQ ID NO: 183964 - DNA, 35 bp, Artificial Sequence
  Synthetic oligonucleotide
gtccagcccaatatgtccctgccccaccctaatgc

SEQ ID NO: 183965 - DNA, 35 bp, Artificial Sequence
  Synthetic oligonucleotide
atgtgcacccttactccgccatctgactgggaatc

SEQ ID NO: 183966 - DNA, 35 bp, Artificial Sequence
  Synthetic oligonucleotide
accattcccacctcattcgcccgcttatagggatc

SEQ ID NO: 183967 - DNA, 35 bp, Artificial Sequence
  Synthetic oligonucleotide
tgcgagccgccttaattgtttgtgtacgttctatc

SEQ ID NO: 183968 - DNA, 35 bp, Artificial Sequence
  Synthetic oligonucleotide
gctcgtgacagcactttgcagccatccgccttatc

SEQ ID NO: 183969 - DNA, 35 bp, Artificial Sequence
  Synthetic oligonucleotide
atcgcctctggactcggccactggtctaccacctc

SEQ ID NO: 183970 - DNA, 35 bp, Artificial Sequence
  Synthetic oligonucleotide
accagcccgcgtggaaaccccaccatactcccctc

SEQ ID NO: 183971 - DNA, 35 bp, Artificial Sequence
  Synthetic oligonucleotide
gttagggcaccctctgttcgcaccaatcagccctc

SEQ ID NO: 183972 - DNA, 35 bp, Artificial Sequence
  Synthetic oligonucleotide
atgaccgcatgtaatggcctcttaaacctcgcctc

SEQ ID NO: 183973 - DNA, 35 bp, Artificial Sequence
  Synthetic oligonucleotide
agttcgtcattgtaatggctgcccttcccgtcctc

SEQ ID NO: 183974 - DNA, 35 bp, Artificial Sequence
  Synthetic oligonucleotide
tcctccattctcgttctgtcttgtttacgccgctc

SEQ ID NO: 183975 - DNA, 35 bp, Artificial Sequence
  Synthetic oligonucleotide
attacccacaatggtagtcagataccgccgctctc

SEQ ID NO: 183976 - DNA, 35 bp, Artificial Sequence
  Synthetic oligonucleotide
tctgacccggcccgagttgtcctctgccatccgtc

SEQ ID NO: 183977 - DNA, 35 bp, Artificial Sequence
  Synthetic oligonucleotide
gcctgccatcatatgcactcccttgtatcctcgtc

SEQ ID NO: 183978 - DNA, 35 bp, Artificial Sequence
  Synthetic oligonucleotide
acacctccgctatggacgctccccctttgtttgtc

SEQ ID NO: 183979 - DNA, 34 bp, Artificial Sequence
  Synthetic oligonucleotide
gaagcagtggagtgccatatcatccccccccttc

SEQ ID NO: 183980 - DNA, 35 bp, Artificial Sequence
  Synthetic oligonucleotide
tttccctcgcacccggctcgtgcgcttcgttcttc

SEQ ID NO: 183981 - DNA, 35 bp, Artificial Sequence
  Synthetic oligonucleotide
tctgcgccttgttccttggtttagtcttccggttc

SEQ ID NO: 183982 - DNA, 35 bp, Artificial Sequence
  Synthetic oligonucleotide
agcgggatgcagtcctttccgtgctaccgtttttc

SEQ ID NO: 183983 - DNA, 35 bp, Artificial Sequence
  Synthetic oligonucleotide
ggagccggctgtcccccgtagtcttgtttgccccg

SEQ ID NO: 183984 - DNA, 35 bp, Artificial Sequence
  Synthetic oligonucleotide
aacttgcatacctccacctcggcctgtcctagccg

SEQ ID NO: 183985 - DNA, 35 bp, Artificial Sequence
  Synthetic oligonucleotide
taagcgcaccatgtgaccgtctcttcgtcatgccg

SEQ ID NO: 183986 - DNA, 35 bp, Artificial Sequence
  Synthetic oligonucleotide
gatctgccgccaactcgctgtacttccctttgccg

SEQ ID NO: 183987 - DNA, 35 bp, Artificial Sequence
  Synthetic oligonucleotide
gtgttaactgtccggatcctgttccttcgcctccg

SEQ ID NO: 183988 - DNA, 35 bp, Artificial Sequence
  Synthetic oligonucleotide
attcgcccccgcccctcgaatggtatgatgcgagg

SEQ ID NO: 183989 - DNA, 35 bp, Artificial Sequence
  Synthetic oligonucleotide
gttggggtgatgtagatgggtgagggagggaacgg

SEQ ID NO: 183990 - DNA, 35 bp, Artificial Sequence
  Synthetic oligonucleotide
gcgagtggggaaaggaaggggtattggtgacgatg

SEQ ID NO: 183991 - DNA, 35 bp, Artificial Sequence
  Synthetic oligonucleotide
tcacccccacgcgtctaatatcattcaccaccctg

SEQ ID NO: 183992 - DNA, 35 bp, Artificial Sequence
  Synthetic oligonucleotide
tcaagtatgtgtagcgccgcccacctgttcccttg

SEQ ID NO: 183993 - DNA, 35 bp, Artificial Sequence
  Synthetic oligonucleotide
agccaccgaaccatcttacacgtcaccgctggttg

SEQ ID NO: 183994 - DNA, 35 bp, Artificial Sequence
  Synthetic oligonucleotide
aatccgcccccacattgtcctctcttccattcaat

SEQ ID NO: 183995 - DNA, 35 bp, Artificial Sequence
  Synthetic oligonucleotide
gagggccatcgcaagggagggcggttacttgggat

SEQ ID NO: 183996 - DNA, 35 bp, Artificial Sequence
  Synthetic oligonucleotide
tccacccgtatcgaagtcgtaccgctgcttactat

SEQ ID NO: 183997 - DNA, 35 bp, Artificial Sequence
  Synthetic oligonucleotide
ttgacgtacgtcacactcctgtcaattcgcacact

SEQ ID NO: 183998 - DNA, 35 bp, Artificial Sequence
  Synthetic oligonucleotide
gctccccctagcccgcaattcccttacagatgact

SEQ ID NO: 183999 - DNA, 35 bp, Artificial Sequence
  Synthetic oligonucleotide
tgtatggacaccgctttctatctgcatcacatact

SEQ ID NO: 184000 - DNA, 35 bp, Artificial Sequence
  Synthetic oligonucleotide
gtcttcctcgccgcttgctgacccttgtttgacct

SEQ ID NO: 184001 - DNA, 35 bp, Artificial Sequence
  Synthetic oligonucleotide
tgactcaccctccgctctgtacgtgcctgtcccct

SEQ ID NO: 184002 - DNA, 35 bp, Artificial Sequence
  Synthetic oligonucleotide
ggacgcagtaccactggccccattcccgcttgcct

SEQ ID NO: 184003 - DNA, 35 bp, Artificial Sequence
  Synthetic oligonucleotide
taatgccgtgcccagtatccgccttcttatgtcct

SEQ ID NO: 184004 - DNA, 36 bp, Artificial Sequence
  Synthetic oligonucleotide
gcccgcctgccacgccaccctgaattatcagcagct

SEQ ID NO: 184005 - DNA, 35 bp, Artificial Sequence
  Synthetic oligonucleotide
gcctaccaacgtcaccttccgtcgcatcccgggct

SEQ ID NO: 184006 - DNA, 35 bp, Artificial Sequence
  Synthetic oligonucleotide
gccgtagccgcctctctattgtgaccgcaccctct

SEQ ID NO: 184007 - DNA, 35 bp, Artificial Sequence
  Synthetic oligonucleotide
tgtccaaccgctcccgacatctattgctactcagt

SEQ ID NO: 184008 - DNA, 35 bp, Artificial Sequence
  Synthetic oligonucleotide
agcggagagcgggtggcgggggaattaacggtagt

SEQ ID NO: 184009 - DNA, 35 bp, Artificial Sequence
  Synthetic oligonucleotide
tatccgctctgagttactcctggtccctaccccgt

SEQ ID NO: 184010 - DNA, 35 bp, Artificial Sequence
  Synthetic oligonucleotide
tagccacccacagccctcctgccacccggacttgt

SEQ ID NO: 184011 - DNA, 35 bp, Artificial Sequence
  Synthetic oligonucleotide
acacgccgctcccagcccctagctttcatacttgt

SEQ ID NO: 184012 - DNA, 35 bp, Artificial Sequence
  Synthetic oligonucleotide
agacgcccgcccatctcccgctaggagacaacctt

SEQ ID NO: 184013 - DNA, 35 bp, Artificial Sequence
  Synthetic oligonucleotide
tgcaaaggcgattcacgctccaccagccgaccctt

SEQ ID NO: 184014 - DNA, 35 bp, Artificial Sequence
  Synthetic oligonucleotide
gtgccaacctggtaatagtatctgcatcctcgctt

SEQ ID NO: 184015 - DNA, 35 bp, Artificial Sequence
  Synthetic oligonucleotide
gccccacgcttatctgttacggctttgctcctctt

SEQ ID NO: 184016 - DNA, 29 bp, Artificial Sequence
  Synthetic oligonucleotide
tgcctacgtgctcgggcctctccattctt

SEQ ID NO: 184017 - DNA, 36 bp, Artificial Sequence
  Synthetic oligonucleotide
gttgggcagggaggggagtatgggaagtgtaggaaa

SEQ ID NO: 184018 - DNA, 36 bp, Artificial Sequence
  Synthetic oligonucleotide
ttggccacctgaccaccccggattcgcccagtacaa

SEQ ID NO: 184019 - DNA, 36 bp, Artificial Sequence
  Synthetic oligonucleotide
atgtcgccccacctcgtctatcgaagccttcaccaa

SEQ ID NO: 184020 - DNA, 36 bp, Artificial Sequence
  Synthetic oligonucleotide
acttcgacccccgcccttggtcttgatattgacgaa

SEQ ID NO: 184021 - DNA, 36 bp, Artificial Sequence
  Synthetic oligonucleotide
ttcgatgcgcgttcggtcttcgattctccactataa

SEQ ID NO: 184022 - DNA, 35 bp, Artificial Sequence
  Synthetic oligonucleotide
agcatgtcgctactcccgtgcccccggtctactaa

SEQ ID NO: 184023 - DNA, 35 bp, Artificial Sequence
  Synthetic oligonucleotide
gtttgccgcctttgtaactcaaccctcgtctctaa

SEQ ID NO: 184024 - DNA, 36 bp, Artificial Sequence
  Synthetic oligonucleotide
tagcccccccctttaggttatgaggcctccccttaa

SEQ ID NO: 184025 - DNA, 36 bp, Artificial Sequence
  Synthetic oligonucleotide
atcgtgcgatgcgctgttgccctcatgatcctcaca

SEQ ID NO: 184026 - DNA, 35 bp, Artificial Sequence
  Synthetic oligonucleotide
tgctagggtagcgagcaccttgcccatcctcccca

SEQ ID NO: 184027 - DNA, 36 bp, Artificial Sequence
  Synthetic oligonucleotide
gtggaccacgcccgcatatacataacacctggccca

SEQ ID NO: 184028 - DNA, 35 bp, Artificial Sequence
  Synthetic oligonucleotide
tccctccccctctccttctgcatgacagcttgcca

SEQ ID NO: 184029 - DNA, 36 bp, Artificial Sequence
  Synthetic oligonucleotide
tgcccgccatccactaagccatttgcccctttgcca

SEQ ID NO: 184030 - DNA, 36 bp, Artificial Sequence
  Synthetic oligonucleotide
ttcgccaacgctgacccgccgcctaccgctttgcca

SEQ ID NO: 184031 - DNA, 36 bp, Artificial Sequence
  Synthetic oligonucleotide
tccacccacacagttgcgtgctccaattttcatcca

SEQ ID NO: 184032 - DNA, 36 bp, Artificial Sequence
  Synthetic oligonucleotide
acaggcacatctgttttacccccgccgcaaatcgca

SEQ ID NO: 184033 - DNA, 36 bp, Artificial Sequence
  Synthetic oligonucleotide
agcaaacggtcgtgtacccttgatccttcctcctca

SEQ ID NO: 184034 - DNA, 35 bp, Artificial Sequence
  Synthetic oligonucleotide
accgtacatgccgtcccatatttttcacgatctca

SEQ ID NO: 184035 - DNA, 36 bp, Artificial Sequence
  Synthetic oligonucleotide
tgcataccccctactgtactaccgactctgctctca

SEQ ID NO: 184036 - DNA, 35 bp, Artificial Sequence
  Synthetic oligonucleotide
agtttgccctcccgattcccgccccgactgagtca

SEQ ID NO: 184037 - DNA, 35 bp, Artificial Sequence
  Synthetic oligonucleotide
acaactccgcgtggcacaattctaccgtcctgtca

SEQ ID NO: 184038 - DNA, 36 bp, Artificial Sequence
  Synthetic oligonucleotide
gatacgcctcgcgagctttaaccgtccaccgcttca

SEQ ID NO: 184039 - DNA, 35 bp, Artificial Sequence
  Synthetic oligonucleotide
tacacccgtcctcattagcgtccgcctaactttca

SEQ ID NO: 184040 - DNA, 37 bp, Artificial Sequence
  Synthetic oligonucleotide
gtgaaggggggtgtgaaatggtgggagagcgcgaaga

SEQ ID NO: 184041 - DNA, 37 bp, Artificial Sequence
  Synthetic oligonucleotide
ggagataggggggaggaggagcgtataggcgtccaga

SEQ ID NO: 184042 - DNA, 36 bp, Artificial Sequence
  Synthetic oligonucleotide
ttcgacagagagcgagaggcgaggaggggaagcaga

SEQ ID NO: 184043 - DNA, 37 bp, Artificial Sequence
  Synthetic oligonucleotide
tcgtacgaagagaacagggagggggggacagtagaga

SEQ ID NO: 184044 - DNA, 37 bp, Artificial Sequence
  Synthetic oligonucleotide
agggggtggagaggaaacgggagtgctgcgcgcgaga

SEQ ID NO: 184045 - DNA, 37 bp, Artificial Sequence
  Synthetic oligonucleotide
aaccactgaccgtggtataggagtaggggtggggaga

SEQ ID NO: 184046 - DNA, 37 bp, Artificial Sequence
  Synthetic oligonucleotide
ggtgaaaggtagaggggatgacgggagacaagtacga

SEQ ID NO: 184047 - DNA, 37 bp, Artificial Sequence
  Synthetic oligonucleotide
gccccgctacagattcttctcagcaccgtccacccga

SEQ ID NO: 184048 - DNA, 37 bp, Artificial Sequence
  Synthetic oligonucleotide
acgcgcattagcatgtttcgcctcctttaccccccga

SEQ ID NO: 184049 - DNA, 36 bp, Artificial Sequence
  Synthetic oligonucleotide
tatcctgctcattcttccaccccgtgctctgcccga

SEQ ID NO: 184050 - DNA, 36 bp, Artificial Sequence
  Synthetic oligonucleotide
gtgatgctgtgtctgtgcttatcctccttccgccga

SEQ ID NO: 184051 - DNA, 37 bp, Artificial Sequence
  Synthetic oligonucleotide
gttacaccgattttgctttgatgccattcctcgccga

SEQ ID NO: 184052 - DNA, 37 bp, Artificial Sequence
  Synthetic oligonucleotide
ttaaggcgctgggagacggggaggaataggggagcga

SEQ ID NO: 184053 - DNA, 37 bp, Artificial Sequence
  Synthetic oligonucleotide
gtctaccgcatctccaccgcgcggtcccatttatcga

SEQ ID NO: 184054 - DNA, 37 bp, Artificial Sequence
  Synthetic oligonucleotide
tcctccgcactacttgtctcccagcccgccacctcga

SEQ ID NO: 184055 - DNA, 37 bp, Artificial Sequence
  Synthetic oligonucleotide
gactgctaaagccatccggttccatctcgtgcctcga

SEQ ID NO: 184056 - DNA, 37 bp, Artificial Sequence
  Synthetic oligonucleotide
ttgccacacctgtagaccagtttctcgccctcttcga

SEQ ID NO: 184057 - DNA, 37 bp, Artificial Sequence
  Synthetic oligonucleotide
ttacaaccgcctgcgtatagccccctctccgaccgga

SEQ ID NO: 184058 - DNA, 37 bp, Artificial Sequence
  Synthetic oligonucleotide
agccccggtcgggtggggaattaggggccggcccgga

SEQ ID NO: 184059 - DNA, 37 bp, Artificial Sequence
  Synthetic oligonucleotide
acgtaggggaggggcggtagggtaattccgttgcgga

SEQ ID NO: 184060 - DNA, 37 bp, Artificial Sequence
  Synthetic oligonucleotide
gaatctccgggggtggggaaggggcctgcaataggga

SEQ ID NO: 184061 - DNA, 37 bp, Artificial Sequence
  Synthetic oligonucleotide
tagtggtgggcgggaaggtatgcattagagggcggga

SEQ ID NO: 184062 - DNA, 37 bp, Artificial Sequence
  Synthetic oligonucleotide
gcgagagtgcagtaaaaacggaagggtggcactggga

SEQ ID NO: 184063 - DNA, 36 bp, Artificial Sequence
  Synthetic oligonucleotide
accaccccgagtactcccttgctccactagtgtgga

SEQ ID NO: 184064 - DNA, 37 bp, Artificial Sequence
  Synthetic oligonucleotide
gaataggggagggacaaagggtagtgggtcgtaatga

SEQ ID NO: 184065 - DNA, 37 bp, Artificial Sequence
  Synthetic oligonucleotide
gaccgggggagggggtgtagtgggagataggtaatga

SEQ ID NO: 184066 - DNA, 38 bp, Artificial Sequence
  Synthetic oligonucleotide
gcagatgcacccgctgtccacatacctcccagccatga

SEQ ID NO: 184067 - DNA, 38 bp, Artificial Sequence
  Synthetic oligonucleotide
acacatgccctgtcgcttcttccgccttctcgctatga

SEQ ID NO: 184068 - DNA, 37 bp, Artificial Sequence
  Synthetic oligonucleotide
gtgtcccccgccgcagaccgttttccagcctcactga

SEQ ID NO: 184069 - DNA, 38 bp, Artificial Sequence
  Synthetic oligonucleotide
taaggccatagcccgcttgtttttgaatccacctctga

SEQ ID NO: 184070 - DNA, 38 bp, Artificial Sequence
  Synthetic oligonucleotide
agcgcccgccctccgaacaccgacccccttctccgtga

SEQ ID NO: 184071 - DNA, 38 bp, Artificial Sequence
  Synthetic oligonucleotide
agaggacggtagggaggggtaggaccaatggagtgtga

SEQ ID NO: 184072 - DNA, 38 bp, Artificial Sequence
  Synthetic oligonucleotide
aaccaacccggatcgctatgcctgtccttcacttgtga

SEQ ID NO: 184073 - DNA, 37 bp, Artificial Sequence
  Synthetic oligonucleotide
ttacgacgcccacatcgctgacgtgccctccttgtga

SEQ ID NO: 184074 - DNA, 37 bp, Artificial Sequence
  Synthetic oligonucleotide
taggacgagggggacaggaggggatgaccggaattga

SEQ ID NO: 184075 - DNA, 38 bp, Artificial Sequence
  Synthetic oligonucleotide
gtcgccctcctaccgcgttctatctaacctgtcattga

SEQ ID NO: 184076 - DNA, 38 bp, Artificial Sequence
  Synthetic oligonucleotide
gagggaggggcggagcaaaagggcaacatagtgcttga

SEQ ID NO: 184077 - DNA, 38 bp, Artificial Sequence
  Synthetic oligonucleotide
gagtcgctcgctctgcatatcaccgcgccctatcttga

SEQ ID NO: 184078 - DNA, 38 bp, Artificial Sequence
  Synthetic oligonucleotide
tgactcgtcccgcccccgtgtagcctcctttccgttga

SEQ ID NO: 184079 - DNA, 36 bp, Artificial Sequence
  Synthetic oligonucleotide
gagaacgtcaagccgccgccattctctatgttacta

SEQ ID NO: 184080 - DNA, 36 bp, Artificial Sequence
  Synthetic oligonucleotide
tatacaccggctccgtttctacagccctgttcccta

SEQ ID NO: 184081 - DNA, 36 bp, Artificial Sequence
  Synthetic oligonucleotide
gcgtacgcctctctggttcttggcttgctttatcta

SEQ ID NO: 184082 - DNA, 36 bp, Artificial Sequence
  Synthetic oligonucleotide
gtacgccctcctttgtgaacactttgcaattttcta

SEQ ID NO: 184083 - DNA, 36 bp, Artificial Sequence
  Synthetic oligonucleotide
tgcgaagcctccacgcccacagtccttatacattta

SEQ ID NO: 184084 - DNA, 36 bp, Artificial Sequence
  Synthetic oligonucleotide
tacgcccccctcatgcgcaaattgcaccacacttta

SEQ ID NO: 184085 - DNA, 35 bp, Artificial Sequence
  Synthetic oligonucleotide
acgatccctcttcattttgcttatcgggtccaaac

SEQ ID NO: 184086 - DNA, 35 bp, Artificial Sequence
  Synthetic oligonucleotide
gccgtgtggggggaaaagcctagggaagagacaac

SEQ ID NO: 184087 - DNA, 35 bp, Artificial Sequence
  Synthetic oligonucleotide
aacgaccgggccaaccctgatctatccctggacac

SEQ ID NO: 184088 - DNA, 35 bp, Artificial Sequence
  Synthetic oligonucleotide
agtccccgtcaactactgttactcactaccgccac

SEQ ID NO: 184089 - DNA, 35 bp, Artificial Sequence
  Synthetic oligonucleotide
gcagtcccgcctattctctcccgccgctgagagac

SEQ ID NO: 184090 - DNA, 35 bp, Artificial Sequence
  Synthetic oligonucleotide
gcacgcgccggcgataacgttacctccctcgcgac

SEQ ID NO: 184091 - DNA, 35 bp, Artificial Sequence
  Synthetic oligonucleotide
gtgcgtgcctctgttaactcgcttcaccacatgac

SEQ ID NO: 184092 - DNA, 38 bp, Artificial Sequence
  Synthetic oligonucleotide
agcccgcccgcattatccaaagtcgtcgttctcttgac

SEQ ID NO: 184093 - DNA, 35 bp, Artificial Sequence
  Synthetic oligonucleotide
gcacgcccgacccccctttactgtcgcggttatac

SEQ ID NO: 184094 - DNA, 35 bp, Artificial Sequence
  Synthetic oligonucleotide
tccgtcgtccccgcgccgttttgtccactttgtac

SEQ ID NO: 184095 - DNA, 35 bp, Artificial Sequence
  Synthetic oligonucleotide
tgagtagccatggtgccacatcacgccccttttac

SEQ ID NO: 184096 - DNA, 35 bp, Artificial Sequence
  Synthetic oligonucleotide
gtctcgtgcccgacgtccaagttcgcatctacacc

SEQ ID NO: 184097 - DNA, 35 bp, Artificial Sequence
  Synthetic oligonucleotide
tcgcgaaccgccgacgctactcctgcctctttacc

SEQ ID NO: 184098 - DNA, 35 bp, Artificial Sequence
  Synthetic oligonucleotide
ttctcacctcggacctctctcggcgacttggaccc

SEQ ID NO: 184099 - DNA, 36 bp, Artificial Sequence
  Synthetic oligonucleotide
gacggattcctcgtgccaactttactgtgccccccc

SEQ ID NO: 184100 - DNA, 35 bp, Artificial Sequence
  Synthetic oligonucleotide
tctcgcctgccgctactgcgagccaggatctcccc

SEQ ID NO: 184101 - DNA, 35 bp, Artificial Sequence
  Synthetic oligonucleotide
tgtagcgcaccccgtatagctctgttccgccgccc

SEQ ID NO: 184102 - DNA, 35 bp, Artificial Sequence
  Synthetic oligonucleotide
tggagcccgctgagttaacattccgcattccgccc

SEQ ID NO: 184103 - DNA, 35 bp, Artificial Sequence
  Synthetic oligonucleotide
cccatccctgtacacctagagtgacgacgaatccc

SEQ ID NO: 184104 - DNA, 36 bp, Artificial Sequence
  Synthetic oligonucleotide
tgattcgacccgggatatcatggcccttcacctccc

SEQ ID NO: 184105 - DNA, 35 bp, Artificial Sequence
  Synthetic oligonucleotide
atggtgacgagccgagttaaatccaccgttctccc

SEQ ID NO: 184106 - DNA, 35 bp, Artificial Sequence
  Synthetic oligonucleotide
gtgtctcgcccaggcaatcgccctcgaccattccc

SEQ ID NO: 184107 - DNA, 35 bp, Artificial Sequence
  Synthetic oligonucleotide
tgagccggtcccgtattgctaccccgccactagcc

SEQ ID NO: 184108 - DNA, 35 bp, Artificial Sequence
  Synthetic oligonucleotide
gccacccactctgccttcacgaacgccatcctgcc

SEQ ID NO: 184109 - DNA, 35 bp, Artificial Sequence
  Synthetic oligonucleotide
gcgtacccccgcgattacttcgtctgtactctgcc

SEQ ID NO: 184110 - DNA, 35 bp, Artificial Sequence
  Synthetic oligonucleotide
tatctacctcccttcccacttgcacaggcggtgcc

SEQ ID NO: 184111 - DNA, 35 bp, Artificial Sequence
  Synthetic oligonucleotide
gtgcgatacgttgccctctctgtttttgccttgcc

SEQ ID NO: 184112 - DNA, 35 bp, Artificial Sequence
  Synthetic oligonucleotide
tcacgccagggagcgtgccgtcaccttccctacgc

SEQ ID NO: 184113 - DNA, 35 bp, Artificial Sequence
  Synthetic oligonucleotide
taccacctccgattagcccctgcggtttccctcgc

SEQ ID NO: 184114 - DNA, 35 bp, Artificial Sequence
  Synthetic oligonucleotide
tctgagccctgcgcgaaccaacctaccccattcgc

SEQ ID NO: 184115 - DNA, 32 bp, Artificial Sequence
  Synthetic oligonucleotide
acactgccactgggagaaaatggggggggggc

SEQ ID NO: 184116 - DNA, 35 bp, Artificial Sequence
  Synthetic oligonucleotide
ttagacaccacatttccatcgttatttgctcctgc

SEQ ID NO: 184117 - DNA, 35 bp, Artificial Sequence
  Synthetic oligonucleotide
agatccccctccaatcctgtacaggcgtcgccatc

SEQ ID NO: 184118 - DNA, 35 bp, Artificial Sequence
  Synthetic oligonucleotide
tgctcgttcgcccccaccgtcacacatcgcatatc

SEQ ID NO: 184119 - DNA, 35 bp, Artificial Sequence
  Synthetic oligonucleotide
aacgctcctgttgtcatagtaatgcctcgtacctc

SEQ ID NO: 184120 - DNA, 35 bp, Artificial Sequence
  Synthetic oligonucleotide
tttgccgtaccgcgctcccttaatgcagggccctc

SEQ ID NO: 184121 - DNA, 35 bp, Artificial Sequence
  Synthetic oligonucleotide
atgtgctgagctgttctttccgttatcgtctcctc

SEQ ID NO: 184122 - DNA, 35 bp, Artificial Sequence
  Synthetic oligonucleotide
tcgaacatccaaaccgtcccgctgagcctgtcctc

SEQ ID NO: 184123 - DNA, 35 bp, Artificial Sequence
  Synthetic oligonucleotide
acccatcccctgcccgtgaagagatctctgatctc

SEQ ID NO: 184124 - DNA, 35 bp, Artificial Sequence
  Synthetic oligonucleotide
gctccttcactcgctcctagtgtctatcacctctc

SEQ ID NO: 184125 - DNA, 35 bp, Artificial Sequence
  Synthetic oligonucleotide
ccacacacttctcgaatgtcgtaacctcgcctctc

SEQ ID NO: 184126 - DNA, 35 bp, Artificial Sequence
  Synthetic oligonucleotide
gacattcgctcctttggtacctgcctgtccttctc

SEQ ID NO: 184127 - DNA, 35 bp, Artificial Sequence
  Synthetic oligonucleotide
gtccatgtccctttcccttagggccccaccatgtc

SEQ ID NO: 184128 - DNA, 35 bp, Artificial Sequence
  Synthetic oligonucleotide
tccccgttccttctttgtctgctggccactatgtc

SEQ ID NO: 184129 - DNA, 35 bp, Artificial Sequence
  Synthetic oligonucleotide
tgtgtgctctgtatctcccctccgtcacaggattc

SEQ ID NO: 184130 - DNA, 35 bp, Artificial Sequence
  Synthetic oligonucleotide
tctggtgccacgttgccgtccccccctggttattc

SEQ ID NO: 184131 - DNA, 35 bp, Artificial Sequence
  Synthetic oligonucleotide
gcctcacgtttccgaaggactctacgcaccacttc

SEQ ID NO: 184132 - DNA, 35 bp, Artificial Sequence
  Synthetic oligonucleotide
gagaaaatggaggggggcacaaggagcgcgggaag

SEQ ID NO: 184133 - DNA, 35 bp, Artificial Sequence
  Synthetic oligonucleotide
ggggaaggtgagtccggtaagtggggaggagtaag

SEQ ID NO: 184134 - DNA, 35 bp, Artificial Sequence
  Synthetic oligonucleotide
gcaatacacaccctcgcctgcccacgatcacggag

SEQ ID NO: 184135 - DNA, 35 bp, Artificial Sequence
  Synthetic oligonucleotide
gggtggagcggggggcaggcgaacggccatcgacg

SEQ ID NO: 184136 - DNA, 35 bp, Artificial Sequence
  Synthetic oligonucleotide
agatgtcccacctatcttgctccctgttttttacg

SEQ ID NO: 184137 - DNA, 35 bp, Artificial Sequence
  Synthetic oligonucleotide
acgacactccccccattattgatccacttcccccg

SEQ ID NO: 184138 - DNA, 35 bp, Artificial Sequence
  Synthetic oligonucleotide
tcacgtctgtaggtctccacgtcccatcttctccg

SEQ ID NO: 184139 - DNA, 35 bp, Artificial Sequence
  Synthetic oligonucleotide
ttccatgccccgtacaattttgcgtttcaacatcg

SEQ ID NO: 184140 - DNA, 35 bp, Artificial Sequence
  Synthetic oligonucleotide
ttgcccactgaatagtaccactcccgcatcattcg

SEQ ID NO: 184141 - DNA, 35 bp, Artificial Sequence
  Synthetic oligonucleotide
gccacacagaccgggtagggtcgggagggtaaagg

SEQ ID NO: 184142 - DNA, 35 bp, Artificial Sequence
  Synthetic oligonucleotide
ggacaaagtaaagtaggagtggagcagggaagagg

SEQ ID NO: 184143 - DNA, 35 bp, Artificial Sequence
  Synthetic oligonucleotide
atagtgaggggaagaccgggcatgggttggggagg

SEQ ID NO: 184144 - DNA, 35 bp, Artificial Sequence
  Synthetic oligonucleotide
gtgcttcaaggctaccacccccgctccccccgtgg

SEQ ID NO: 184145 - DNA, 33 bp, Artificial Sequence
  Synthetic oligonucleotide
ggttgggtggtggaagttcggggggaatagatg

SEQ ID NO: 184146 - DNA, 35 bp, Artificial Sequence
  Synthetic oligonucleotide
acgacccaatcgtgctgtctcatttgcgccctctg

SEQ ID NO: 184147 - DNA, 33 bp, Artificial Sequence
  Synthetic oligonucleotide
agtctcgcctgtaccgcgccctatactcctgtg

SEQ ID NO: 184148 - DNA, 35 bp, Artificial Sequence
  Synthetic oligonucleotide
tcagcactcttgtgcccccgcgattcctctcattg

SEQ ID NO: 184149 - DNA, 35 bp, Artificial Sequence
  Synthetic oligonucleotide
tgcgtcacttccggcgtttttcccttgactccttg

SEQ ID NO: 184150 - DNA, 35 bp, Artificial Sequence
  Synthetic oligonucleotide
gccgcgcactgagtcacattatccctccgtctttg

SEQ ID NO: 184151 - DNA, 35 bp, Artificial Sequence
  Synthetic oligonucleotide
ttgacgacagtggctgcttacaactccaccttttg

SEQ ID NO: 184152 - DNA, 35 bp, Artificial Sequence
  Synthetic oligonucleotide
gacattccatctgtctgcccacatttcattccaat

SEQ ID NO: 184153 - DNA, 35 bp, Artificial Sequence
  Synthetic oligonucleotide
gtacttctatcacgctgccccccgctacagttaat

SEQ ID NO: 184154 - DNA, 35 bp, Artificial Sequence
  Synthetic oligonucleotide
gcctgcgtgtattcgtccatgtcgccaccccacat

SEQ ID NO: 184155 - DNA, 35 bp, Artificial Sequence
  Synthetic oligonucleotide
gagtcatgtcaccacgtcccttacataggcaccat

SEQ ID NO: 184156 - DNA, 35 bp, Artificial Sequence
  Synthetic oligonucleotide
tacgcggttaagcgttgtttcgccgttcttaccat

SEQ ID NO: 184157 - DNA, 35 bp, Artificial Sequence
  Synthetic oligonucleotide
gaacatccacggttccgtaattctctgtcctccat

SEQ ID NO: 184158 - DNA, 35 bp, Artificial Sequence
  Synthetic oligonucleotide
atgggagggaggggagggtacgaggcagggggcat

SEQ ID NO: 184159 - DNA, 35 bp, Artificial Sequence
  Synthetic oligonucleotide
gtccccgtgggatctgtctagttcttccatatcat

SEQ ID NO: 184160 - DNA, 35 bp, Artificial Sequence
  Synthetic oligonucleotide
gcctgtaccatcgcttgttagagtgcacttactat

SEQ ID NO: 184161 - DNA, 35 bp, Artificial Sequence
  Synthetic oligonucleotide
ccagccacactgctgctatccctttgacctcttat

SEQ ID NO: 184162 - DNA, 35 bp, Artificial Sequence
  Synthetic oligonucleotide
atctcgcccttcgcagaagtttgcccttatacact

SEQ ID NO: 184163 - DNA, 35 bp, Artificial Sequence
  Synthetic oligonucleotide
gtactgccccatactcggcttctctgcactctact

SEQ ID NO: 184164 - DNA, 35 bp, Artificial Sequence
  Synthetic oligonucleotide
gttgacgaacgcctctgtctaaactgtctacacct

SEQ ID NO: 184165 - DNA, 35 bp, Artificial Sequence
  Synthetic oligonucleotide
tgacgctgtacagccctgtccgcaagcacctccct

SEQ ID NO: 184166 - DNA, 35 bp, Artificial Sequence
  Synthetic oligonucleotide
gatttaccccgctctccccgcccacgcgcgagcct

SEQ ID NO: 184167 - DNA, 35 bp, Artificial Sequence
  Synthetic oligonucleotide
gacaatgttacgtcctgttcgcagccttcccctct

SEQ ID NO: 184168 - DNA, 35 bp, Artificial Sequence
  Synthetic oligonucleotide
accaccgcccatccgcaagaggtccaccaacttct

SEQ ID NO: 184169 - DNA, 35 bp, Artificial Sequence
  Synthetic oligonucleotide
acgacctactcgcctctgttagcgttcaaccttct

SEQ ID NO: 184170 - DNA, 35 bp, Artificial Sequence
  Synthetic oligonucleotide
gcactcctcagcacccgccctgcctgtttaccagt

SEQ ID NO: 184171 - DNA, 35 bp, Artificial Sequence
  Synthetic oligonucleotide
gaagatagaacgcagggggaacgggcgtagagagt

SEQ ID NO: 184172 - DNA, 35 bp, Artificial Sequence
  Synthetic oligonucleotide
aagctcgccaccgacgtgcccctcgaaccccaggt

SEQ ID NO: 184173 - DNA, 35 bp, Artificial Sequence
  Synthetic oligonucleotide
tgccccacctgctgccacctgacgacaatgtaggt

SEQ ID NO: 184174 - DNA, 35 bp, Artificial Sequence
  Synthetic oligonucleotide
gtaccgtctaactgtcatcgctaattccccccggt

SEQ ID NO: 184175 - DNA, 35 bp, Artificial Sequence
  Synthetic oligonucleotide
aaccgcacctcagttcctcgcatctcccccgatgt

SEQ ID NO: 184176 - DNA, 35 bp, Artificial Sequence
  Synthetic oligonucleotide
atacacagccgtgccctctgtccaatatctgctgt

SEQ ID NO: 184177 - DNA, 35 bp, Artificial Sequence
  Synthetic oligonucleotide
taccggtgaggagtgggtgggggcatggcgcgatt

SEQ ID NO: 184178 - DNA, 33 bp, Artificial Sequence
  Synthetic oligonucleotide
tcccaccaccatgtctatactatcgtcccggtt

SEQ ID NO: 184179 - DNA, 35 bp, Artificial Sequence
  Synthetic oligonucleotide
acatggtacatccttgctttacagaccgttccttt

SEQ ID NO: 184180 - DNA, 35 bp, Artificial Sequence
  Synthetic oligonucleotide
gatatggaacgcggggggccaagaggagacggaaa

SEQ ID NO: 184181 - DNA, 36 bp, Artificial Sequence
  Synthetic oligonucleotide
agcatggggagggtgcacgagggattggggcggaaa

SEQ ID NO: 184182 - DNA, 35 bp, Artificial Sequence
  Synthetic oligonucleotide
tccaccctcagctctctttacgaactacacttaaa

SEQ ID NO: 184183 - DNA, 35 bp, Artificial Sequence
  Synthetic oligonucleotide
atgacccctccgaacctggtacgacttcagcccaa

SEQ ID NO: 184184 - DNA, 33 bp, Artificial Sequence
  Synthetic oligonucleotide
agatcccccgtgcactatgatttcatcgcccaa

SEQ ID NO: 184185 - DNA, 36 bp, Artificial Sequence
  Synthetic oligonucleotide
tcccaaccgccgccagttcactttacatcgatccaa

SEQ ID NO: 184186 - DNA, 35 bp, Artificial Sequence
  Synthetic oligonucleotide
agacctaccacactgcctactcacaaacagtccaa

SEQ ID NO: 184187 - DNA, 36 bp, Artificial Sequence
  Synthetic oligonucleotide
gagtgtgagccagaatagcgggaagggggggacgaa

SEQ ID NO: 184188 - DNA, 35 bp, Artificial Sequence
  Synthetic oligonucleotide
tccgcggagggagtgcgggtggagaggggggtgaa

SEQ ID NO: 184189 - DNA, 36 bp, Artificial Sequence
  Synthetic oligonucleotide
gtacagagcgggcggttgggcggtagagcggtgtaa

SEQ ID NO: 184190 - DNA, 34 bp, Artificial Sequence
  Synthetic oligonucleotide
gacggaagttgtagcccgcccgtatgtcccttaa

SEQ ID NO: 184191 - DNA, 35 bp, Artificial Sequence
  Synthetic oligonucleotide
acaccctatgttgtctaacccttctcccgctcaca

SEQ ID NO: 184192 - DNA, 36 bp, Artificial Sequence
  Synthetic oligonucleotide
tagcccacaccgctgtacgttctcttatctggtaca

SEQ ID NO: 184193 - DNA, 36 bp, Artificial Sequence
  Synthetic oligonucleotide
gcacaggccaggtgcttcttgtccgttcgtacccca

SEQ ID NO: 184194 - DNA, 36 bp, Artificial Sequence
  Synthetic oligonucleotide
tctcggtgtcctcgcagctcgccctccttggatcca

SEQ ID NO: 184195 - DNA, 35 bp, Artificial Sequence
  Synthetic oligonucleotide
tcagcgggtgggtagggttatgggcaggctatcca

SEQ ID NO: 184196 - DNA, 35 bp, Artificial Sequence
  Synthetic oligonucleotide
atgacatgggcgggatacgggcggatatggaggca

SEQ ID NO: 184197 - DNA, 36 bp, Artificial Sequence
  Synthetic oligonucleotide
agtagacgtgacagggtggagtgagggggtggggca

SEQ ID NO: 184198 - DNA, 36 bp, Artificial Sequence
  Synthetic oligonucleotide
gtcgaccatgaccgcccctttgtcttgcccaactca

SEQ ID NO: 184199 - DNA, 36 bp, Artificial Sequence
  Synthetic oligonucleotide
atcctgccatcgcaatgacgagtcccttccgcctca

SEQ ID NO: 184200 - DNA, 35 bp, Artificial Sequence
  Synthetic oligonucleotide
atcggaggtcacggtggggaggaggacggatgtca

SEQ ID NO: 184201 - DNA, 35 bp, Artificial Sequence
  Synthetic oligonucleotide
gtattgcccctcatagctgtgtccctgtcctgtca

SEQ ID NO: 184202 - DNA, 35 bp, Artificial Sequence
  Synthetic oligonucleotide
gcccgggcctctgctccatcacagctggtacttca

SEQ ID NO: 184203 - DNA, 36 bp, Artificial Sequence
  Synthetic oligonucleotide
ggaatgccatcacatcccatccgagtcgaaccttca

SEQ ID NO: 184204 - DNA, 35 bp, Artificial Sequence
  Synthetic oligonucleotide
gtgacacccctgctaccgcgttaacctctctttca

SEQ ID NO: 184205 - DNA, 36 bp, Artificial Sequence
  Synthetic oligonucleotide
gggggaggttgggaggggccgaaaagccggcaaaga

SEQ ID NO: 184206 - DNA, 37 bp, Artificial Sequence
  Synthetic oligonucleotide
atagaccgcgggttgggtggagtgggacgtccggaga

SEQ ID NO: 184207 - DNA, 36 bp, Artificial Sequence
  Synthetic oligonucleotide
gtgagggaaccaaactgtggaacatggggggggaga

SEQ ID NO: 184208 - DNA, 37 bp, Artificial Sequence
  Synthetic oligonucleotide
atcaccccgatccgaatggtcattgctactgccacga

SEQ ID NO: 184209 - DNA, 37 bp, Artificial Sequence
  Synthetic oligonucleotide
attcacgccgacgttcggaccctcgcctcatccacga

SEQ ID NO: 184210 - DNA, 37 bp, Artificial Sequence
  Synthetic oligonucleotide
aacgtagtcgcacacaattttagtaccctgctcccga

SEQ ID NO: 184211 - DNA, 38 bp, Artificial Sequence
  Synthetic oligonucleotide
taccgccctatccgaaaagacctcccacattctgccga

SEQ ID NO: 184212 - DNA, 37 bp, Artificial Sequence
  Synthetic oligonucleotide
gcccacccgccgttgtccattttcgctggctatccga

SEQ ID NO: 184213 - DNA, 37 bp, Artificial Sequence
  Synthetic oligonucleotide
acttctgaccatctgtagctacaagcaccctcctcga

SEQ ID NO: 184214 - DNA, 37 bp, Artificial Sequence
  Synthetic oligonucleotide
gtgggcgggtagggatgggggctggccctgggttcga

SEQ ID NO: 184215 - DNA, 37 bp, Artificial Sequence
  Synthetic oligonucleotide
tccgacattactgacctgcatacaacggccctttcga

SEQ ID NO: 184216 - DNA, 37 bp, Artificial Sequence
  Synthetic oligonucleotide
acgcaagggtgggcggggacgaaatagggagacagga

SEQ ID NO: 184217 - DNA, 37 bp, Artificial Sequence
  Synthetic oligonucleotide
ttggaggacggcggtggtttggggggaggataccgga

SEQ ID NO: 184218 - DNA, 37 bp, Artificial Sequence
  Synthetic oligonucleotide
gttggtcaagggggaggggacatctgagggcggcgga

SEQ ID NO: 184219 - DNA, 37 bp, Artificial Sequence
  Synthetic oligonucleotide
gccgaagcacacacgccgccctcccagaatcactgga

SEQ ID NO: 184220 - DNA, 36 bp, Artificial Sequence
  Synthetic oligonucleotide
tccatcctcctcgatactttttgctgacctcgtgga

SEQ ID NO: 184221 - DNA, 36 bp, Artificial Sequence
  Synthetic oligonucleotide
gaatgcataaagggtgccgggagggggtggaaatga

SEQ ID NO: 184222 - DNA, 38 bp, Artificial Sequence
  Synthetic oligonucleotide
ggtccaccaccctgctttcctcaattgcagtcgaatga

SEQ ID NO: 184223 - DNA, 37 bp, Artificial Sequence
  Synthetic oligonucleotide
gcgtgtcggggccgggcgggagggagtttgacgatga

SEQ ID NO: 184224 - DNA, 36 bp, Artificial Sequence
  Synthetic oligonucleotide
tacgccgaccccgcccagtccgcttacaatctatga

SEQ ID NO: 184225 - DNA, 38 bp, Artificial Sequence
  Synthetic oligonucleotide
ttactgccgccgtccaattccccctctgcgcacactga

SEQ ID NO: 184226 - DNA, 36 bp, Artificial Sequence
  Synthetic oligonucleotide
atcgccccagttatcccgccgcattctacagactga

SEQ ID NO: 184227 - DNA, 38 bp, Artificial Sequence
  Synthetic oligonucleotide
attggggtggtggagggcatggaaaggtgcgggactga

SEQ ID NO: 184228 - DNA, 37 bp, Artificial Sequence
  Synthetic oligonucleotide
tacgagccacatgtttacccgcctcactcttgactga

SEQ ID NO: 184229 - DNA, 38 bp, Artificial Sequence
  Synthetic oligonucleotide
tcagtgcctgccgttatttactacatcctcgttactga

SEQ ID NO: 184230 - DNA, 38 bp, Artificial Sequence
  Synthetic oligonucleotide
gccgatctgcctcgcacgagcccgttattcctccctga

SEQ ID NO: 184231 - DNA, 38 bp, Artificial Sequence
  Synthetic oligonucleotide
gcgagctcgcccctgctgacattattctcgactcctga

SEQ ID NO: 184232 - DNA, 38 bp, Artificial Sequence
  Synthetic oligonucleotide
gccccattgcccatccatcatgaccgagagtctcctga

SEQ ID NO: 184233 - DNA, 37 bp, Artificial Sequence
  Synthetic oligonucleotide
atcgagtgctgttcgtagtttccgcgttccttcctga

SEQ ID NO: 184234 - DNA, 37 bp, Artificial Sequence
  Synthetic oligonucleotide
acgacatactcgcagttactgacaccctctttcctga

SEQ ID NO: 184235 - DNA, 38 bp, Artificial Sequence
  Synthetic oligonucleotide
gatgctagtcagtcacattattccgtctcccccgctga

SEQ ID NO: 184236 - DNA, 36 bp, Artificial Sequence
  Synthetic oligonucleotide
gctggagacagcggggaggggagcacggcgggctga

SEQ ID NO: 184237 - DNA, 38 bp, Artificial Sequence
  Synthetic oligonucleotide
tgacacccagtgatcatttcccgctatctctctcgtga

SEQ ID NO: 184238 - DNA, 38 bp, Artificial Sequence
  Synthetic oligonucleotide
actgtcgcccacttgctcttcagcttcccgtctcgtga

SEQ ID NO: 184239 - DNA, 37 bp, Artificial Sequence
  Synthetic oligonucleotide
ttgtagagggtcggggggaggccaataagagcggtga

SEQ ID NO: 184240 - DNA, 38 bp, Artificial Sequence
  Synthetic oligonucleotide
tatgcgcgtgaacaactagaagggcggggcaagggtga

SEQ ID NO: 184241 - DNA, 37 bp, Artificial Sequence
  Synthetic oligonucleotide
gtcacgggaacaacgggtgaagggggggtacgggtga

SEQ ID NO: 184242 - DNA, 38 bp, Artificial Sequence
  Synthetic oligonucleotide
gaacgcggggtgtggtaagggcgggtaaggtcgggtga

SEQ ID NO: 184243 - DNA, 37 bp, Artificial Sequence
  Synthetic oligonucleotide
tctgcctctttggctggcgacccattcccccctgtga

SEQ ID NO: 184244 - DNA, 38 bp, Artificial Sequence
  Synthetic oligonucleotide
gattggcggtaggggatcgtaagggggggcaggattga

SEQ ID NO: 184245 - DNA, 37 bp, Artificial Sequence
  Synthetic oligonucleotide
acagtacggggtggaaggggaactggtacgatattga

SEQ ID NO: 184246 - DNA, 37 bp, Artificial Sequence
  Synthetic oligonucleotide
gtgccgctccgtttcgtccctctgccctttgtattga

SEQ ID NO: 184247 - DNA, 38 bp, Artificial Sequence
  Synthetic oligonucleotide
aagaacagcctccgtaggctctattcctgtacccttga

SEQ ID NO: 184248 - DNA, 37 bp, Artificial Sequence
  Synthetic oligonucleotide
tgccatggtctcttctctgcacatcaccccgccttga

SEQ ID NO: 184249 - DNA, 36 bp, Artificial Sequence
  Synthetic oligonucleotide
aacgaaggagggtggggagttacatagggcagttga

SEQ ID NO: 184250 - DNA, 38 bp, Artificial Sequence
  Synthetic oligonucleotide
tccgtcgcaccgccttgctcgagcactttacctgttga

SEQ ID NO: 184251 - DNA, 38 bp, Artificial Sequence
  Synthetic oligonucleotide
tcgccattctcagccgctcctcgactccccccgtttga

SEQ ID NO: 184252 - DNA, 35 bp, Artificial Sequence
  Synthetic oligonucleotide
gacacggcctcttgtcacttagcccactttcaata

SEQ ID NO: 184253 - DNA, 36 bp, Artificial Sequence
  Synthetic oligonucleotide
acaccccgccgccacactataaacaggtccggaata

SEQ ID NO: 184254 - DNA, 35 bp, Artificial Sequence
  Synthetic oligonucleotide
gaccacccctcaagccacagtttgcgtcccaccta

SEQ ID NO: 184255 - DNA, 36 bp, Artificial Sequence
  Synthetic oligonucleotide
gtgacaccccgacctccgtcctgtattacgctgcta

SEQ ID NO: 184256 - DNA, 35 bp, Artificial Sequence
  Synthetic oligonucleotide
gtgacgcaacgctttttccaattggctccactcta

SEQ ID NO: 184257 - DNA, 36 bp, Artificial Sequence
  Synthetic oligonucleotide
aggggaagggagctgggctagggaggaacatgcgta

SEQ ID NO: 184258 - DNA, 36 bp, Artificial Sequence
  Synthetic oligonucleotide
gctcaccttcccatgcgccatcttcatgacattgta

SEQ ID NO: 184259 - DNA, 36 bp, Artificial Sequence
  Synthetic oligonucleotide
acaccgatcagacgacccccctgtgcccgcaaatta

SEQ ID NO: 184260 - DNA, 36 bp, Artificial Sequence
  Synthetic oligonucleotide
gaaccaccctcgatgatcctactctttgaccgatta

SEQ ID NO: 184261 - DNA, 36 bp, Artificial Sequence
  Synthetic oligonucleotide
atggagaagggggcgaggggaagtcaggggggctta

SEQ ID NO: 184262 - DNA, 36 bp, Artificial Sequence
  Synthetic oligonucleotide
gctggtgccgcctccagccgaattactcgcctctta

SEQ ID NO: 184263 - DNA, 35 bp, Artificial Sequence
  Synthetic oligonucleotide
accccgccgccattgcttgccaatcgttaccgaac

SEQ ID NO: 184264 - DNA, 35 bp, Artificial Sequence
  Synthetic oligonucleotide
tcgaccgatcccgcagatgatgccccatcgttcac

SEQ ID NO: 184265 - DNA, 35 bp, Artificial Sequence
  Synthetic oligonucleotide
atgcaaggcctcgtgcgcgtccatttccctcgtac

SEQ ID NO: 184266 - DNA, 34 bp, Artificial Sequence
  Synthetic oligonucleotide
tcaggagggcgggtgggtacatgggttgatttac

SEQ ID NO: 184267 - DNA, 35 bp, Artificial Sequence
  Synthetic oligonucleotide
accccgaacgcctcgcccccctgataagtacaacc

SEQ ID NO: 184268 - DNA, 33 bp, Artificial Sequence
  Synthetic oligonucleotide
tctacgtcgttggccacaccatctaactccacc

SEQ ID NO: 184269 - DNA, 35 bp, Artificial Sequence
  Synthetic oligonucleotide
gttacccccctcagtttatcctgcattgattgacc

SEQ ID NO: 184270 - DNA, 35 bp, Artificial Sequence
  Synthetic oligonucleotide
tcgcccctatccgtaacacctcacgtggtgacccc

SEQ ID NO: 184271 - DNA, 35 bp, Artificial Sequence
  Synthetic oligonucleotide
gactgcccctgaggcatatcagccattctcgcccc

SEQ ID NO: 184272 - DNA, 35 bp, Artificial Sequence
  Synthetic oligonucleotide
ttgtgccgctctgcattcgcagtaattctctcccc

SEQ ID NO: 184273 - DNA, 35 bp, Artificial Sequence
  Synthetic oligonucleotide
gttactgccgtacgagctggttgcgatctcctccc

SEQ ID NO: 184274 - DNA, 35 bp, Artificial Sequence
  Synthetic oligonucleotide
gtttcgtctgtgcatttctccgtttggccgctccc

SEQ ID NO: 184275 - DNA, 35 bp, Artificial Sequence
  Synthetic oligonucleotide
aggtcgcgcgcatgcctccgctgttccatcgtccc

SEQ ID NO: 184276 - DNA, 34 bp, Artificial Sequence
  Synthetic oligonucleotide
tcccccgtaccgcccgctccacgtcgcattggcc

SEQ ID NO: 184277 - DNA, 35 bp, Artificial Sequence
  Synthetic oligonucleotide
atcgcctgttcctgtatgatctgcccgtacatgcc

SEQ ID NO: 184278 - DNA, 35 bp, Artificial Sequence
  Synthetic oligonucleotide
taccactacggtggatatccagatccgtccctgcc

SEQ ID NO: 184279 - DNA, 35 bp, Artificial Sequence
  Synthetic oligonucleotide
tttcccccagaccctgctcgcgccctgcccttgcc

SEQ ID NO: 184280 - DNA, 35 bp, Artificial Sequence
  Synthetic oligonucleotide
ttaggcaccctcccccttgcggcactggcccttcc

SEQ ID NO: 184281 - DNA, 35 bp, Artificial Sequence
  Synthetic oligonucleotide
gagtcatcatcagtcttttgcatcctgcttcttcc

SEQ ID NO: 184282 - DNA, 35 bp, Artificial Sequence
  Synthetic oligonucleotide
tgtaccgactctgttacacttccctttgttcttcc

SEQ ID NO: 184283 - DNA, 35 bp, Artificial Sequence
  Synthetic oligonucleotide
ggggtgaggtagggcggggatgggtgggaggtagc

SEQ ID NO: 184284 - DNA, 35 bp, Artificial Sequence
  Synthetic oligonucleotide
gacgcccgtccactagttcacgatcgcccctacgc

SEQ ID NO: 184285 - DNA, 35 bp, Artificial Sequence
  Synthetic oligonucleotide
tctaccacctccagtcttctgtacttctcgtccgc

SEQ ID NO: 184286 - DNA, 35 bp, Artificial Sequence
  Synthetic oligonucleotide
aacatccctatgcacctatgagagccttcctgcgc

SEQ ID NO: 184287 - DNA, 35 bp, Artificial Sequence
  Synthetic oligonucleotide
gcatgagctccggttgcatctccttttccactggc

SEQ ID NO: 184288 - DNA, 35 bp, Artificial Sequence
  Synthetic oligonucleotide
atggtggcgcatccccgtcctactaggaaccctgc

SEQ ID NO: 184289 - DNA, 35 bp, Artificial Sequence
  Synthetic oligonucleotide
gactcgcaccgttgcgtccactacgaccctgttgc

SEQ ID NO: 184290 - DNA, 35 bp, Artificial Sequence
  Synthetic oligonucleotide
atggagcgcaggtcgccgccgcccgtccaagtatc

SEQ ID NO: 184291 - DNA, 35 bp, Artificial Sequence
  Synthetic oligonucleotide
aaaggcccaccgtttcgcccccgtttctggtactc

SEQ ID NO: 184292 - DNA, 35 bp, Artificial Sequence
  Synthetic oligonucleotide
gcgccatccgccaccgaacgaagaactataccctc

SEQ ID NO: 184293 - DNA, 35 bp, Artificial Sequence
  Synthetic oligonucleotide
tcctgcgggtcctcacatagcggtaatgtcccctc

SEQ ID NO: 184294 - DNA, 35 bp, Artificial Sequence
  Synthetic oligonucleotide
gcccatatcgctctctttaactgctgctctggctc

SEQ ID NO: 184295 - DNA, 35 bp, Artificial Sequence
  Synthetic oligonucleotide
gcggaaagtccgccccatcgcatgccatccgtctc

SEQ ID NO: 184296 - DNA, 35 bp, Artificial Sequence
  Synthetic oligonucleotide
tccgtctcccttcattttgtcagccggttattctc

SEQ ID NO: 184297 - DNA, 35 bp, Artificial Sequence
  Synthetic oligonucleotide
accgcatcatagcatctcgatctctctccttggtc

SEQ ID NO: 184298 - DNA, 35 bp, Artificial Sequence
  Synthetic oligonucleotide
ggatgagcgttgcccacccctgataaatgcctgtc

SEQ ID NO: 184299 - DNA, 35 bp, Artificial Sequence
  Synthetic oligonucleotide
gtcaactgccgttccatctcgcctatcccgctgtc

SEQ ID NO: 184300 - DNA, 35 bp, Artificial Sequence
  Synthetic oligonucleotide
aatcagtcaccgtcaagccagcgcatcttctcttc

SEQ ID NO: 184301 - DNA, 35 bp, Artificial Sequence
  Synthetic oligonucleotide
tgacccccacaagtaaggtcgttccgcttcctccg

SEQ ID NO: 184302 - DNA, 35 bp, Artificial Sequence
  Synthetic oligonucleotide
ggacctgtcccagtcaaaaccccgctctccccgcg

SEQ ID NO: 184303 - DNA, 35 bp, Artificial Sequence
  Synthetic oligonucleotide
aatccaccaccccgctcgctgcgatcttaacttcg

SEQ ID NO: 184304 - DNA, 35 bp, Artificial Sequence
  Synthetic oligonucleotide
atcaggtgagggaatggaggagggggatttacagg

SEQ ID NO: 184305 - DNA, 35 bp, Artificial Sequence
  Synthetic oligonucleotide
tccccactgttcagtcctgcctcctacccctgagg

SEQ ID NO: 184306 - DNA, 35 bp, Artificial Sequence
  Synthetic oligonucleotide
ggtgagaggatgggggtcgaagggcgggttcgcgg

SEQ ID NO: 184307 - DNA, 35 bp, Artificial Sequence
  Synthetic oligonucleotide
gtcgagtgagagtgcaaggtgggagcaatgtgggg

SEQ ID NO: 184308 - DNA, 32 bp, Artificial Sequence
  Synthetic oligonucleotide
acacgtgggggggggcagggatacggtttatg

SEQ ID NO: 184309 - DNA, 35 bp, Artificial Sequence
  Synthetic oligonucleotide
accccgaccccctgccacgagtccaccacctactg

SEQ ID NO: 184310 - DNA, 35 bp, Artificial Sequence
  Synthetic oligonucleotide
ttctcccatccagtcgcgcataatttcgtttcctg

SEQ ID NO: 184311 - DNA, 35 bp, Artificial Sequence
  Synthetic oligonucleotide
tgtgcttgtcgtgcgcttcacgttacctattccat

SEQ ID NO: 184312 - DNA, 35 bp, Artificial Sequence
  Synthetic oligonucleotide
tgcgtgccctgccccactgcaaatgctttgcgcat

SEQ ID NO: 184313 - DNA, 35 bp, Artificial Sequence
  Synthetic oligonucleotide
tcgcctcctctgtcctgctgcggtactccgcctat

SEQ ID NO: 184314 - DNA, 35 bp, Artificial Sequence
  Synthetic oligonucleotide
gactcgggccacgagtatccgattcactttcctat

SEQ ID NO: 184315 - DNA, 35 bp, Artificial Sequence
  Synthetic oligonucleotide
gcactatcgcacgtcttcgctccaccccaggacct

SEQ ID NO: 184316 - DNA, 35 bp, Artificial Sequence
  Synthetic oligonucleotide
atgaagggggacggggtgagggagaacttgatcct

SEQ ID NO: 184317 - DNA, 35 bp, Artificial Sequence
  Synthetic oligonucleotide
gactcacatcgggcaagctgtcctgtaattctcct

SEQ ID NO: 184318 - DNA, 35 bp, Artificial Sequence
  Synthetic oligonucleotide
tgcctgatctccacccgtatgttccgctccactct

SEQ ID NO: 184319 - DNA, 35 bp, Artificial Sequence
  Synthetic oligonucleotide
gtgtcaccttcgaattccaacatcgcctggcctct

SEQ ID NO: 184320 - DNA, 35 bp, Artificial Sequence
  Synthetic oligonucleotide
ttgaaaccacctcaagcatgtacacgtgcatctct

SEQ ID NO: 184321 - DNA, 35 bp, Artificial Sequence
  Synthetic oligonucleotide
ttgatctccgcccccctctctgggattgacattct

SEQ ID NO: 184322 - DNA, 35 bp, Artificial Sequence
  Synthetic oligonucleotide
ttcactgctgtgcactcccgctcgttctcctttct

SEQ ID NO: 184323 - DNA, 35 bp, Artificial Sequence
  Synthetic oligonucleotide
tgaccacgccaggttgcctgctcgccccatttcgt

SEQ ID NO: 184324 - DNA, 35 bp, Artificial Sequence
  Synthetic oligonucleotide
atggggagggacggatgggatgtatgctgtgatgt

SEQ ID NO: 184325 - DNA, 35 bp, Artificial Sequence
  Synthetic oligonucleotide
accttccgctgccatttcgtgtgatctccgcctgt

SEQ ID NO: 184326 - DNA, 35 bp, Artificial Sequence
  Synthetic oligonucleotide
attccacgccgccttcatacgtaccaccagtaatt

SEQ ID NO: 184327 - DNA, 35 bp, Artificial Sequence
  Synthetic oligonucleotide
gatcccgttctacctgcctattctacgttcgcctt

SEQ ID NO: 184328 - DNA, 35 bp, Artificial Sequence
  Synthetic oligonucleotide
ggacacgtactgttcttcggcgcctcctccggctt

SEQ ID NO: 184329 - DNA, 35 bp, Artificial Sequence
  Synthetic oligonucleotide
ttgcctgtgctcactggtttccactaccccacgtt

SEQ ID NO: 184330 - DNA, 36 bp, Artificial Sequence
  Synthetic oligonucleotide
agtagggcacgagagatagggggcgtggcggaaaaa

SEQ ID NO: 184331 - DNA, 36 bp, Artificial Sequence
  Synthetic oligonucleotide
atcacaccccatcactgttgcacgatctgttgacaa

SEQ ID NO: 184332 - DNA, 36 bp, Artificial Sequence
  Synthetic oligonucleotide
ggtggggagagcgggggagcgttggataggtggcaa

SEQ ID NO: 184333 - DNA, 35 bp, Artificial Sequence
  Synthetic oligonucleotide
gcacccctccacagctgtcttgttccatctacgaa

SEQ ID NO: 184334 - DNA, 36 bp, Artificial Sequence
  Synthetic oligonucleotide
ccgatgctccaccggtctgtcacctctctgctcgaa

SEQ ID NO: 184335 - DNA, 34 bp, Artificial Sequence
  Synthetic oligonucleotide
aacaaggcagggcggacggggggggcaaagggaa

SEQ ID NO: 184336 - DNA, 36 bp, Artificial Sequence
  Synthetic oligonucleotide
attccctcgctcaccccgtatagtgtggttcacaca

SEQ ID NO: 184337 - DNA, 36 bp, Artificial Sequence
  Synthetic oligonucleotide
gcccgtctcatgcggctaacggtctttcgccccaca

SEQ ID NO: 184338 - DNA, 36 bp, Artificial Sequence
  Synthetic oligonucleotide
gcgaccccactacgccctgctcctatcaagtgcaca

SEQ ID NO: 184339 - DNA, 36 bp, Artificial Sequence
  Synthetic oligonucleotide
aacattgggggagataaaggggcacatgacgagaca

SEQ ID NO: 184340 - DNA, 35 bp, Artificial Sequence
  Synthetic oligonucleotide
gcccgaatggtatcggcacagcttccgcccctaca

SEQ ID NO: 184341 - DNA, 36 bp, Artificial Sequence
  Synthetic oligonucleotide
ggaacgacagaatagagggtgggggggtagaaacca

SEQ ID NO: 184342 - DNA, 36 bp, Artificial Sequence
  Synthetic oligonucleotide
atacgccgggtgtgccgtcgctccttctcctaacca

SEQ ID NO: 184343 - DNA, 36 bp, Artificial Sequence
  Synthetic oligonucleotide
gcgtacgtagttgatgatgtgtaccgtccgccccca

SEQ ID NO: 184344 - DNA, 36 bp, Artificial Sequence
  Synthetic oligonucleotide
tgtgcaaatgtcgatcctaatggcccggctctccca

SEQ ID NO: 184345 - DNA, 36 bp, Artificial Sequence
  Synthetic oligonucleotide
tgtccccatcttgtattgcatatcttacccgtccca

SEQ ID NO: 184346 - DNA, 36 bp, Artificial Sequence
  Synthetic oligonucleotide
gactcccgcacctgcctatgttttgcgtagttccca

SEQ ID NO: 184347 - DNA, 35 bp, Artificial Sequence
  Synthetic oligonucleotide
gcctgcattgccatgttcgctctttgtccagtcca

SEQ ID NO: 184348 - DNA, 36 bp, Artificial Sequence
  Synthetic oligonucleotide
gttgtccgcatccatctcgtgcaattatcttttcca

SEQ ID NO: 184349 - DNA, 36 bp, Artificial Sequence
  Synthetic oligonucleotide
atcgggcgggagtatgggaagggtcgccgatccgca

SEQ ID NO: 184350 - DNA, 36 bp, Artificial Sequence
  Synthetic oligonucleotide
cacactcgaagcgtctaaatcacctgctcctccgca

SEQ ID NO: 184351 - DNA, 35 bp, Artificial Sequence
  Synthetic oligonucleotide
tatcccagcaatcccccggttttagaccccgtgca

SEQ ID NO: 184352 - DNA, 36 bp, Artificial Sequence
  Synthetic oligonucleotide
gatccgatgccgcagatgctgcctctcgttttatca

SEQ ID NO: 184353 - DNA, 36 bp, Artificial Sequence
  Synthetic oligonucleotide
ggttgccccaccgacttgtttactatcccccactca

SEQ ID NO: 184354 - DNA, 35 bp, Artificial Sequence
  Synthetic oligonucleotide
tcatgcacgtcactcccgtaatcggttccccctca

SEQ ID NO: 184355 - DNA, 36 bp, Artificial Sequence
  Synthetic oligonucleotide
tcaacccctcccatgtctgcgaagcacgggccctca

SEQ ID NO: 184356 - DNA, 36 bp, Artificial Sequence
  Synthetic oligonucleotide
gttcccatgccttgtatgctaccctatgttccctca

SEQ ID NO: 184357 - DNA, 36 bp, Artificial Sequence
  Synthetic oligonucleotide
tcaaagcacggcctatggctacgtctactgctctca

SEQ ID NO: 184358 - DNA, 36 bp, Artificial Sequence
  Synthetic oligonucleotide
tgactagctgtatcgccttaattcgccctccgttca

SEQ ID NO: 184359 - DNA, 35 bp, Artificial Sequence
  Synthetic oligonucleotide
acacgtgctccatgtgtggctacacctttttttca

SEQ ID NO: 184360 - DNA, 37 bp, Artificial Sequence
  Synthetic oligonucleotide
acgagggtgggaaggaaagcgggggttctggctcaga

SEQ ID NO: 184361 - DNA, 37 bp, Artificial Sequence
  Synthetic oligonucleotide
tcccccgcccttcctgtgatctcgggttctgtagaga

SEQ ID NO: 184362 - DNA, 37 bp, Artificial Sequence
  Synthetic oligonucleotide
aagacgggactgttgtaggggaagtgagggagggaga

SEQ ID NO: 184363 - DNA, 35 bp, Artificial Sequence
  Synthetic oligonucleotide
taccccgtacttttgccatttcactgtccgaacga

SEQ ID NO: 184364 - DNA, 37 bp, Artificial Sequence
  Synthetic oligonucleotide
acgaatgccgtcggtacgtccctgctcgcctctccga

SEQ ID NO: 184365 - DNA, 37 bp, Artificial Sequence
  Synthetic oligonucleotide
gctgcaccaccatctgtcgacgctgcgccatctgcga

SEQ ID NO: 184366 - DNA, 37 bp, Artificial Sequence
  Synthetic oligonucleotide
tccgcgtgccgctttttatccgttttcgatccatcga

SEQ ID NO: 184367 - DNA, 37 bp, Artificial Sequence
  Synthetic oligonucleotide
actgtccacactcgttccctttcgcctcgtacctcga

SEQ ID NO: 184368 - DNA, 37 bp, Artificial Sequence
  Synthetic oligonucleotide
gatggacctgccgcatcttattcttgccacacttcga

SEQ ID NO: 184369 - DNA, 37 bp, Artificial Sequence
  Synthetic oligonucleotide
cacaaggatggagggaagggtgggaaaggaagaagga

SEQ ID NO: 184370 - DNA, 37 bp, Artificial Sequence
  Synthetic oligonucleotide
gacggtaaggcgggaagggtagggtgggggggcagga

SEQ ID NO: 184371 - DNA, 37 bp, Artificial Sequence
  Synthetic oligonucleotide
agccacccgcaacatccgcctacagatcctaatagga

SEQ ID NO: 184372 - DNA, 37 bp, Artificial Sequence
  Synthetic oligonucleotide
gtttccgcccacattagttttttcacccttactagga

SEQ ID NO: 184373 - DNA, 36 bp, Artificial Sequence
  Synthetic oligonucleotide
tccataccccctgatagtccgtcccacccccaggga

SEQ ID NO: 184374 - DNA, 37 bp, Artificial Sequence
  Synthetic oligonucleotide
gtccttaccgctttctgccctgcttccgtgtacggga

SEQ ID NO: 184375 - DNA, 37 bp, Artificial Sequence
  Synthetic oligonucleotide
gtgggccacacaatgggggacggtaagctccggggga

SEQ ID NO: 184376 - DNA, 36 bp, Artificial Sequence
  Synthetic oligonucleotide
tcacgaacgctcagaatggagagggatggggtggga

SEQ ID NO: 184377 - DNA, 34 bp, Artificial Sequence
  Synthetic oligonucleotide
aaaccccgccttcttatccgcccctcaattggga

SEQ ID NO: 184378 - DNA, 37 bp, Artificial Sequence
  Synthetic oligonucleotide
gccgcctacgagagggaggggagtggaatggaatgga

SEQ ID NO: 184379 - DNA, 37 bp, Artificial Sequence
  Synthetic oligonucleotide
tacatctggtaggaggtaggggacggtggtacttgga

SEQ ID NO: 184380 - DNA, 38 bp, Artificial Sequence
  Synthetic oligonucleotide
ggggggagggcacgaggcgggctaacacaggaaaatga

SEQ ID NO: 184381 - DNA, 38 bp, Artificial Sequence
  Synthetic oligonucleotide
gtaccagcgagggggagggtggtcggggaaaggaatga

SEQ ID NO: 184382 - DNA, 38 bp, Artificial Sequence
  Synthetic oligonucleotide
tcagtccctgaagctatgcaaccctccgctccgcatga

SEQ ID NO: 184383 - DNA, 38 bp, Artificial Sequence
  Synthetic oligonucleotide
gacctcctctgctttttatcgcctctcgctttcgatga

SEQ ID NO: 184384 - DNA, 38 bp, Artificial Sequence
  Synthetic oligonucleotide
tgagggcggagggaggggggtggatttggacgttatga

SEQ ID NO: 184385 - DNA, 38 bp, Artificial Sequence
  Synthetic oligonucleotide
tgcgccctcttgagccgtttgccgatgccttccactga

SEQ ID NO: 184386 - DNA, 38 bp, Artificial Sequence
  Synthetic oligonucleotide
gaaacagtgcgggggtcaagggggcggtcgagcactga

SEQ ID NO: 184387 - DNA, 38 bp, Artificial Sequence
  Synthetic oligonucleotide
gttgggggaacgggtggggaaaagtattaggggactga

SEQ ID NO: 184388 - DNA, 37 bp, Artificial Sequence
  Synthetic oligonucleotide
agttgccagcctctgcccgcattaaccgattgcctga

SEQ ID NO: 184389 - DNA, 38 bp, Artificial Sequence
  Synthetic oligonucleotide
gcaactgtacgcgctactaagtgcccatcccctgctga

SEQ ID NO: 184390 - DNA, 30 bp, Artificial Sequence
  Synthetic oligonucleotide
acttccaccttctgcaattccccttgctga

SEQ ID NO: 184391 - DNA, 38 bp, Artificial Sequence
  Synthetic oligonucleotide
gtctccccctcgcctccaatgatagcagtcatatctga

SEQ ID NO: 184392 - DNA, 37 bp, Artificial Sequence
  Synthetic oligonucleotide
tccagcctgtggtgccccgcctgccttatccttctga

SEQ ID NO: 184393 - DNA, 38 bp, Artificial Sequence
  Synthetic oligonucleotide
acagggggcccgctctgttacatccttccctaccgtga

SEQ ID NO: 184394 - DNA, 36 bp, Artificial Sequence
  Synthetic oligonucleotide
ggtgccacgcggctgtgggaagggacgggagggtga

SEQ ID NO: 184395 - DNA, 38 bp, Artificial Sequence
  Synthetic oligonucleotide
gagtacggaggtgtgccggggggaaagggagcgtgtga

SEQ ID NO: 184396 - DNA, 37 bp, Artificial Sequence
  Synthetic oligonucleotide
gagggacctaagcaggaagacgaaggaaggggattga

SEQ ID NO: 184397 - DNA, 35 bp, Artificial Sequence
  Synthetic oligonucleotide
atcgggccgccttttggcctatcctcctgacttga

SEQ ID NO: 184398 - DNA, 38 bp, Artificial Sequence
  Synthetic oligonucleotide
acttccctgtgccgtggtaaccgccgcaattcccttga

SEQ ID NO: 184399 - DNA, 38 bp, Artificial Sequence
  Synthetic oligonucleotide
agttctgccatatcgtcctcgtgctgccctctccttga

SEQ ID NO: 184400 - DNA, 38 bp, Artificial Sequence
  Synthetic oligonucleotide
tgtaaacccctccatcactatatgcgtcccgtccttga

SEQ ID NO: 184401 - DNA, 38 bp, Artificial Sequence
  Synthetic oligonucleotide
tttcaccacgccccattatgctatattgtttcgcttga

SEQ ID NO: 184402 - DNA, 38 bp, Artificial Sequence
  Synthetic oligonucleotide
gagcgctgggccgtatagccctcccctgttcctcttga

SEQ ID NO: 184403 - DNA, 38 bp, Artificial Sequence
  Synthetic oligonucleotide
actccgcccttgtcacgctgctcatacccgcttgttga

SEQ ID NO: 184404 - DNA, 35 bp, Artificial Sequence
  Synthetic oligonucleotide
gtccccggtgcaccctgtttcgtccccggctttga

SEQ ID NO: 184405 - DNA, 38 bp, Artificial Sequence
  Synthetic oligonucleotide
gcccccggcctccgaatacctatacgcttccggtttga

SEQ ID NO: 184406 - DNA, 36 bp, Artificial Sequence
  Synthetic oligonucleotide
gagactggccccataggtaatcgcctgctttcacta

SEQ ID NO: 184407 - DNA, 27 bp, Artificial Sequence
  Synthetic oligonucleotide
tgactgcccgacccccctcttcagcta

SEQ ID NO: 184408 - DNA, 36 bp, Artificial Sequence
  Synthetic oligonucleotide
acccgcggcaccctatattagtgcgcttcccctcta

SEQ ID NO: 184409 - DNA, 35 bp, Artificial Sequence
  Synthetic oligonucleotide
acgccctcctcagggaatttcccgtactccctcta

SEQ ID NO: 184410 - DNA, 36 bp, Artificial Sequence
  Synthetic oligonucleotide
gaattcccgcatcctccgcccattgttcgttttcta

SEQ ID NO: 184411 - DNA, 37 bp, Artificial Sequence
  Synthetic oligonucleotide
gctccaacgcctcttatcgtctcaccaagtactagta

SEQ ID NO: 184412 - DNA, 36 bp, Artificial Sequence
  Synthetic oligonucleotide
ggggtgggcgcatgccataatatagtgaaagaggta

SEQ ID NO: 184413 - DNA, 36 bp, Artificial Sequence
  Synthetic oligonucleotide
gaccgccctagcgcgtcgagcaccataccacctgta

SEQ ID NO: 184414 - DNA, 36 bp, Artificial Sequence
  Synthetic oligonucleotide
acgttccacccgccctcgaggttcctctgccactta

SEQ ID NO: 184415 - DNA, 35 bp, Artificial Sequence
  Synthetic oligonucleotide
acctgccccacccgcccacgattttcactgtctta

SEQ ID NO: 184416 - DNA, 36 bp, Artificial Sequence
  Synthetic oligonucleotide
tgacacccattccgccgtgctcgcccttgtaattta

SEQ ID NO: 184417 - DNA, 35 bp, Artificial Sequence
  Synthetic oligonucleotide
gccgcgggccttttccgttgtctctgcctccaaac

SEQ ID NO: 184418 - DNA, 35 bp, Artificial Sequence
  Synthetic oligonucleotide
gtttgagcccgccacatgttccattccgcgtcaac

SEQ ID NO: 184419 - DNA, 35 bp, Artificial Sequence
  Synthetic oligonucleotide
tgatgggaaccatctcgttctaccccgtaccacac

SEQ ID NO: 184420 - DNA, 35 bp, Artificial Sequence
  Synthetic oligonucleotide
gcatcagatgtcccctacgttctgcgatgtaccac

SEQ ID NO: 184421 - DNA, 35 bp, Artificial Sequence
  Synthetic oligonucleotide
ttactcccgaccgccaccagtacagcccttatcac

SEQ ID NO: 184422 - DNA, 35 bp, Artificial Sequence
  Synthetic oligonucleotide
tcacccatattgctccgacccgttcgcctagtgac

SEQ ID NO: 184423 - DNA, 35 bp, Artificial Sequence
  Synthetic oligonucleotide
acccatcatgcgggcctttatttcctcgcccatac

SEQ ID NO: 184424 - DNA, 35 bp, Artificial Sequence
  Synthetic oligonucleotide
gtctaagacctcagctcctagccctgttgtccacc

SEQ ID NO: 184425 - DNA, 35 bp, Artificial Sequence
  Synthetic oligonucleotide
accgcaacttatcctcttgtcgcgtacctacgacc

SEQ ID NO: 184426 - DNA, 35 bp, Artificial Sequence
  Synthetic oligonucleotide
tctgcgaccctgcaacgtctcgcctcaagcctacc

SEQ ID NO: 184427 - DNA, 35 bp, Artificial Sequence
  Synthetic oligonucleotide
tcatccactcaccatcatgcgggaaacacggaccc

SEQ ID NO: 184428 - DNA, 35 bp, Artificial Sequence
  Synthetic oligonucleotide
ttcgacaagtcacgcacgtcgggtaacccctcccc

SEQ ID NO: 184429 - DNA, 35 bp, Artificial Sequence
  Synthetic oligonucleotide
tcgactccaccgttttgagtttccggtgtctcccc

SEQ ID NO: 184430 - DNA, 35 bp, Artificial Sequence
  Synthetic oligonucleotide
tgtgcgcgtatgccgacgtgttctatccaccgccc

SEQ ID NO: 184431 - DNA, 35 bp, Artificial Sequence
  Synthetic oligonucleotide
gtccgtcacaatcagacctctagcatcgaccgccc

SEQ ID NO: 184432 - DNA, 35 bp, Artificial Sequence
  Synthetic oligonucleotide
ggacccctcgcgattcttgtaacggttacatgccc

SEQ ID NO: 184433 - DNA, 35 bp, Artificial Sequence
  Synthetic oligonucleotide
attggccgcagtcctgtggctgccatcccgatccc

SEQ ID NO: 184434 - DNA, 35 bp, Artificial Sequence
  Synthetic oligonucleotide
acgtggcgcatcagttcattagccgccgtgctccc

SEQ ID NO: 184435 - DNA, 35 bp, Artificial Sequence
  Synthetic oligonucleotide
actgatgggcgtcccgaatgcctcttcccccagcc

SEQ ID NO: 184436 - DNA, 35 bp, Artificial Sequence
  Synthetic oligonucleotide
tacaccgtagtatccgaaccgtctgtttctccgcc

SEQ ID NO: 184437 - DNA, 36 bp, Artificial Sequence
  Synthetic oligonucleotide
aacatgcccgttcggcaggccagccagtccctcgcc

SEQ ID NO: 184438 - DNA, 35 bp, Artificial Sequence
  Synthetic oligonucleotide
gatcgcacacagtcactacacctatcatcaatgcc

SEQ ID NO: 184439 - DNA, 35 bp, Artificial Sequence
  Synthetic oligonucleotide
tctgcgaaccctgcagccggtctccctccgcatcc

SEQ ID NO: 184440 - DNA, 35 bp, Artificial Sequence
  Synthetic oligonucleotide
gctcgtcctcgcgacaccttaccctaacgtgctcc

SEQ ID NO: 184441 - DNA, 35 bp, Artificial Sequence
  Synthetic oligonucleotide
gatgagccccgtctttaggtgtcaactgcccgtcc

SEQ ID NO: 184442 - DNA, 35 bp, Artificial Sequence
  Synthetic oligonucleotide
ggagcatcgaaatggtggcttccgttcgtccttcc

SEQ ID NO: 184443 - DNA, 35 bp, Artificial Sequence
  Synthetic oligonucleotide
gcaacttccgccttacgacacccgttccgcccagc

SEQ ID NO: 184444 - DNA, 35 bp, Artificial Sequence
  Synthetic oligonucleotide
tcacaccacccactttctatatatgggccccccgc

SEQ ID NO: 184445 - DNA, 35 bp, Artificial Sequence
  Synthetic oligonucleotide
gagccacatgtcagttagcttccctcactccccgc

SEQ ID NO: 184446 - DNA, 35 bp, Artificial Sequence
  Synthetic oligonucleotide
gtgctaccactgacctctatccaagtactccccgc

SEQ ID NO: 184447 - DNA, 35 bp, Artificial Sequence
  Synthetic oligonucleotide
gcctcctaccgtaacacctgcttcacagccctcgc

SEQ ID NO: 184448 - DNA, 35 bp, Artificial Sequence
  Synthetic oligonucleotide
gcgtggccatgtgtaccacccgcccatttcgtcgc

SEQ ID NO: 184449 - DNA, 35 bp, Artificial Sequence
  Synthetic oligonucleotide
tcatccgcttccggtcaccataatgatgccttcgc

SEQ ID NO: 184450 - DNA, 35 bp, Artificial Sequence
  Synthetic oligonucleotide
gctggtcaccccgcccctcgtacgtcatgtatggc

SEQ ID NO: 184451 - DNA, 35 bp, Artificial Sequence
  Synthetic oligonucleotide
gaagcataaaggggggaaggtgggggacatgtggc

SEQ ID NO: 184452 - DNA, 35 bp, Artificial Sequence
  Synthetic oligonucleotide
attgccgtctagacaccccctgccattaaccatgc

SEQ ID NO: 184453 - DNA, 35 bp, Artificial Sequence
  Synthetic oligonucleotide
atcaccatgtcgttgctagactagtgccccccctc

SEQ ID NO: 184454 - DNA, 35 bp, Artificial Sequence
  Synthetic oligonucleotide
gccgtcctggtgtcttgtggtcctcatgttccctc

SEQ ID NO: 184455 - DNA, 35 bp, Artificial Sequence
  Synthetic oligonucleotide
aatgcctagctgtcacccacgtctgttcttgcctc

SEQ ID NO: 184456 - DNA, 35 bp, Artificial Sequence
  Synthetic oligonucleotide
tcagtgtgtcactctattgtatttacctactcgtc

SEQ ID NO: 184457 - DNA, 35 bp, Artificial Sequence
  Synthetic oligonucleotide
tcttcacccgccggtcccgtacgatatcgccgttc

SEQ ID NO: 184458 - DNA, 35 bp, Artificial Sequence
  Synthetic oligonucleotide
actatcccctcgatgtctctacaatttgtgccacg

SEQ ID NO: 184459 - DNA, 35 bp, Artificial Sequence
  Synthetic oligonucleotide
agaaatgggacgggacagggggggttaggcgcacg

SEQ ID NO: 184460 - DNA, 35 bp, Artificial Sequence
  Synthetic oligonucleotide
ttaggtggtggaggggttggatggcggtcgcgccg

SEQ ID NO: 184461 - DNA, 35 bp, Artificial Sequence
  Synthetic oligonucleotide
gttccgccgttcctcctgattctgatctatcatcg

SEQ ID NO: 184462 - DNA, 35 bp, Artificial Sequence
  Synthetic oligonucleotide
acaggggtgggagggcagagggatctggtatgtcg

SEQ ID NO: 184463 - DNA, 35 bp, Artificial Sequence
  Synthetic oligonucleotide
gaagcggcacaggtcctccctccgtgtccccgtgg

SEQ ID NO: 184464 - DNA, 35 bp, Artificial Sequence
  Synthetic oligonucleotide
actccgccccatctatgtaattgaatcttgtaatg

SEQ ID NO: 184465 - DNA, 35 bp, Artificial Sequence
  Synthetic oligonucleotide
tcacacctgtccatggtcgctcttgggatatcctg

SEQ ID NO: 184466 - DNA, 35 bp, Artificial Sequence
  Synthetic oligonucleotide
atactccgtcctatactcccgactccttctacgtg

SEQ ID NO: 184467 - DNA, 35 bp, Artificial Sequence
  Synthetic oligonucleotide
gatcatacgcctgcaaactacacatatcgttccat

SEQ ID NO: 184468 - DNA, 35 bp, Artificial Sequence
  Synthetic oligonucleotide
ttcgacccacatgttcccctttcagcctgattcat

SEQ ID NO: 184469 - DNA, 35 bp, Artificial Sequence
  Synthetic oligonucleotide
tgagacgtgtaatctggcgccttccctcttttcat

SEQ ID NO: 184470 - DNA, 34 bp, Artificial Sequence
  Synthetic oligonucleotide
atgccatgacgcgagccaccccctgccccatgat

SEQ ID NO: 184471 - DNA, 27 bp, Artificial Sequence
  Synthetic oligonucleotide
ttcctagctcccctgcttcccgcctat

SEQ ID NO: 184472 - DNA, 35 bp, Artificial Sequence
  Synthetic oligonucleotide
gagccggggccttagcatgttccgctccatcctat

SEQ ID NO: 184473 - DNA, 35 bp, Artificial Sequence
  Synthetic oligonucleotide
tcccgaccaatatcggtccatgatccacttgctat

SEQ ID NO: 184474 - DNA, 35 bp, Artificial Sequence
  Synthetic oligonucleotide
acacatcacttcttgtggtaacaaccttattgtat

SEQ ID NO: 184475 - DNA, 35 bp, Artificial Sequence
  Synthetic oligonucleotide
tagccgtccaggattttttgtccggtccatcacct

SEQ ID NO: 184476 - DNA, 35 bp, Artificial Sequence
  Synthetic oligonucleotide
atcaccgaccgccgcctattttgataaatgtccct

SEQ ID NO: 184477 - DNA, 35 bp, Artificial Sequence
  Synthetic oligonucleotide
tccatttgcgcgggaggacctgttgcccctctcct

SEQ ID NO: 184478 - DNA, 35 bp, Artificial Sequence
  Synthetic oligonucleotide
tagcccaccctggattagtgcctctcttcgttcct

SEQ ID NO: 184479 - DNA, 35 bp, Artificial Sequence
  Synthetic oligonucleotide
taccaaccgctgtaagctccgactcaaccatcgct

SEQ ID NO: 184480 - DNA, 35 bp, Artificial Sequence
  Synthetic oligonucleotide
gcatgtcaatgtcaccacctaaaccgccccatgct

SEQ ID NO: 184481 - DNA, 35 bp, Artificial Sequence
  Synthetic oligonucleotide
gtccaccccgacgctttttttccgtaaagccatct

SEQ ID NO: 184482 - DNA, 35 bp, Artificial Sequence
  Synthetic oligonucleotide
tcaccctctgattggttctcttctcgtacaacagt

SEQ ID NO: 184483 - DNA, 35 bp, Artificial Sequence
  Synthetic oligonucleotide
acccacgtgagttccgcatccccgctatttcgcgt

SEQ ID NO: 184484 - DNA, 35 bp, Artificial Sequence
  Synthetic oligonucleotide
tatcagcgccctccccacgttatggctttcttcgt

SEQ ID NO: 184485 - DNA, 35 bp, Artificial Sequence
  Synthetic oligonucleotide
tccctgtggccccagttgcaaatctctcccgtggt

SEQ ID NO: 184486 - DNA, 35 bp, Artificial Sequence
  Synthetic oligonucleotide
taggaggaggaggggtctcatatggagggcggatt

SEQ ID NO: 184487 - DNA, 35 bp, Artificial Sequence
  Synthetic oligonucleotide
ttgtccccgctgtttaacgtcactagcgcactatt

SEQ ID NO: 184488 - DNA, 35 bp, Artificial Sequence
  Synthetic oligonucleotide
agcccattcttcgctctgcttaattgcatatactt

SEQ ID NO: 184489 - DNA, 35 bp, Artificial Sequence
  Synthetic oligonucleotide
tccagcggatgcccgcctcacgtcacttcattctt

SEQ ID NO: 184490 - DNA, 35 bp, Artificial Sequence
  Synthetic oligonucleotide
tcccacgcgccctagatttccccgtgcacatcgtt

SEQ ID NO: 184491 - DNA, 35 bp, Artificial Sequence
  Synthetic oligonucleotide
accacgcacatcgctgcccgcatgcctacgccttt

SEQ ID NO: 184492 - DNA, 35 bp, Artificial Sequence
  Synthetic oligonucleotide
gtcaaatcacgtctcgccgccttcccaccaagttt

SEQ ID NO: 184493 - DNA, 36 bp, Artificial Sequence
  Synthetic oligonucleotide
gaacaacggagggcagggaaaaaggcggagtaaaaa

SEQ ID NO: 184494 - DNA, 35 bp, Artificial Sequence
  Synthetic oligonucleotide
tcaagcgagtcccgtcccgccgcttcttcgaacaa

SEQ ID NO: 184495 - DNA, 36 bp, Artificial Sequence
  Synthetic oligonucleotide
acgatcccccgtgcgtcccatcattcgttaacacaa

SEQ ID NO: 184496 - DNA, 35 bp, Artificial Sequence
  Synthetic oligonucleotide
gcacgtgcagatcctttccctggtcaattctccaa

SEQ ID NO: 184497 - DNA, 35 bp, Artificial Sequence
  Synthetic oligonucleotide
atccgctcgacggaaggttggggggaggggggcaa

SEQ ID NO: 184498 - DNA, 36 bp, Artificial Sequence
  Synthetic oligonucleotide
gcgcacgtcgctgcttgttacctttctgtcctgcaa

SEQ ID NO: 184499 - DNA, 36 bp, Artificial Sequence
  Synthetic oligonucleotide
gacaaagactgggtggggatttagggcagggttcaa

SEQ ID NO: 184500 - DNA, 36 bp, Artificial Sequence
  Synthetic oligonucleotide
gaacaggaggggtaggtcagggaatgcacgcaagaa

SEQ ID NO: 184501 - DNA, 36 bp, Artificial Sequence
  Synthetic oligonucleotide
atgccccaaccccgcgcgtttcttcagtgtcctgaa

SEQ ID NO: 184502 - DNA, 35 bp, Artificial Sequence
  Synthetic oligonucleotide
acatcacttccctcgccacagcaggccttgctgaa

SEQ ID NO: 184503 - DNA, 36 bp, Artificial Sequence
  Synthetic oligonucleotide
gaccgctccccaccgctgtcacttgcccgcttataa

SEQ ID NO: 184504 - DNA, 35 bp, Artificial Sequence
  Synthetic oligonucleotide
tcccgccccaacctattgttttactgcccacctaa

SEQ ID NO: 184505 - DNA, 35 bp, Artificial Sequence
  Synthetic oligonucleotide
gccatccctaatgtccgttaagtcctttcacacca

SEQ ID NO: 184506 - DNA, 35 bp, Artificial Sequence
  Synthetic oligonucleotide
tctgatcctggttctgtcgttcaatccctccacca

SEQ ID NO: 184507 - DNA, 36 bp, Artificial Sequence
  Synthetic oligonucleotide
acgcctggtcgccgcctcctccggatctagttacca

SEQ ID NO: 184508 - DNA, 36 bp, Artificial Sequence
  Synthetic oligonucleotide
tgatgccaattggcctatagtatccggttcccccca

SEQ ID NO: 184509 - DNA, 35 bp, Artificial Sequence
  Synthetic oligonucleotide
accagccacacatgcatggtggcacccgctcccca

SEQ ID NO: 184510 - DNA, 35 bp, Artificial Sequence
  Synthetic oligonucleotide
tatcaactcccgccaggatcccaatgtctcgccca

SEQ ID NO: 184511 - DNA, 35 bp, Artificial Sequence
  Synthetic oligonucleotide
tctaccaccgacattaacctgcatgaacttgccca

SEQ ID NO: 184512 - DNA, 35 bp, Artificial Sequence
  Synthetic oligonucleotide
gcatcccataactcccaccagacctggctctccca

SEQ ID NO: 184513 - DNA, 36 bp, Artificial Sequence
  Synthetic oligonucleotide
ttcgcacgccgttcgtctttacctggaatctagcca

SEQ ID NO: 184514 - DNA, 35 bp, Artificial Sequence
  Synthetic oligonucleotide
atgtacccatacagcgccccccgtcgatcctgcca

SEQ ID NO: 184515 - DNA, 35 bp, Artificial Sequence
  Synthetic oligonucleotide
taccgttgctgccctcgcatttcattacgactcca

SEQ ID NO: 184516 - DNA, 36 bp, Artificial Sequence
  Synthetic oligonucleotide
gtactagcggcaatcacactatcgttaacacctcca

SEQ ID NO: 184517 - DNA, 36 bp, Artificial Sequence
  Synthetic oligonucleotide
taggccgcatgcagccacgcgctatcaaactctcca

SEQ ID NO: 184518 - DNA, 36 bp, Artificial Sequence
  Synthetic oligonucleotide
gtcctcccatcgtgtgacatgatgtgcctccgtcca

SEQ ID NO: 184519 - DNA, 36 bp, Artificial Sequence
  Synthetic oligonucleotide
accacgccattgctgcattcagccctacacggtcca

SEQ ID NO: 184520 - DNA, 36 bp, Artificial Sequence
  Synthetic oligonucleotide
gtatggtgcgggcgggtagggtaacatcggaaagca

SEQ ID NO: 184521 - DNA, 35 bp, Artificial Sequence
  Synthetic oligonucleotide
aaatagaggacgggatcgttgggaaagggggggca

SEQ ID NO: 184522 - DNA, 36 bp, Artificial Sequence
  Synthetic oligonucleotide
ttgtaagcacccgccgtgctcctgttaatcacatca

SEQ ID NO: 184523 - DNA, 36 bp, Artificial Sequence
  Synthetic oligonucleotide
tctgtctgcgcaattgagctactccctctgccatca

SEQ ID NO: 184524 - DNA, 35 bp, Artificial Sequence
  Synthetic oligonucleotide
gtgggggtgggcgggtgtagtctttcggggactca

SEQ ID NO: 184525 - DNA, 36 bp, Artificial Sequence
  Synthetic oligonucleotide
atctgctgcagccgtaacgtactatttgtcacctca

SEQ ID NO: 184526 - DNA, 36 bp, Artificial Sequence
  Synthetic oligonucleotide
acatcgcttccagatagcttacacacctgcccctca

SEQ ID NO: 184527 - DNA, 35 bp, Artificial Sequence
  Synthetic oligonucleotide
tcctgacgagcagactaacgtactttccaccttca

SEQ ID NO: 184528 - DNA, 37 bp, Artificial Sequence
  Synthetic oligonucleotide
gatgtagggcgaacgaaggggagggcgcactggaaga

SEQ ID NO: 184529 - DNA, 37 bp, Artificial Sequence
  Synthetic oligonucleotide
gacgcctcactctttgactccccacagtactcacaga

SEQ ID NO: 184530 - DNA, 37 bp, Artificial Sequence
  Synthetic oligonucleotide
gtcgtgggggagcggagcagacgaggggggaggcaga

SEQ ID NO: 184531 - DNA, 37 bp, Artificial Sequence
  Synthetic oligonucleotide
atgcgggggggaacgggcattggacttctaaaggaga

SEQ ID NO: 184532 - DNA, 37 bp, Artificial Sequence
  Synthetic oligonucleotide
agtgctcgatgggcgagagggaacgaagggcgggaga

SEQ ID NO: 184533 - DNA, 37 bp, Artificial Sequence
  Synthetic oligonucleotide
gttgagccagttggtaaggggctggggtgaggggaga

SEQ ID NO: 184534 - DNA, 36 bp, Artificial Sequence
  Synthetic oligonucleotide
gatcaccctcgcattattacacccggttacctacga

SEQ ID NO: 184535 - DNA, 35 bp, Artificial Sequence
  Synthetic oligonucleotide
gcaactgccccaactggcgcctccccttcaaccga

SEQ ID NO: 184536 - DNA, 37 bp, Artificial Sequence
  Synthetic oligonucleotide
tgccacctcacaaggtcctcccgcctcttctcgccga

SEQ ID NO: 184537 - DNA, 37 bp, Artificial Sequence
  Synthetic oligonucleotide
aatcacaccgctcctggccccagaaatagttctccga

SEQ ID NO: 184538 - DNA, 37 bp, Artificial Sequence
  Synthetic oligonucleotide
accacctgtaggctgtatttctttcgtacttttccga

SEQ ID NO: 184539 - DNA, 37 bp, Artificial Sequence
  Synthetic oligonucleotide
taaggaggggatcggaggagaataaagtaggcatcga

SEQ ID NO: 184540 - DNA, 36 bp, Artificial Sequence
  Synthetic oligonucleotide
tagagcccctgtgtctcctgcccgatataccctcga

SEQ ID NO: 184541 - DNA, 37 bp, Artificial Sequence
  Synthetic oligonucleotide
agcgatagcagcatccccttacgatccaccgcctcga

SEQ ID NO: 184542 - DNA, 37 bp, Artificial Sequence
  Synthetic oligonucleotide
aagaggtggtgggttgcggaggacaagtggcggtcga

SEQ ID NO: 184543 - DNA, 37 bp, Artificial Sequence
  Synthetic oligonucleotide
gtcacctcagcccccctcaccccggctcctaggagga

SEQ ID NO: 184544 - DNA, 37 bp, Artificial Sequence
  Synthetic oligonucleotide
gcgcacaccatcgggatctctgttacttctctccgga

SEQ ID NO: 184545 - DNA, 35 bp, Artificial Sequence
  Synthetic oligonucleotide
gtcaactccgctctacctcctatctgcacacggga

SEQ ID NO: 184546 - DNA, 37 bp, Artificial Sequence
  Synthetic oligonucleotide
gaccgattgggaagggtgggagaccagttggacggga

SEQ ID NO: 184547 - DNA, 37 bp, Artificial Sequence
  Synthetic oligonucleotide
attccgccctccacctatcgtccgtccagctacggga

SEQ ID NO: 184548 - DNA, 37 bp, Artificial Sequence
  Synthetic oligonucleotide
ggggcattaactgggaggggaaaaaggttcccgggga

SEQ ID NO: 184549 - DNA, 37 bp, Artificial Sequence
  Synthetic oligonucleotide
gggtaaggggcatgggactgaggtggctggaggggga

SEQ ID NO: 184550 - DNA, 37 bp, Artificial Sequence
  Synthetic oligonucleotide
tcacaggggctaggtgtctatgtgggtgggcggggga

SEQ ID NO: 184551 - DNA, 36 bp, Artificial Sequence
  Synthetic oligonucleotide
aacgcaggtggggagggcaggcgggtctaatgggga

SEQ ID NO: 184552 - DNA, 37 bp, Artificial Sequence
  Synthetic oligonucleotide
aagcacccaagtggaagggcggaggagggtactggga

SEQ ID NO: 184553 - DNA, 37 bp, Artificial Sequence
  Synthetic oligonucleotide
tcgcggttccgcaatgcacctactacacacccctgga

SEQ ID NO: 184554 - DNA, 35 bp, Artificial Sequence
  Synthetic oligonucleotide
acagcggcaccttgttcaccgccccctcgtttgga

SEQ ID NO: 184555 - DNA, 37 bp, Artificial Sequence
  Synthetic oligonucleotide
acaccctccgtgtactatcagtgctctccgcctatga

SEQ ID NO: 184556 - DNA, 37 bp, Artificial Sequence
  Synthetic oligonucleotide
tcagcgcaccgttttacactggctcccgttccactga

SEQ ID NO: 184557 - DNA, 38 bp, Artificial Sequence
  Synthetic oligonucleotide
acacgctcccttcctgcattcaatggctagtcccctga

SEQ ID NO: 184558 - DNA, 38 bp, Artificial Sequence
  Synthetic oligonucleotide
gagccacgtactgcccgcacccccctatctagcgctga

SEQ ID NO: 184559 - DNA, 37 bp, Artificial Sequence
  Synthetic oligonucleotide
atgacccctcttgcctaggaacctcagactctgctga

SEQ ID NO: 184560 - DNA, 37 bp, Artificial Sequence
  Synthetic oligonucleotide
tccgtcgccgctagctgagctactacgtaccatctga

SEQ ID NO: 184561 - DNA, 38 bp, Artificial Sequence
  Synthetic oligonucleotide
gttaccagctcccgacggcccgccccctacctctctga

SEQ ID NO: 184562 - DNA, 37 bp, Artificial Sequence
  Synthetic oligonucleotide
gttgccccgcagcgtagtacaccttagcccaccgtga

SEQ ID NO: 184563 - DNA, 38 bp, Artificial Sequence
  Synthetic oligonucleotide
ggagaaggggtaaggctgttgaggtggcggggcggtga

SEQ ID NO: 184564 - DNA, 38 bp, Artificial Sequence
  Synthetic oligonucleotide
gcaagcctctcgccctacctgcccgtcccttaccttga

SEQ ID NO: 184565 - DNA, 38 bp, Artificial Sequence
  Synthetic oligonucleotide
gacgcacatcgcttttgcgttacacactcctctcttga

SEQ ID NO: 184566 - DNA, 37 bp, Artificial Sequence
  Synthetic oligonucleotide
gtgcgcactgtttctacctcccgcatgctgttcttga

SEQ ID NO: 184567 - DNA, 36 bp, Artificial Sequence
  Synthetic oligonucleotide
tgtgtccgctcgcgaaaagcacctcctcccctttga

SEQ ID NO: 184568 - DNA, 37 bp, Artificial Sequence
  Synthetic oligonucleotide
tcgcgatcagatatctactcgctccagccctctttga

SEQ ID NO: 184569 - DNA, 38 bp, Artificial Sequence
  Synthetic oligonucleotide
atcgccggcaacactagccttacgccactcctctttga

SEQ ID NO: 184570 - DNA, 35 bp, Artificial Sequence
  Synthetic oligonucleotide
tcacctacatctcgttgacatcctctgctgacata

SEQ ID NO: 184571 - DNA, 36 bp, Artificial Sequence
  Synthetic oligonucleotide
ttcgcaccgcacttagtacatacactctctctacta

SEQ ID NO: 184572 - DNA, 36 bp, Artificial Sequence
  Synthetic oligonucleotide
gtggccccagtagtgtttctcgctccccaaccgcta

SEQ ID NO: 184573 - DNA, 35 bp, Artificial Sequence
  Synthetic oligonucleotide
tgagggacgacgacgagggtgggggagggatgcta

SEQ ID NO: 184574 - DNA, 36 bp, Artificial Sequence
  Synthetic oligonucleotide
ggaccccgtgagcctatgagccttccctaccctcta

SEQ ID NO: 184575 - DNA, 36 bp, Artificial Sequence
  Synthetic oligonucleotide
attcccaccacctccagtgtgactttccatagtcta

SEQ ID NO: 184576 - DNA, 35 bp, Artificial Sequence
  Synthetic oligonucleotide
tacagcgctgaactctgcttaccttctccggtcta

SEQ ID NO: 184577 - DNA, 36 bp, Artificial Sequence
  Synthetic oligonucleotide
accaggtggtgggggggcgggttatgggcctaagta

SEQ ID NO: 184578 - DNA, 36 bp, Artificial Sequence
  Synthetic oligonucleotide
acttatgccgccctcctctatgattggccccttgta

SEQ ID NO: 184579 - DNA, 36 bp, Artificial Sequence
  Synthetic oligonucleotide
atcacctccccgttcaataattcgccaggattatta

SEQ ID NO: 184580 - DNA, 35 bp, Artificial Sequence
  Synthetic oligonucleotide
gtcccactctgcccacgttttcggtcaaactctta

SEQ ID NO: 184581 - DNA, 36 bp, Artificial Sequence
  Synthetic oligonucleotide
actacccatctcggtgggatattggttctcctctta

SEQ ID NO: 184582 - DNA, 35 bp, Artificial Sequence
  Synthetic oligonucleotide
gtctctctcacgccccagatctttagccccagtta

SEQ ID NO: 184583 - DNA, 36 bp, Artificial Sequence
  Synthetic oligonucleotide
atgcagccattcggagatagggggcgggggaggtta

SEQ ID NO: 184584 - DNA, 36 bp, Artificial Sequence
  Synthetic oligonucleotide
gtttgacccgagcactatgcctattgcacccgttta

SEQ ID NO: 184585 - DNA, 35 bp, Artificial Sequence
  Synthetic oligonucleotide
tcgtccctcactaggccccctgtgctcatatccac

SEQ ID NO: 184586 - DNA, 34 bp, Artificial Sequence
  Synthetic oligonucleotide
ccacgacgcacagctagttgcaacccatttccac

SEQ ID NO: 184587 - DNA, 35 bp, Artificial Sequence
  Synthetic oligonucleotide
acacgtcctccactgttatactcatctctcccgac

SEQ ID NO: 184588 - DNA, 35 bp, Artificial Sequence
  Synthetic oligonucleotide
gatcaccaggcctcctccacggtatcatctgtgac

SEQ ID NO: 184589 - DNA, 35 bp, Artificial Sequence
  Synthetic oligonucleotide
aagcctgtaccacccgccttccgagacgtatatac

SEQ ID NO: 184590 - DNA, 35 bp, Artificial Sequence
  Synthetic oligonucleotide
taagcctcccatgtttatgcttcaccgccctatac

SEQ ID NO: 184591 - DNA, 35 bp, Artificial Sequence
  Synthetic oligonucleotide
gccgtccgcaacgcagaccaataaccacgccctac

SEQ ID NO: 184592 - DNA, 35 bp, Artificial Sequence
  Synthetic oligonucleotide
tgtcgtcgcatctaatcggccggccttcctgaacc

SEQ ID NO: 184593 - DNA, 35 bp, Artificial Sequence
  Synthetic oligonucleotide
tccagcccctgcctgagagcaccctagcccccacc

SEQ ID NO: 184594 - DNA, 35 bp, Artificial Sequence
  Synthetic oligonucleotide
atcatccgatgttcgctattccgcttagttccacc

SEQ ID NO: 184595 - DNA, 35 bp, Artificial Sequence
  Synthetic oligonucleotide
ttcgtaccatctgccggatatcttcatttggaccc

SEQ ID NO: 184596 - DNA, 35 bp, Artificial Sequence
  Synthetic oligonucleotide
ttcgtgtcacagtcgagcaccgctgtatcgccccc

SEQ ID NO: 184597 - DNA, 35 bp, Artificial Sequence
  Synthetic oligonucleotide
acccgccctcgcacccacattttactacgtgcccc

SEQ ID NO: 184598 - DNA, 35 bp, Artificial Sequence
  Synthetic oligonucleotide
taaggtgtgtcatcatgttctctccggcgctcccc

SEQ ID NO: 184599 - DNA, 35 bp, Artificial Sequence
  Synthetic oligonucleotide
tgcatgaacccccctctcttagcctagcggtcccc

SEQ ID NO: 184600 - DNA, 35 bp, Artificial Sequence
  Synthetic oligonucleotide
gtcacccctcccctttgtctgaatagattgtcccc

SEQ ID NO: 184601 - DNA, 35 bp, Artificial Sequence
  Synthetic oligonucleotide
ggggggggggggggcacacacgggggttatcgccc

SEQ ID NO: 184602 - DNA, 35 bp, Artificial Sequence
  Synthetic oligonucleotide
gccaaacgcgctcccgaccacttcacttaaggccc

SEQ ID NO: 184603 - DNA, 35 bp, Artificial Sequence
  Synthetic oligonucleotide
tgccggggaagcagggctaaagggagggaatgccc

SEQ ID NO: 184604 - DNA, 35 bp, Artificial Sequence
  Synthetic oligonucleotide
gagcgacccgccaccttgattccccgtgcatagcc

SEQ ID NO: 184605 - DNA, 35 bp, Artificial Sequence
  Synthetic oligonucleotide
tcatattccatcaagcagcctcgcattccttggcc

SEQ ID NO: 184606 - DNA, 35 bp, Artificial Sequence
  Synthetic oligonucleotide
tgtaaacatccgctgacgctaactcctcgtactcc

SEQ ID NO: 184607 - DNA, 35 bp, Artificial Sequence
  Synthetic oligonucleotide
gagacatcacctcgtggtcaaaacaataccgctcc

SEQ ID NO: 184608 - DNA, 35 bp, Artificial Sequence
  Synthetic oligonucleotide
ccgtcctggccacacacgttcctatcattcgctcc

SEQ ID NO: 184609 - DNA, 35 bp, Artificial Sequence
  Synthetic oligonucleotide
gtgcaggaacctgcccatcgatgccctgcccgtcc

SEQ ID NO: 184610 - DNA, 35 bp, Artificial Sequence
  Synthetic oligonucleotide
tcaccctaggctgatgctacccaccatttttgtcc

SEQ ID NO: 184611 - DNA, 35 bp, Artificial Sequence
  Synthetic oligonucleotide
tcctaccatgcccctcgtgagtcgtttggccttcc

SEQ ID NO: 184612 - DNA, 35 bp, Artificial Sequence
  Synthetic oligonucleotide
tcgaccggaatgtgctccgctcctgctccatcagc

SEQ ID NO: 184613 - DNA, 35 bp, Artificial Sequence
  Synthetic oligonucleotide
accacccgattcaatcccccgtgggttaacaccgc

SEQ ID NO: 184614 - DNA, 35 bp, Artificial Sequence
  Synthetic oligonucleotide
gcgcccctcttcagcccctgcctcctaatcattgc

SEQ ID NO: 184615 - DNA, 35 bp, Artificial Sequence
  Synthetic oligonucleotide
ttgggacacagctggtcgggagggttgggagttgc

SEQ ID NO: 184616 - DNA, 35 bp, Artificial Sequence
  Synthetic oligonucleotide
ttgttctggcccctggtgtccaccgctcccacatc

SEQ ID NO: 184617 - DNA, 29 bp, Artificial Sequence
  Synthetic oligonucleotide
gtgatcacccatccgcccggcctcttatc

SEQ ID NO: 184618 - DNA, 35 bp, Artificial Sequence
  Synthetic oligonucleotide
gttctgcccgtagcctaagccctccgtcgcaactc

SEQ ID NO: 184619 - DNA, 35 bp, Artificial Sequence
  Synthetic oligonucleotide
gtccactcgcaaccgcctaggactagaaccccctc

SEQ ID NO: 184620 - DNA, 35 bp, Artificial Sequence
  Synthetic oligonucleotide
tcatccttgtgcgcccacatcttacgtgactcctc

SEQ ID NO: 184621 - DNA, 35 bp, Artificial Sequence
  Synthetic oligonucleotide
gagaaagggagaggcggggatcggagataggggtc

SEQ ID NO: 184622 - DNA, 35 bp, Artificial Sequence
  Synthetic oligonucleotide
ggtggatcgaatgcttgttgctgcctgtccctgtc

SEQ ID NO: 184623 - DNA, 35 bp, Artificial Sequence
  Synthetic oligonucleotide
tagccatccatctgcctactatcgtacctcctgtc

SEQ ID NO: 184624 - DNA, 35 bp, Artificial Sequence
  Synthetic oligonucleotide
gtcgcaacataatctgtcccagccacaacccattc

SEQ ID NO: 184625 - DNA, 35 bp, Artificial Sequence
  Synthetic oligonucleotide
tcgtaaccccctggtgatggacctgctctttgttc

SEQ ID NO: 184626 - DNA, 35 bp, Artificial Sequence
  Synthetic oligonucleotide
gacggagcctcacatcatgcctctcacgccatttc

SEQ ID NO: 184627 - DNA, 35 bp, Artificial Sequence
  Synthetic oligonucleotide
gatggggggataagggagatggacttagcgggaag

SEQ ID NO: 184628 - DNA, 35 bp, Artificial Sequence
  Synthetic oligonucleotide
gcctggagcaacaaggggggatatgcaggatggag

SEQ ID NO: 184629 - DNA, 35 bp, Artificial Sequence
  Synthetic oligonucleotide
gtggctatgggcgcaggcacgggggagggggaacg

SEQ ID NO: 184630 - DNA, 35 bp, Artificial Sequence
  Synthetic oligonucleotide
acctcatctgacttgtccctgaaggctcacctccg

SEQ ID NO: 184631 - DNA, 35 bp, Artificial Sequence
  Synthetic oligonucleotide
acgacccagtgcacagtgcatcattcactcttccg

SEQ ID NO: 184632 - DNA, 35 bp, Artificial Sequence
  Synthetic oligonucleotide
gggtggcgggggggttttgcggatgtcacatcgcg

SEQ ID NO: 184633 - DNA, 35 bp, Artificial Sequence
  Synthetic oligonucleotide
gtcgaggaggtgtcggggaacaagtatagggggcg

SEQ ID NO: 184634 - DNA, 35 bp, Artificial Sequence
  Synthetic oligonucleotide
agctgaccttttctgtttctcgctgcctgccatcg

SEQ ID NO: 184635 - DNA, 35 bp, Artificial Sequence
  Synthetic oligonucleotide
gacataggcgggtcggggcttacggggggaggtcg

SEQ ID NO: 184636 - DNA, 35 bp, Artificial Sequence
  Synthetic oligonucleotide
agggccaaggggggctgggggcagggagaaggagg

SEQ ID NO: 184637 - DNA, 35 bp, Artificial Sequence
  Synthetic oligonucleotide
gcacggggtggagagggcaacgacgactcgaaggg

SEQ ID NO: 184638 - DNA, 35 bp, Artificial Sequence
  Synthetic oligonucleotide
agtgatgggggaagcaaaaggacggggggcttggg

SEQ ID NO: 184639 - DNA, 35 bp, Artificial Sequence
  Synthetic oligonucleotide
ggtacggagtagggggaagtaggaagaggagctgg

SEQ ID NO: 184640 - DNA, 35 bp, Artificial Sequence
  Synthetic oligonucleotide
tgtacgagacgaagggggtagacagatggagtatg

SEQ ID NO: 184641 - DNA, 35 bp, Artificial Sequence
  Synthetic oligonucleotide
gaagaatgggagggcggctgaggggtgttgtagtg

SEQ ID NO: 184642 - DNA, 35 bp, Artificial Sequence
  Synthetic oligonucleotide
tttctccccccagccgtactctccatgcaacattg

SEQ ID NO: 184643 - DNA, 35 bp, Artificial Sequence
  Synthetic oligonucleotide
accgtcgtacggcctgttctcgtattcctccattg

SEQ ID NO: 184644 - DNA, 35 bp, Artificial Sequence
  Synthetic oligonucleotide
gcatgccctgcttgcgatcgatcacttccctattg

SEQ ID NO: 184645 - DNA, 35 bp, Artificial Sequence
  Synthetic oligonucleotide
gccatcaccccggcccacataaccacccacatttg

SEQ ID NO: 184646 - DNA, 35 bp, Artificial Sequence
  Synthetic oligonucleotide
tctgccgttcggaccccgtaacatccgcctccaat

SEQ ID NO: 184647 - DNA, 35 bp, Artificial Sequence
  Synthetic oligonucleotide
atgctaagggtgaggtcagggggcgtagggtggat

SEQ ID NO: 184648 - DNA, 35 bp, Artificial Sequence
  Synthetic oligonucleotide
aacacgagctcccgattttcatgcgcctaccctat

SEQ ID NO: 184649 - DNA, 35 bp, Artificial Sequence
  Synthetic oligonucleotide
caatttgaccctccgcatcggctggttactcccct

SEQ ID NO: 184650 - DNA, 34 bp, Artificial Sequence
  Synthetic oligonucleotide
accgcccccatgcctctttcctgcctaaagccct

SEQ ID NO: 184651 - DNA, 35 bp, Artificial Sequence
  Synthetic oligonucleotide
tatgtcccgcccttgagctagttttatttagccct

SEQ ID NO: 184652 - DNA, 35 bp, Artificial Sequence
  Synthetic oligonucleotide
gcaacaatggtcctgaatccgttctgctgttccct

SEQ ID NO: 184653 - DNA, 35 bp, Artificial Sequence
  Synthetic oligonucleotide
tccaccgcggaacgcactctgcctgcctcgcgcct

SEQ ID NO: 184654 - DNA, 34 bp, Artificial Sequence
  Synthetic oligonucleotide
acaccctcgaccccaccttgctaccggcctagct

SEQ ID NO: 184655 - DNA, 35 bp, Artificial Sequence
  Synthetic oligonucleotide
aaccgtctcccccgaatatctccacgccgtccgct

SEQ ID NO: 184656 - DNA, 35 bp, Artificial Sequence
  Synthetic oligonucleotide
ttcgccgtcctcagcgttcgtcacttggtggctct

SEQ ID NO: 184657 - DNA, 35 bp, Artificial Sequence
  Synthetic oligonucleotide
acgactacgtgcccactcgtcccttgttatccagt

SEQ ID NO: 184658 - DNA, 35 bp, Artificial Sequence
  Synthetic oligonucleotide
gtcacgcctactgttctaccgtccctggttgccgt

SEQ ID NO: 184659 - DNA, 35 bp, Artificial Sequence
  Synthetic oligonucleotide
gacgctgtcaaccctagtttagtcctgttttccgt

SEQ ID NO: 184660 - DNA, 35 bp, Artificial Sequence
  Synthetic oligonucleotide
taagcaatcaggagggagtgaggggcagtgggcgt

SEQ ID NO: 184661 - DNA, 35 bp, Artificial Sequence
  Synthetic oligonucleotide
gtcacaccgcaccgttaactatctgcccctccggt

SEQ ID NO: 184662 - DNA, 35 bp, Artificial Sequence
  Synthetic oligonucleotide
gaagtcgcgtgcgcatgcctataccccgccattgt

SEQ ID NO: 184663 - DNA, 35 bp, Artificial Sequence
  Synthetic oligonucleotide
tgaccccacccctcgttatttgattacgtctactt

SEQ ID NO: 184664 - DNA, 35 bp, Artificial Sequence
  Synthetic oligonucleotide
gtgcatggccggcatcccttgtcctcaccaccctt

SEQ ID NO: 184665 - DNA, 35 bp, Artificial Sequence
  Synthetic oligonucleotide
gttaccaccgtccttagcatctccacaggcgcctt

SEQ ID NO: 184666 - DNA, 36 bp, Artificial Sequence
  Synthetic oligonucleotide
aactccacgccctgagttccgcctacttacatcgtt

SEQ ID NO: 184667 - DNA, 35 bp, Artificial Sequence
  Synthetic oligonucleotide
tatagctgccagtcggccctcctcgttctcctgtt

SEQ ID NO: 184668 - DNA, 35 bp, Artificial Sequence
  Synthetic oligonucleotide
acaccatccacccttacacactgcaggtactccaa

SEQ ID NO: 184669 - DNA, 36 bp, Artificial Sequence
  Synthetic oligonucleotide
gaccttcccgcctctcgaactgtatctccgtcgcaa

SEQ ID NO: 184670 - DNA, 35 bp, Artificial Sequence
  Synthetic oligonucleotide
ttccgacaccgcccttagttctgtttttttatcaa

SEQ ID NO: 184671 - DNA, 36 bp, Artificial Sequence
  Synthetic oligonucleotide
ttccaccacccctcacgttaaagagttaacgtcgaa

SEQ ID NO: 184672 - DNA, 36 bp, Artificial Sequence
  Synthetic oligonucleotide
ggtggggagggtggtgcgggtgtttcggaggttgaa

SEQ ID NO: 184673 - DNA, 35 bp, Artificial Sequence
  Synthetic oligonucleotide
gttacaacccccccatgcgcacaatactcacgtaa

SEQ ID NO: 184674 - DNA, 36 bp, Artificial Sequence
  Synthetic oligonucleotide
acctcatccgacctgtgcccttcgtacctctgttaa

SEQ ID NO: 184675 - DNA, 36 bp, Artificial Sequence
  Synthetic oligonucleotide
tgatgatacccttcctgccttcgtgacgtggccaca

SEQ ID NO: 184676 - DNA, 35 bp, Artificial Sequence
  Synthetic oligonucleotide
gaccccaaccccggttgtgtttcccgatctcccca

SEQ ID NO: 184677 - DNA, 36 bp, Artificial Sequence
  Synthetic oligonucleotide
ttgcccctctgaaatgccgaaccgccgtagtgccca

SEQ ID NO: 184678 - DNA, 35 bp, Artificial Sequence
  Synthetic oligonucleotide
gtcgccttagtacattcctaccgtgcctgatccca

SEQ ID NO: 184679 - DNA, 35 bp, Artificial Sequence
  Synthetic oligonucleotide
gtgtcgcagatctgtaatattcgcttcccgtccca

SEQ ID NO: 184680 - DNA, 36 bp, Artificial Sequence
  Synthetic oligonucleotide
gccccaccgattgccacttgggcgtttctgacgcca

SEQ ID NO: 184681 - DNA, 35 bp, Artificial Sequence
  Synthetic oligonucleotide
tgggcctccctcagacgtctatcgtttcttttcca

SEQ ID NO: 184682 - DNA, 36 bp, Artificial Sequence
  Synthetic oligonucleotide
ttggtctcgcacagggcgggacgggaggggtacgca

SEQ ID NO: 184683 - DNA, 36 bp, Artificial Sequence
  Synthetic oligonucleotide
gtgcgccctcgtttcatgcctacgcgcgtcttcgca

SEQ ID NO: 184684 - DNA, 36 bp, Artificial Sequence
  Synthetic oligonucleotide
ttcaccctccgaacccgtacgtagttttacctatca

SEQ ID NO: 184685 - DNA, 35 bp, Artificial Sequence
  Synthetic oligonucleotide
tcaactccttcccgtcgccgccccccgccgtatca

SEQ ID NO: 184686 - DNA, 36 bp, Artificial Sequence
  Synthetic oligonucleotide
gccccacctttgtttccgtgcgatatcagccactca

SEQ ID NO: 184687 - DNA, 36 bp, Artificial Sequence
  Synthetic oligonucleotide
tcgaccctacaatgtaacggctttccctctcactca

SEQ ID NO: 184688 - DNA, 35 bp, Artificial Sequence
  Synthetic oligonucleotide
tttccgtacccccgcttatgaaccaccttgcttca

SEQ ID NO: 184689 - DNA, 37 bp, Artificial Sequence
  Synthetic oligonucleotide
gactgggcgggttcgggagggttgcctgaatccaaga

SEQ ID NO: 184690 - DNA, 37 bp, Artificial Sequence
  Synthetic oligonucleotide
tcagggggcctggacaaagggggaaaaacgtggaaga

SEQ ID NO: 184691 - DNA, 36 bp, Artificial Sequence
  Synthetic oligonucleotide
gtgacgtacacatgtctttcaacctatcaccccaga

SEQ ID NO: 184692 - DNA, 37 bp, Artificial Sequence
  Synthetic oligonucleotide
tactgcctccgcgtccatggttccttctcactccaga

SEQ ID NO: 184693 - DNA, 37 bp, Artificial Sequence
  Synthetic oligonucleotide
gccacgcgttcattttcgccctatcccatctctcaga

SEQ ID NO: 184694 - DNA, 36 bp, Artificial Sequence
  Synthetic oligonucleotide
atacgccaccctgccttgttctcccttcttctcaga

SEQ ID NO: 184695 - DNA, 37 bp, Artificial Sequence
  Synthetic oligonucleotide
tacatcggtggagggatgggacaagacgtgggaacga

SEQ ID NO: 184696 - DNA, 37 bp, Artificial Sequence
  Synthetic oligonucleotide
accgcgggccacactgcataccgcttccgtattacga

SEQ ID NO: 184697 - DNA, 37 bp, Artificial Sequence
  Synthetic oligonucleotide
gacgatcccagcccgctcctgtcaacaccatttacga

SEQ ID NO: 184698 - DNA, 36 bp, Artificial Sequence
  Synthetic oligonucleotide
acccatgcagccagtactaccttagccccaccccga

SEQ ID NO: 184699 - DNA, 36 bp, Artificial Sequence
  Synthetic oligonucleotide
agagcactagtcactggcctatcaccttactcccga

SEQ ID NO: 184700 - DNA, 36 bp, Artificial Sequence
  Synthetic oligonucleotide
tccccggcccgaattctcgagcgttttacctcccga

SEQ ID NO: 184701 - DNA, 36 bp, Artificial Sequence
  Synthetic oligonucleotide
accaacctgagtcacaatcgtcatcccttctcccga

SEQ ID NO: 184702 - DNA, 36 bp, Artificial Sequence
  Synthetic oligonucleotide
atgatcaccggccgccgtatcttatacctctatcga

SEQ ID NO: 184703 - DNA, 35 bp, Artificial Sequence
  Synthetic oligonucleotide
gcttgacctccgaacgtttttctctccagactcga

SEQ ID NO: 184704 - DNA, 37 bp, Artificial Sequence
  Synthetic oligonucleotide
gtgcgaagcttccgtagctttagtccctgcccctcga

SEQ ID NO: 184705 - DNA, 37 bp, Artificial Sequence
  Synthetic oligonucleotide
tggggccctcgtgctcccgttcctttccttgtctcga

SEQ ID NO: 184706 - DNA, 36 bp, Artificial Sequence
  Synthetic oligonucleotide
ttcccgccactgttaagctcgcccgccttgccagga

SEQ ID NO: 184707 - DNA, 37 bp, Artificial Sequence
  Synthetic oligonucleotide
ttgaggtaggggtctagggggaagcagaagcggagga

SEQ ID NO: 184708 - DNA, 36 bp, Artificial Sequence
  Synthetic oligonucleotide
ggggtagacagaagatgggaaacggagtagggagga

SEQ ID NO: 184709 - DNA, 37 bp, Artificial Sequence
  Synthetic oligonucleotide
tgttgtagaggagggtgcggaagggagcgtgaacgga

SEQ ID NO: 184710 - DNA, 36 bp, Artificial Sequence
  Synthetic oligonucleotide
gcgatcacacctcctctatatgcttcctctcgcgga

SEQ ID NO: 184711 - DNA, 36 bp, Artificial Sequence
  Synthetic oligonucleotide
aaggggagcacaggacggactaggggtggaggggga

SEQ ID NO: 184712 - DNA, 37 bp, Artificial Sequence
  Synthetic oligonucleotide
tgcggggtaggttaaagtggggggctgtcgtggggga

SEQ ID NO: 184713 - DNA, 37 bp, Artificial Sequence
  Synthetic oligonucleotide
ggggtgggtccacgtcacttcggggacgtcgtgggga

SEQ ID NO: 184714 - DNA, 37 bp, Artificial Sequence
  Synthetic oligonucleotide
gaacggatgggctcgaggggcttagaatggggctgga

SEQ ID NO: 184715 - DNA, 37 bp, Artificial Sequence
  Synthetic oligonucleotide
gccaccccatgcccttagccgtacacgtcttgactga

SEQ ID NO: 184716 - DNA, 38 bp, Artificial Sequence
  Synthetic oligonucleotide
tacctaacggctaggtgtgtttgctcgcctccccctga

SEQ ID NO: 184717 - DNA, 37 bp, Artificial Sequence
  Synthetic oligonucleotide
tagggtcggaggaggggggaaaatcaaagagagctga

SEQ ID NO: 184718 - DNA, 38 bp, Artificial Sequence
  Synthetic oligonucleotide
gtaacacccactgtggtccgctccatgcctcctgctga

SEQ ID NO: 184719 - DNA, 38 bp, Artificial Sequence
  Synthetic oligonucleotide
ggtcaaagggacacgaaaagggagggagaacacagtga

SEQ ID NO: 184720 - DNA, 37 bp, Artificial Sequence
  Synthetic oligonucleotide
tcccgcccccccatttaaccctggacacctagggtga

SEQ ID NO: 184721 - DNA, 36 bp, Artificial Sequence
  Synthetic oligonucleotide
taactctggagggtggaagggagggtggagcattga

SEQ ID NO: 184722 - DNA, 38 bp, Artificial Sequence
  Synthetic oligonucleotide
atacggaagctcagcctgccgcatccatcctcacttga

SEQ ID NO: 184723 - DNA, 38 bp, Artificial Sequence
  Synthetic oligonucleotide
accgccgcctgcctcttactcctttttgacggccttga

SEQ ID NO: 184724 - DNA, 37 bp, Artificial Sequence
  Synthetic oligonucleotide
atggcggatcgtcagcccctgctgccctctttgttga

SEQ ID NO: 184725 - DNA, 38 bp, Artificial Sequence
  Synthetic oligonucleotide
tagactgccgcacgttcgctacccgcttccacatttga

SEQ ID NO: 184726 - DNA, 38 bp, Artificial Sequence
  Synthetic oligonucleotide
acacacgtcagttcctattcgttccgtcttgcctttga

SEQ ID NO: 184727 - DNA, 38 bp, Artificial Sequence
  Synthetic oligonucleotide
gactaagccgccgggggtggaagggagggactctttga

SEQ ID NO: 184728 - DNA, 35 bp, Artificial Sequence
  Synthetic oligonucleotide
ttgtagcccgctccccctccgcgatgcgtcgcata

SEQ ID NO: 184729 - DNA, 35 bp, Artificial Sequence
  Synthetic oligonucleotide
gccgcacgcatccgctctctctatttctgacgata

SEQ ID NO: 184730 - DNA, 35 bp, Artificial Sequence
  Synthetic oligonucleotide
accgcaagccttccttcgcacggtcccttctacta

SEQ ID NO: 184731 - DNA, 35 bp, Artificial Sequence
  Synthetic oligonucleotide
accgatcgcgaacgccgctattgcccctgtcccta

SEQ ID NO: 184732 - DNA, 36 bp, Artificial Sequence
  Synthetic oligonucleotide
acactaacgtacggctccttgcatatttcccgccta

SEQ ID NO: 184733 - DNA, 36 bp, Artificial Sequence
  Synthetic oligonucleotide
tagtcgtatccgccactctggtttagttccgtccta

SEQ ID NO: 184734 - DNA, 26 bp, Artificial Sequence
  Synthetic oligonucleotide
accgtggcccttccggattcactcta

SEQ ID NO: 184735 - DNA, 36 bp, Artificial Sequence
  Synthetic oligonucleotide
tcctgcgcctccgtcccatgcgcctgtcccccagta

SEQ ID NO: 184736 - DNA, 35 bp, Artificial Sequence
  Synthetic oligonucleotide
gatcgcacgccccccactgttcaacgtctatagta

SEQ ID NO: 184737 - DNA, 36 bp, Artificial Sequence
  Synthetic oligonucleotide
ttcacgacaagtgcgctcgtgcctcttctgccatta

SEQ ID NO: 184738 - DNA, 35 bp, Artificial Sequence
  Synthetic oligonucleotide
gatcaacgtgcgtgactctgacctctcctccatta

SEQ ID NO: 184739 - DNA, 36 bp, Artificial Sequence
  Synthetic oligonucleotide
tgcgaccgctctagtccatcttgccacttcacctta

SEQ ID NO: 184740 - DNA, 35 bp, Artificial Sequence
  Synthetic oligonucleotide
gagagggtgggagggtaatcattgctccgggggac

SEQ ID NO: 184741 - DNA, 35 bp, Artificial Sequence
  Synthetic oligonucleotide
tccagggggccagatgcgctcatcccccgcactac

SEQ ID NO: 184742 - DNA, 35 bp, Artificial Sequence
  Synthetic oligonucleotide
tcacactccgcccatagaccgacaggtctttgtac

SEQ ID NO: 184743 - DNA, 35 bp, Artificial Sequence
  Synthetic oligonucleotide
tgccccgttagatcatatgtccccgtgctcgttac

SEQ ID NO: 184744 - DNA, 35 bp, Artificial Sequence
  Synthetic oligonucleotide
gtttgccaccgcgcttttgctgcctatgcattacc

SEQ ID NO: 184745 - DNA, 34 bp, Artificial Sequence
  Synthetic oligonucleotide
accgtccatcagatctagaacatagccccccccc

SEQ ID NO: 184746 - DNA, 35 bp, Artificial Sequence
  Synthetic oligonucleotide
gcccaggacacgaagcgtaaacatttaacccgccc

SEQ ID NO: 184747 - DNA, 35 bp, Artificial Sequence
  Synthetic oligonucleotide
gcgcacccgcaacggctccaatcttctccttcgcc

SEQ ID NO: 184748 - DNA, 35 bp, Artificial Sequence
  Synthetic oligonucleotide
gacccctcgcagacacaattctcattcgcctggcc

SEQ ID NO: 184749 - DNA, 35 bp, Artificial Sequence
  Synthetic oligonucleotide
taacgcgtgcattatgtcagctactggcgccctcc

SEQ ID NO: 184750 - DNA, 35 bp, Artificial Sequence
  Synthetic oligonucleotide
acgcactccctgctatcgttaatcaccgagtctcc

SEQ ID NO: 184751 - DNA, 35 bp, Artificial Sequence
  Synthetic oligonucleotide
gcgcatgcccggagccaaagcgcgaattcctgtcc

SEQ ID NO: 184752 - DNA, 35 bp, Artificial Sequence
  Synthetic oligonucleotide
ttcaccgacccccatgcacccaatagccacagagc

SEQ ID NO: 184753 - DNA, 35 bp, Artificial Sequence
  Synthetic oligonucleotide
gcaccgcttgcttcaaccgccactacaagttccgc

SEQ ID NO: 184754 - DNA, 35 bp, Artificial Sequence
  Synthetic oligonucleotide
ttcgattacgtcctccggttttgttcccccttggc

SEQ ID NO: 184755 - DNA, 35 bp, Artificial Sequence
  Synthetic oligonucleotide
ttgcatgccctttgctcttgacccgtacgccttgc

SEQ ID NO: 184756 - DNA, 35 bp, Artificial Sequence
  Synthetic oligonucleotide
tcccgctgcggatatcgctgcaaatgttccccatc

SEQ ID NO: 184757 - DNA, 35 bp, Artificial Sequence
  Synthetic oligonucleotide
tgactgcttcgggtctcgctgtcatacgctccatc

SEQ ID NO: 184758 - DNA, 35 bp, Artificial Sequence
  Synthetic oligonucleotide
ggacacctattcgcgctggttccctccgtatactc

SEQ ID NO: 184759 - DNA, 35 bp, Artificial Sequence
  Synthetic oligonucleotide
acacgtggaatcagcagttccctttcctctcgctc

SEQ ID NO: 184760 - DNA, 34 bp, Artificial Sequence
  Synthetic oligonucleotide
ttgcgaacggtcgtttcccctccatcactaggtc

SEQ ID NO: 184761 - DNA, 35 bp, Artificial Sequence
  Synthetic oligonucleotide
gggggtaggaacgggggttgtaaggggaggcggtc

SEQ ID NO: 184762 - DNA, 35 bp, Artificial Sequence
  Synthetic oligonucleotide
gagccactcgccgttttgattctcatattctggtc

SEQ ID NO: 184763 - DNA, 35 bp, Artificial Sequence
  Synthetic oligonucleotide
gtcaggcaatcttgtcctgcaacgtaccccctgtc

SEQ ID NO: 184764 - DNA, 35 bp, Artificial Sequence
  Synthetic oligonucleotide
tcctactcgcacattctttccgcaacccttgtgtc

SEQ ID NO: 184765 - DNA, 35 bp, Artificial Sequence
  Synthetic oligonucleotide
tgacctgccctgggctccctgtttatcttatattc

SEQ ID NO: 184766 - DNA, 35 bp, Artificial Sequence
  Synthetic oligonucleotide
agcaactcgctgctagtggcctgttctgtcccttc

SEQ ID NO: 184767 - DNA, 35 bp, Artificial Sequence
  Synthetic oligonucleotide
tatccgcaacatcccgcctcgtcctcggggaccag

SEQ ID NO: 184768 - DNA, 35 bp, Artificial Sequence
  Synthetic oligonucleotide
gtttgggaggaggaggggagaagaccgtcgattag

SEQ ID NO: 184769 - DNA, 36 bp, Artificial Sequence
  Synthetic oligonucleotide
ttgcgaatgctgtcccgtcgcgtccctactaccacg

SEQ ID NO: 184770 - DNA, 35 bp, Artificial Sequence
  Synthetic oligonucleotide
gtacgactgtcgctccttgtgcccccgccccgacg

SEQ ID NO: 184771 - DNA, 35 bp, Artificial Sequence
  Synthetic oligonucleotide
gacccctccgttctcctgccatctacgacgcaccg

SEQ ID NO: 184772 - DNA, 35 bp, Artificial Sequence
  Synthetic oligonucleotide
agaccgacaccgacatgaattccgtccattccccg

SEQ ID NO: 184773 - DNA, 35 bp, Artificial Sequence
  Synthetic oligonucleotide
actcaacctcaattgtaaatcatacctccctgccg

SEQ ID NO: 184774 - DNA, 35 bp, Artificial Sequence
  Synthetic oligonucleotide
tgagcaccccagcacatcgcatatgtctttctccg

SEQ ID NO: 184775 - DNA, 35 bp, Artificial Sequence
  Synthetic oligonucleotide
gagaggtggggcgtggaagaaaaggtgcacgtgcg

SEQ ID NO: 184776 - DNA, 35 bp, Artificial Sequence
  Synthetic oligonucleotide
acaccccccgtcccctggttactctacacccgtcg

SEQ ID NO: 184777 - DNA, 35 bp, Artificial Sequence
  Synthetic oligonucleotide
gccctccccgaccgccctgactgctcaccgcccgg

SEQ ID NO: 184778 - DNA, 35 bp, Artificial Sequence
  Synthetic oligonucleotide
acgtgcgcttgacgtacttcgaccgatccaccctg

SEQ ID NO: 184779 - DNA, 35 bp, Artificial Sequence
  Synthetic oligonucleotide
gccaccgacgccaccacccttctcttagtaaagtg

SEQ ID NO: 184780 - DNA, 35 bp, Artificial Sequence
  Synthetic oligonucleotide
gactcagtgccaagggggtagggggggttcgattg

SEQ ID NO: 184781 - DNA, 35 bp, Artificial Sequence
  Synthetic oligonucleotide
tcccccgtgccccttgatcccgttcctactcgttg

SEQ ID NO: 184782 - DNA, 35 bp, Artificial Sequence
  Synthetic oligonucleotide
tgtggagggcgggaggatggtggtgcgggtggcat

SEQ ID NO: 184783 - DNA, 35 bp, Artificial Sequence
  Synthetic oligonucleotide
aagatgaggcgggagaaggcggacaggagagctat

SEQ ID NO: 184784 - DNA, 35 bp, Artificial Sequence
  Synthetic oligonucleotide
gtgtccctccgtacgtctggacgatcatttaccct

SEQ ID NO: 184785 - DNA, 35 bp, Artificial Sequence
  Synthetic oligonucleotide
gccctccaccgttcaacttgccgtgacctggccct

SEQ ID NO: 184786 - DNA, 35 bp, Artificial Sequence
  Synthetic oligonucleotide
gccagagtcctaattgcctttaccgtgatatccct

SEQ ID NO: 184787 - DNA, 35 bp, Artificial Sequence
  Synthetic oligonucleotide
tgagggcccggtcctcttaacgtaatcctgctcct

SEQ ID NO: 184788 - DNA, 35 bp, Artificial Sequence
  Synthetic oligonucleotide
gagggcgtcacgtttcgcctcagttcccgtccgct

SEQ ID NO: 184789 - DNA, 35 bp, Artificial Sequence
  Synthetic oligonucleotide
tgatccactccattgtgcagtccacctctggctct

SEQ ID NO: 184790 - DNA, 35 bp, Artificial Sequence
  Synthetic oligonucleotide
attggctgcccctgtgcccgctttcacgtatttct

SEQ ID NO: 184791 - DNA, 35 bp, Artificial Sequence
  Synthetic oligonucleotide
tagacacctaccgattgcctgccgccctactttct

SEQ ID NO: 184792 - DNA, 35 bp, Artificial Sequence
  Synthetic oligonucleotide
aggtcaacgcctccctgcgcccttccttagaccgt

SEQ ID NO: 184793 - DNA, 35 bp, Artificial Sequence
  Synthetic oligonucleotide
aaacgccgcccccttgcctctcaaacgttccatgt

SEQ ID NO: 184794 - DNA, 36 bp, Artificial Sequence
  Synthetic oligonucleotide
actcagccacccttgtaccattgccccaagctctgt

SEQ ID NO: 184795 - DNA, 35 bp, Artificial Sequence
  Synthetic oligonucleotide
agagagtcaccgcccttgtctttacgttatgcctt

SEQ ID NO: 184796 - DNA, 35 bp, Artificial Sequence
  Synthetic oligonucleotide
tcatatacggggcagacgggaaaaggggggaggtt

SEQ ID NO: 184797 - DNA, 35 bp, Artificial Sequence
  Synthetic oligonucleotide
ggacgacattcctcctctccgcgccattcttgttt

SEQ ID NO: 184798 - DNA, 35 bp, Artificial Sequence
  Synthetic oligonucleotide
tcccctcccctctcgtatgtgcatgttgtccaaaa

SEQ ID NO: 184799 - DNA, 36 bp, Artificial Sequence
  Synthetic oligonucleotide
gatgacgtccgctgttcccgccgcccgtagctaaaa

SEQ ID NO: 184800 - DNA, 35 bp, Artificial Sequence
  Synthetic oligonucleotide
gtgtcaccttgtatgcgtatggtccgctcccccaa

SEQ ID NO: 184801 - DNA, 36 bp, Artificial Sequence
  Synthetic oligonucleotide
attgacagcacatcttgccgccaccttacgctccaa

SEQ ID NO: 184802 - DNA, 36 bp, Artificial Sequence
  Synthetic oligonucleotide
gcgtcgctgggcagggaatgaacgggggtggggcaa

SEQ ID NO: 184803 - DNA, 35 bp, Artificial Sequence
  Synthetic oligonucleotide
ggggtagggaggggtggacaatagaaatagaggaa

SEQ ID NO: 184804 - DNA, 35 bp, Artificial Sequence
  Synthetic oligonucleotide
atcgctcagggcgaagatggagtggggcggggtaa

SEQ ID NO: 184805 - DNA, 36 bp, Artificial Sequence
  Synthetic oligonucleotide
gatggacgggtaaaatcaagtgggggcggggtgtaa

SEQ ID NO: 184806 - DNA, 36 bp, Artificial Sequence
  Synthetic oligonucleotide
gtgggagtgatagcagggggaaggacattgcacaca

SEQ ID NO: 184807 - DNA, 36 bp, Artificial Sequence
  Synthetic oligonucleotide
aagccacattcctatctgcccataccggttgacaca

SEQ ID NO: 184808 - DNA, 35 bp, Artificial Sequence
  Synthetic oligonucleotide
atggtggagggggagggagggactggctagagaca

SEQ ID NO: 184809 - DNA, 36 bp, Artificial Sequence
  Synthetic oligonucleotide
gggccccgccgctgcttatcacccctcacacaacca

SEQ ID NO: 184810 - DNA, 36 bp, Artificial Sequence
  Synthetic oligonucleotide
tccgcactgacactttcgaagaccccctgcgcacca

SEQ ID NO: 184811 - DNA, 33 bp, Artificial Sequence
  Synthetic oligonucleotide
tccgacttcagtatgccttccgcccataaccca

SEQ ID NO: 184812 - DNA, 35 bp, Artificial Sequence
  Synthetic oligonucleotide
tctgtcttagatgtattctccgcctgtcccgccca

SEQ ID NO: 184813 - DNA, 35 bp, Artificial Sequence
  Synthetic oligonucleotide
ttccatcacctcagcgccgcccgaccagattccca

SEQ ID NO: 184814 - DNA, 36 bp, Artificial Sequence
  Synthetic oligonucleotide
gacgccctcggcccttctttctagactttgcttcca

SEQ ID NO: 184815 - DNA, 36 bp, Artificial Sequence
  Synthetic oligonucleotide
ccgaagcccctcacccgttgttcttctgcccacgca

SEQ ID NO: 184816 - DNA, 35 bp, Artificial Sequence
  Synthetic oligonucleotide
ttagcacatccattcggttttacgctcccgacgca

SEQ ID NO: 184817 - DNA, 35 bp, Artificial Sequence
  Synthetic oligonucleotide
gtaccatctgagcagccgcgcctcttttcatcgca

SEQ ID NO: 184818 - DNA, 36 bp, Artificial Sequence
  Synthetic oligonucleotide
tgcgcatccctgttcgaacaaccaccgatctctgca

SEQ ID NO: 184819 - DNA, 36 bp, Artificial Sequence
  Synthetic oligonucleotide
actcgggcacccctcgcttgtctccctttctgttca

SEQ ID NO: 184820 - DNA, 36 bp, Artificial Sequence
  Synthetic oligonucleotide
aacccacccctggctggactggacgatcccctttca

SEQ ID NO: 184821 - DNA, 37 bp, Artificial Sequence
  Synthetic oligonucleotide
atgggacaggtggaaagtgaggtatggggtggaaaga

SEQ ID NO: 184822 - DNA, 37 bp, Artificial Sequence
  Synthetic oligonucleotide
gtaggtgacagggggaattaaggggagatggtgaaga

SEQ ID NO: 184823 - DNA, 37 bp, Artificial Sequence
  Synthetic oligonucleotide
acctacgccaaacccccgcttactacagtacgataga

SEQ ID NO: 184824 - DNA, 36 bp, Artificial Sequence
  Synthetic oligonucleotide
tcctcccaccctattgatgcaccttcgatgacacga

SEQ ID NO: 184825 - DNA, 36 bp, Artificial Sequence
  Synthetic oligonucleotide
tcaacctcctacgctgtatggtccgccgcccgacga

SEQ ID NO: 184826 - DNA, 37 bp, Artificial Sequence
  Synthetic oligonucleotide
gagcccaccttcgcaccttgtcattcgttaatgccga

SEQ ID NO: 184827 - DNA, 37 bp, Artificial Sequence
  Synthetic oligonucleotide
tgccactaccaactgcctgtgttctccttatgctcga

SEQ ID NO: 184828 - DNA, 36 bp, Artificial Sequence
  Synthetic oligonucleotide
gtacctcctaagtgctgtgctgccttccctattcga

SEQ ID NO: 184829 - DNA, 37 bp, Artificial Sequence
  Synthetic oligonucleotide
gtcccccccagtgctagtttgccactccctccttcga

SEQ ID NO: 184830 - DNA, 37 bp, Artificial Sequence
  Synthetic oligonucleotide
acatgtggggggggactggcgggctggggacgaagga

SEQ ID NO: 184831 - DNA, 37 bp, Artificial Sequence
  Synthetic oligonucleotide
accgggagggtgggctactggcgttaagacttaggga

SEQ ID NO: 184832 - DNA, 37 bp, Artificial Sequence
  Synthetic oligonucleotide
gctgggtggtgtgggccgggatatcggtgactcggga

SEQ ID NO: 184833 - DNA, 37 bp, Artificial Sequence
  Synthetic oligonucleotide
gttccgggcggggttgtttggggtgtcgctatgggga

SEQ ID NO: 184834 - DNA, 37 bp, Artificial Sequence
  Synthetic oligonucleotide
agggagggagagaggggctcgaagggacttaatggga

SEQ ID NO: 184835 - DNA, 37 bp, Artificial Sequence
  Synthetic oligonucleotide
tgaccaacctctctattctccgcgccctccgtatgga

SEQ ID NO: 184836 - DNA, 36 bp, Artificial Sequence
  Synthetic oligonucleotide
gtcctacgtctccccgccctttctctcacagttgga

SEQ ID NO: 184837 - DNA, 38 bp, Artificial Sequence
  Synthetic oligonucleotide
aggaaaagacagtgaggcggggggggtacagcagatga

SEQ ID NO: 184838 - DNA, 38 bp, Artificial Sequence
  Synthetic oligonucleotide
tagtccgccttcccattgattctgccctttccttatga

SEQ ID NO: 184839 - DNA, 37 bp, Artificial Sequence
  Synthetic oligonucleotide
ggtcgcaccggccgcccgtgtccttctgcttaactga

SEQ ID NO: 184840 - DNA, 38 bp, Artificial Sequence
  Synthetic oligonucleotide
accgcgtagtcaacgtctcgcgccctccttaccactga

SEQ ID NO: 184841 - DNA, 37 bp, Artificial Sequence
  Synthetic oligonucleotide
cccacttctccgcgcgggttactattcaccttcctga

SEQ ID NO: 184842 - DNA, 37 bp, Artificial Sequence
  Synthetic oligonucleotide
tcgccccagagattgggttatcccgccgccttcctga

SEQ ID NO: 184843 - DNA, 37 bp, Artificial Sequence
  Synthetic oligonucleotide
atccaccgcgatggcgcgattcacccttctccagtga

SEQ ID NO: 184844 - DNA, 37 bp, Artificial Sequence
  Synthetic oligonucleotide
gatatgccctgccccttggtactgatacacgtagtga

SEQ ID NO: 184845 - DNA, 38 bp, Artificial Sequence
  Synthetic oligonucleotide
tcacgcccgcccccgctctcgtctaacccagaacgtga

SEQ ID NO: 184846 - DNA, 37 bp, Artificial Sequence
  Synthetic oligonucleotide
gagaagtgtcctgtcattgccgccgactactccgtga

SEQ ID NO: 184847 - DNA, 38 bp, Artificial Sequence
  Synthetic oligonucleotide
gaccacccacccacatatgctctcactagggaccttga

SEQ ID NO: 184848 - DNA, 38 bp, Artificial Sequence
  Synthetic oligonucleotide
tgttaccccaatgtgctgttgtaccccacgatccttga

SEQ ID NO: 184849 - DNA, 38 bp, Artificial Sequence
  Synthetic oligonucleotide
agtccacgcccgagttcctaccgccctcttcagcttga

SEQ ID NO: 184850 - DNA, 38 bp, Artificial Sequence
  Synthetic oligonucleotide
agtggggggcgggtgtaggggcaccaaatggggcttga

SEQ ID NO: 184851 - DNA, 35 bp, Artificial Sequence
  Synthetic oligonucleotide
accgatgcttcactgcttttgacttcccttcttga

SEQ ID NO: 184852 - DNA, 36 bp, Artificial Sequence
  Synthetic oligonucleotide
tcccaccgcatttcctggactattctaacgccacta

SEQ ID NO: 184853 - DNA, 36 bp, Artificial Sequence
  Synthetic oligonucleotide
gtcgatccaggctgtgggtccgtccctccgctccta

SEQ ID NO: 184854 - DNA, 36 bp, Artificial Sequence
  Synthetic oligonucleotide
aacaaggccacccagcctctctatgccaccttgcta

SEQ ID NO: 184855 - DNA, 35 bp, Artificial Sequence
  Synthetic oligonucleotide
accttcgcccgccctcctgttggagctcagttcta

SEQ ID NO: 184856 - DNA, 36 bp, Artificial Sequence
  Synthetic oligonucleotide
aaaccccgccccggtattcacgtacttagactagta

SEQ ID NO: 184857 - DNA, 36 bp, Artificial Sequence
  Synthetic oligonucleotide
aacctttgccgtcgcttgcatttagcctccaccgta

SEQ ID NO: 184858 - DNA, 35 bp, Artificial Sequence
  Synthetic oligonucleotide
gtcgcaccaggcgaccacccaatgtccccccggta

SEQ ID NO: 184859 - DNA, 36 bp, Artificial Sequence
  Synthetic oligonucleotide
tgtgcctccccgtatctccacctaccactagcggta

SEQ ID NO: 184860 - DNA, 34 bp, Artificial Sequence
  Synthetic oligonucleotide
gtttgggcatgccctctactattcgccccctgta

SEQ ID NO: 184861 - DNA, 36 bp, Artificial Sequence
  Synthetic oligonucleotide
gttgcccctccctgtctgttgctcacgcctatctta

SEQ ID NO: 184862 - DNA, 36 bp, Artificial Sequence
  Synthetic oligonucleotide
tcaggccccacaccatgtccctatatcttcgagtta

SEQ ID NO: 184863 - DNA, 35 bp, Artificial Sequence
  Synthetic oligonucleotide
gccacgtcgctttcccgagggcatccttgttacac

SEQ ID NO: 184864 - DNA, 35 bp, Artificial Sequence
  Synthetic oligonucleotide
actcgcgatcggcctctaaaaagtcactctgccac

SEQ ID NO: 184865 - DNA, 34 bp, Artificial Sequence
  Synthetic oligonucleotide
actatcacccctgtttgtgtcttgtccactccac

SEQ ID NO: 184866 - DNA, 35 bp, Artificial Sequence
  Synthetic oligonucleotide
agcacacaatctgtctttgtttttgttcttcgcac

SEQ ID NO: 184867 - DNA, 35 bp, Artificial Sequence
  Synthetic oligonucleotide
taacgtcaacctgcctcttgatgcgccccggtcac

SEQ ID NO: 184868 - DNA, 35 bp, Artificial Sequence
  Synthetic oligonucleotide
ttgaggccatccaagacccgttacatgctcccgac

SEQ ID NO: 184869 - DNA, 35 bp, Artificial Sequence
  Synthetic oligonucleotide
tccccacctactcgttgttctttcccttctggtac

SEQ ID NO: 184870 - DNA, 35 bp, Artificial Sequence
  Synthetic oligonucleotide
tgacatcccatttgcgtatacgcgcgctccccccc

SEQ ID NO: 184871 - DNA, 34 bp, Artificial Sequence
  Synthetic oligonucleotide
aatgcccatcactcgagagtagtaccttggcccc

SEQ ID NO: 184872 - DNA, 35 bp, Artificial Sequence
  Synthetic oligonucleotide
atgtccgcccaattacctgatataaatcatcgccc

SEQ ID NO: 184873 - DNA, 35 bp, Artificial Sequence
  Synthetic oligonucleotide
acaacccatcggtacgaatccgtgcacatttgccc

SEQ ID NO: 184874 - DNA, 35 bp, Artificial Sequence
  Synthetic oligonucleotide
tgtcccgccgtggtacaccttgggccagtactccc

SEQ ID NO: 184875 - DNA, 35 bp, Artificial Sequence
  Synthetic oligonucleotide
aaaggcctcggcaactcgctccatctttccctccc

SEQ ID NO: 184876 - DNA, 35 bp, Artificial Sequence
  Synthetic oligonucleotide
ggcctccctccgctctgtaacactcgcatcctgcc

SEQ ID NO: 184877 - DNA, 35 bp, Artificial Sequence
  Synthetic oligonucleotide
gcaggatgccgcagacatactgacttccctttgcc

SEQ ID NO: 184878 - DNA, 35 bp, Artificial Sequence
  Synthetic oligonucleotide
acccctcgaccgactgccaccattgcctcacatcc

SEQ ID NO: 184879 - DNA, 34 bp, Artificial Sequence
  Synthetic oligonucleotide
gccgaccccacccagatcccttacattatggtcc

SEQ ID NO: 184880 - DNA, 35 bp, Artificial Sequence
  Synthetic oligonucleotide
ggtgcagtagccacctcgtactgtcgcccttgtcc

SEQ ID NO: 184881 - DNA, 35 bp, Artificial Sequence
  Synthetic oligonucleotide
tattcagcgtggcacctatggctctctcctcttcc

SEQ ID NO: 184882 - DNA, 35 bp, Artificial Sequence
  Synthetic oligonucleotide
gtccagacaatgactctgccgtgcccgccttttcc

SEQ ID NO: 184883 - DNA, 35 bp, Artificial Sequence
  Synthetic oligonucleotide
gcatccgtcccgtcgcttgccaccctcttataagc

SEQ ID NO: 184884 - DNA, 36 bp, Artificial Sequence
  Synthetic oligonucleotide
tccaatgatcgttccacctttacctggctctaacgc

SEQ ID NO: 184885 - DNA, 35 bp, Artificial Sequence
  Synthetic oligonucleotide
atactcgggacacatgttgctacttcttccgccgc

SEQ ID NO: 184886 - DNA, 35 bp, Artificial Sequence
  Synthetic oligonucleotide
ttgccccccatgtctacccttgtccgcgaggccgc

SEQ ID NO: 184887 - DNA, 35 bp, Artificial Sequence
  Synthetic oligonucleotide
agatgctggcacatccccctcactgagtcttccgc

SEQ ID NO: 184888 - DNA, 35 bp, Artificial Sequence
  Synthetic oligonucleotide
gctcaccccactatgttcgaaacccgccaactcgc

SEQ ID NO: 184889 - DNA, 35 bp, Artificial Sequence
  Synthetic oligonucleotide
ttagcaccttctcacgcactccggctctttttcgc

SEQ ID NO: 184890 - DNA, 35 bp, Artificial Sequence
  Synthetic oligonucleotide
gtacaatgtgggcgggaggtagagggcgggattgc

SEQ ID NO: 184891 - DNA, 35 bp, Artificial Sequence
  Synthetic oligonucleotide
actcaacgcctgtcctttcagcctcctgtccttgc

SEQ ID NO: 184892 - DNA, 35 bp, Artificial Sequence
  Synthetic oligonucleotide
tcaacctccgggcaaacactgccttgctcccactc

SEQ ID NO: 184893 - DNA, 35 bp, Artificial Sequence
  Synthetic oligonucleotide
taagtccccccggcagtttcaggctcgcgcgcctc

SEQ ID NO: 184894 - DNA, 35 bp, Artificial Sequence
  Synthetic oligonucleotide
tcgcaacacagcattccgatctatgacatcggctc

SEQ ID NO: 184895 - DNA, 35 bp, Artificial Sequence
  Synthetic oligonucleotide
acagtgggtggagcgggtttacgggcatataagtc

SEQ ID NO: 184896 - DNA, 35 bp, Artificial Sequence
  Synthetic oligonucleotide
atggcgtgccttacgcgtacacacctatccccgtc

SEQ ID NO: 184897 - DNA, 35 bp, Artificial Sequence
  Synthetic oligonucleotide
tctgccgccagtagcaagaactgttcctccccttc

SEQ ID NO: 184898 - DNA, 35 bp, Artificial Sequence
  Synthetic oligonucleotide
gcgagtaggctcactgtgagttccttcacctcttc

SEQ ID NO: 184899 - DNA, 35 bp, Artificial Sequence
  Synthetic oligonucleotide
tcgacgcctgctgctttttctgtacatgcgtcttc

SEQ ID NO: 184900 - DNA, 35 bp, Artificial Sequence
  Synthetic oligonucleotide
gagctacacaccagcaatctcaccggttcctgttc

SEQ ID NO: 184901 - DNA, 35 bp, Artificial Sequence
  Synthetic oligonucleotide
gccatgtcccatcctatcaacccacacgaggaccg

SEQ ID NO: 184902 - DNA, 33 bp, Artificial Sequence
  Synthetic oligonucleotide
gttgttccccttcaaactgtatctgttgcctcg

SEQ ID NO: 184903 - DNA, 35 bp, Artificial Sequence
  Synthetic oligonucleotide
tgccacccagttcgcattgtggcatccacctctcg

SEQ ID NO: 184904 - DNA, 35 bp, Artificial Sequence
  Synthetic oligonucleotide
tagcggagggtgagatggagatgggatggatgagg

SEQ ID NO: 184905 - DNA, 35 bp, Artificial Sequence
  Synthetic oligonucleotide
gatgaacgaaggggtagtgtagcaggggagatagg

SEQ ID NO: 184906 - DNA, 35 bp, Artificial Sequence
  Synthetic oligonucleotide
gtgaaaggcgaaggggggcactagtggccaggtgg

SEQ ID NO: 184907 - DNA, 35 bp, Artificial Sequence
  Synthetic oligonucleotide
tgcgatcccggtcccgtcccattaacccagtttgg

SEQ ID NO: 184908 - DNA, 36 bp, Artificial Sequence
  Synthetic oligonucleotide
ggacccctcccccacgtgtgtcgctccccctacgtg

SEQ ID NO: 184909 - DNA, 35 bp, Artificial Sequence
  Synthetic oligonucleotide
actgtgacacccgcgcctacacactcatagccttg

SEQ ID NO: 184910 - DNA, 35 bp, Artificial Sequence
  Synthetic oligonucleotide
cagaacgagaggtggaggagggagtgagcgtcttg

SEQ ID NO: 184911 - DNA, 35 bp, Artificial Sequence
  Synthetic oligonucleotide
acaccgcccccccgcctatagcatgcgatgctttg

SEQ ID NO: 184912 - DNA, 35 bp, Artificial Sequence
  Synthetic oligonucleotide
tcccgcccacccatgcaaaatggtccgttttaaat

SEQ ID NO: 184913 - DNA, 35 bp, Artificial Sequence
  Synthetic oligonucleotide
gttccgccccgcctggacccctttgattgacgcat

SEQ ID NO: 184914 - DNA, 35 bp, Artificial Sequence
  Synthetic oligonucleotide
gttctcctcagcgccccgcccgcttcacagtgcat

SEQ ID NO: 184915 - DNA, 35 bp, Artificial Sequence
  Synthetic oligonucleotide
tccctaacgcccgaacgctttacttgttacactat

SEQ ID NO: 184916 - DNA, 35 bp, Artificial Sequence
  Synthetic oligonucleotide
tcaccatccgctcgctgtccatcgcgttctactat

SEQ ID NO: 184917 - DNA, 35 bp, Artificial Sequence
  Synthetic oligonucleotide
gcctctcgtccgtgcgcccgtccgaccataattat

SEQ ID NO: 184918 - DNA, 35 bp, Artificial Sequence
  Synthetic oligonucleotide
gcaactcgatactgtcctgttcgttttccctcact

SEQ ID NO: 184919 - DNA, 35 bp, Artificial Sequence
  Synthetic oligonucleotide
tgtctaccagggccttcaccagacgtttttcacct

SEQ ID NO: 184920 - DNA, 35 bp, Artificial Sequence
  Synthetic oligonucleotide
acctgttcctctcgctcaccgttcccttgtgacct

SEQ ID NO: 184921 - DNA, 35 bp, Artificial Sequence
  Synthetic oligonucleotide
aagtcaggcccgaggtcctcctgttttgccctgct

SEQ ID NO: 184922 - DNA, 35 bp, Artificial Sequence
  Synthetic oligonucleotide
gtaactcaccgtctattcctggcgatcacacttct

SEQ ID NO: 184923 - DNA, 35 bp, Artificial Sequence
  Synthetic oligonucleotide
tagggtacgcccttcatcgtttttaccggtcttct

SEQ ID NO: 184924 - DNA, 35 bp, Artificial Sequence
  Synthetic oligonucleotide
tgcacctcgccccgtctcttatcacttacataggt

SEQ ID NO: 184925 - DNA, 35 bp, Artificial Sequence
  Synthetic oligonucleotide
gccccccagaccacgcgcctcacgccattggcctt

SEQ ID NO: 184926 - DNA, 35 bp, Artificial Sequence
  Synthetic oligonucleotide
tactctgtcctcaccggtaagcacccttcttcgtt

SEQ ID NO: 184927 - DNA, 35 bp, Artificial Sequence
  Synthetic oligonucleotide
tcaccccctgttcacctctgcccttgaaacatgtt

SEQ ID NO: 184928 - DNA, 35 bp, Artificial Sequence
  Synthetic oligonucleotide
acaccaccatgtaagcgtctcacatccctggtttt

SEQ ID NO: 184929 - DNA, 35 bp, Artificial Sequence
  Synthetic oligonucleotide
gtcaaagggggcagcagagacacggaaggatgaaa

SEQ ID NO: 184930 - DNA, 35 bp, Artificial Sequence
  Synthetic oligonucleotide
gaaccagccccctccggttccctccccatttacaa

SEQ ID NO: 184931 - DNA, 36 bp, Artificial Sequence
  Synthetic oligonucleotide
gcacgacatagtccctctcgctccttgtgttcggaa

SEQ ID NO: 184932 - DNA, 36 bp, Artificial Sequence
  Synthetic oligonucleotide
cccgaactgtcacctgcacaggtcgtcaaaacaaca

SEQ ID NO: 184933 - DNA, 35 bp, Artificial Sequence
  Synthetic oligonucleotide
tagccaccccctgcacggtttgtgctacgctaaca

SEQ ID NO: 184934 - DNA, 34 bp, Artificial Sequence
  Synthetic oligonucleotide
accaccctcccttgcaccgtttgcgctgaagcca

SEQ ID NO: 184935 - DNA, 35 bp, Artificial Sequence
  Synthetic oligonucleotide
gacaacgcatccacgtcactccatccggtaggcca

SEQ ID NO: 184936 - DNA, 36 bp, Artificial Sequence
  Synthetic oligonucleotide
cctagtcacagatgtgccgctcccaacctcactcca

SEQ ID NO: 184937 - DNA, 36 bp, Artificial Sequence
  Synthetic oligonucleotide
tgatgtcccctgtgttcgctgctgcccgcttctcca

SEQ ID NO: 184938 - DNA, 35 bp, Artificial Sequence
  Synthetic oligonucleotide
tccaccgccccattagacacacctgtttcgaggca

SEQ ID NO: 184939 - DNA, 35 bp, Artificial Sequence
  Synthetic oligonucleotide
tatgacaaggtgacgggggtaagatgcgggcggca

SEQ ID NO: 184940 - DNA, 35 bp, Artificial Sequence
  Synthetic oligonucleotide
attgcacagcatgtcagcccgtcctttctcatgca

SEQ ID NO: 184941 - DNA, 35 bp, Artificial Sequence
  Synthetic oligonucleotide
tccatctcgccgataacgaaccctccactgctgca

SEQ ID NO: 184942 - DNA, 36 bp, Artificial Sequence
  Synthetic oligonucleotide
gtgcctccccacgtgtttttcggctgttgacgtgca

SEQ ID NO: 184943 - DNA, 36 bp, Artificial Sequence
  Synthetic oligonucleotide
tcgacaagccactagttaagcccatccgcctgctca

SEQ ID NO: 184944 - DNA, 35 bp, Artificial Sequence
  Synthetic oligonucleotide
tcttcaccatcccttgtgcagatgagtcccgttca

SEQ ID NO: 184945 - DNA, 36 bp, Artificial Sequence
  Synthetic oligonucleotide
ttgaacggactcggaagtgggaaggcgggggaaaga

SEQ ID NO: 184946 - DNA, 37 bp, Artificial Sequence
  Synthetic oligonucleotide
gaagaggggttcgactgggggtgggtaaggcgtaaga

SEQ ID NO: 184947 - DNA, 36 bp, Artificial Sequence
  Synthetic oligonucleotide
ggaccccctcgaatgcgcacaactcccatccacaga

SEQ ID NO: 184948 - DNA, 37 bp, Artificial Sequence
  Synthetic oligonucleotide
ggtgcgggtagcacgggggggcgagaagacggggaga

SEQ ID NO: 184949 - DNA, 37 bp, Artificial Sequence
  Synthetic oligonucleotide
acgggtggaggacggaggaattatgggtgctgggaga

SEQ ID NO: 184950 - DNA, 36 bp, Artificial Sequence
  Synthetic oligonucleotide
tccaccctgtcctcgtttgcatacgacacaacacga

SEQ ID NO: 184951 - DNA, 37 bp, Artificial Sequence
  Synthetic oligonucleotide
tatgccttccgcccgtgcctaccctccgttcagacga

SEQ ID NO: 184952 - DNA, 37 bp, Artificial Sequence
  Synthetic oligonucleotide
atgaagggtccaaggggggttgtggggagtgggacga

SEQ ID NO: 184953 - DNA, 36 bp, Artificial Sequence
  Synthetic oligonucleotide
gcaaacgccgacgaggtaactccccttccatcccga

SEQ ID NO: 184954 - DNA, 37 bp, Artificial Sequence
  Synthetic oligonucleotide
tgaacaccagtagcaagtaacggcccgcccctcccga

SEQ ID NO: 184955 - DNA, 37 bp, Artificial Sequence
  Synthetic oligonucleotide
tagatggggagatagggaagggcgtgggcgagtccga

SEQ ID NO: 184956 - DNA, 37 bp, Artificial Sequence
  Synthetic oligonucleotide
acgacgccctcttgctgccacggttcgcttatttcga

SEQ ID NO: 184957 - DNA, 37 bp, Artificial Sequence
  Synthetic oligonucleotide
atctacccgctactatcgtgactccctcgactttcga

SEQ ID NO: 184958 - DNA, 37 bp, Artificial Sequence
  Synthetic oligonucleotide
gaaggggtgggaaggcaggcaagggaagaacacagga

SEQ ID NO: 184959 - DNA, 37 bp, Artificial Sequence
  Synthetic oligonucleotide
gccttgcgcacccgccccgccgtcctattacaacgga

SEQ ID NO: 184960 - DNA, 37 bp, Artificial Sequence
  Synthetic oligonucleotide
gtggtgggtgaggaggggccaaagtgtgtctggcgga

SEQ ID NO: 184961 - DNA, 28 bp, Artificial Sequence
  Synthetic oligonucleotide
accaccattccgacccgctgccatcgga

SEQ ID NO: 184962 - DNA, 37 bp, Artificial Sequence
  Synthetic oligonucleotide
gaatccctctcgtacgccctgtcccaccattccggga

SEQ ID NO: 184963 - DNA, 37 bp, Artificial Sequence
  Synthetic oligonucleotide
gataagcgaaaggcaagaaggcggaaacggagcggga

SEQ ID NO: 184964 - DNA, 37 bp, Artificial Sequence
  Synthetic oligonucleotide
ttggaaggggacggtgggtagcctagacgagtgggga

SEQ ID NO: 184965 - DNA, 37 bp, Artificial Sequence
  Synthetic oligonucleotide
gatgaggaggcgtaacggggattcggagggggtggga

SEQ ID NO: 184966 - DNA, 35 bp, Artificial Sequence
  Synthetic oligonucleotide
atcacgcacgggaggggagttgggttaacttggga

SEQ ID NO: 184967 - DNA, 35 bp, Artificial Sequence
  Synthetic oligonucleotide
tattgcgcccgatcacccgcccttcattcactgga

SEQ ID NO: 184968 - DNA, 36 bp, Artificial Sequence
  Synthetic oligonucleotide
agacgaggccagggagtgtgccagggagcgggtgga

SEQ ID NO: 184969 - DNA, 37 bp, Artificial Sequence
  Synthetic oligonucleotide
gtgactcacggccacctgtcactactacccacttgga

SEQ ID NO: 184970 - DNA, 37 bp, Artificial Sequence
  Synthetic oligonucleotide
gacttggggggaggaggaccgagcagccgagtttgga

SEQ ID NO: 184971 - DNA, 38 bp, Artificial Sequence
  Synthetic oligonucleotide
aaagagggcgaggtactagggagataggggtggaatga

SEQ ID NO: 184972 - DNA, 38 bp, Artificial Sequence
  Synthetic oligonucleotide
tgaacgtccggtcgacgccacttccgcccttaccatga

SEQ ID NO: 184973 - DNA, 38 bp, Artificial Sequence
  Synthetic oligonucleotide
gagggggggcggggcaagtagggctcagtcgttgatga

SEQ ID NO: 184974 - DNA, 37 bp, Artificial Sequence
  Synthetic oligonucleotide
tagttacacgcccatgcccgttaagctccctctatga

SEQ ID NO: 184975 - DNA, 37 bp, Artificial Sequence
  Synthetic oligonucleotide
tatgacccgctcccttgcccattgctccttgtactga

SEQ ID NO: 184976 - DNA, 38 bp, Artificial Sequence
  Synthetic oligonucleotide
acacaggtacagacggctgtaaactctccttcccctga

SEQ ID NO: 184977 - DNA, 38 bp, Artificial Sequence
  Synthetic oligonucleotide
atggcccgtcactagcatcatccccagccgcccgctga

SEQ ID NO: 184978 - DNA, 37 bp, Artificial Sequence
  Synthetic oligonucleotide
accccccgacgcatatattaggcaatgccacctctga

SEQ ID NO: 184979 - DNA, 36 bp, Artificial Sequence
  Synthetic oligonucleotide
gtcgccaggtccatctgttgcattttcaccttctga

SEQ ID NO: 184980 - DNA, 38 bp, Artificial Sequence
  Synthetic oligonucleotide
aaggggggggcgcgtaagggaaccatggggaggagtga

SEQ ID NO: 184981 - DNA, 37 bp, Artificial Sequence
  Synthetic oligonucleotide
tattcaccctacgctgcctcacctcccgactccgtga

SEQ ID NO: 184982 - DNA, 38 bp, Artificial Sequence
  Synthetic oligonucleotide
taggacgaggaggggatgtctgaggggccggggattga

SEQ ID NO: 184983 - DNA, 38 bp, Artificial Sequence
  Synthetic oligonucleotide
tcgcgaacacgacaggtgccgcctctttcccccgttga

SEQ ID NO: 184984 - DNA, 36 bp, Artificial Sequence
  Synthetic oligonucleotide
ggatcatggacgggggaagggagggcggacatttga

SEQ ID NO: 184985 - DNA, 38 bp, Artificial Sequence
  Synthetic oligonucleotide
ttgtacctccagctgttcttcccctgtttcccctttga

SEQ ID NO: 184986 - DNA, 37 bp, Artificial Sequence
  Synthetic oligonucleotide
agtacagccccttcatcgttttccccctgtcgtttga

SEQ ID NO: 184987 - DNA, 37 bp, Artificial Sequence
  Synthetic oligonucleotide
atcgccccctcccactaccgagacttgcatggtttga

SEQ ID NO: 184988 - DNA, 36 bp, Artificial Sequence
  Synthetic oligonucleotide
gcaatccactgccctctgttaccgttcacgcgcata

SEQ ID NO: 184989 - DNA, 36 bp, Artificial Sequence
  Synthetic oligonucleotide
tgcaatgccccccgtccgttaacagcattaagccta

SEQ ID NO: 184990 - DNA, 36 bp, Artificial Sequence
  Synthetic oligonucleotide
acgactcttgctgctcctgttactccacctggccta

SEQ ID NO: 184991 - DNA, 35 bp, Artificial Sequence
  Synthetic oligonucleotide
atcgacagacccttgttggtcctagttctcttcta

SEQ ID NO: 184992 - DNA, 35 bp, Artificial Sequence
  Synthetic oligonucleotide
gcgggggggtgaggaggggttgaatgcgcgcagta

SEQ ID NO: 184993 - DNA, 36 bp, Artificial Sequence
  Synthetic oligonucleotide
gaccgtcacacctgtcaacctcctcttacgcgagta

SEQ ID NO: 184994 - DNA, 36 bp, Artificial Sequence
  Synthetic oligonucleotide
gcgtgcctcccctctgcttagtgtccctgcaccgta

SEQ ID NO: 184995 - DNA, 35 bp, Artificial Sequence
  Synthetic oligonucleotide
gcgatagcaactgtcacctcggtccattccccgta

SEQ ID NO: 184996 - DNA, 36 bp, Artificial Sequence
  Synthetic oligonucleotide
attcgcgtacgcgacgacgttcttgcccttacctta

SEQ ID NO: 184997 - DNA, 35 bp, Artificial Sequence
  Synthetic oligonucleotide
tgttacgtgatcgtctatcttgccctcattcgtta

SEQ ID NO: 184998 - DNA, 35 bp, Artificial Sequence
  Synthetic oligonucleotide
tactcctcagccttcttaccgtcccttcgttgtta

SEQ ID NO: 184999 - DNA, 35 bp, Artificial Sequence
  Synthetic oligonucleotide
gaaggggggctcaaaatctgggggaggggttcaac

SEQ ID NO: 185000 - DNA, 35 bp, Artificial Sequence
  Synthetic oligonucleotide
ttgatgcttcgtccgcctttgtcgttcgccctaac

SEQ ID NO: 185001 - DNA, 35 bp, Artificial Sequence
  Synthetic oligonucleotide
ggatctgcacatcggtactcgcggctatttaccac

SEQ ID NO: 185002 - DNA, 35 bp, Artificial Sequence
  Synthetic oligonucleotide
tcgcaccgccccacgttcttcggcgcccctttcac

SEQ ID NO: 185003 - DNA, 35 bp, Artificial Sequence
  Synthetic oligonucleotide
acattcgttcatccctgcaactgtgccttccctac

SEQ ID NO: 185004 - DNA, 35 bp, Artificial Sequence
  Synthetic oligonucleotide
gaggactgaccggcggtgggggggagcatggttac

SEQ ID NO: 185005 - DNA, 35 bp, Artificial Sequence
  Synthetic oligonucleotide
ttaagtcaccgtgcccacgcccagttcatctaacc

SEQ ID NO: 185006 - DNA, 35 bp, Artificial Sequence
  Synthetic oligonucleotide
tcccgaccgccaaaactgctcccctgagtactacc

SEQ ID NO: 185007 - DNA, 35 bp, Artificial Sequence
  Synthetic oligonucleotide
tctcccccgatgttagcgtcttgacctcgtttccc

SEQ ID NO: 185008 - DNA, 35 bp, Artificial Sequence
  Synthetic oligonucleotide
tgtcgatcacgcttcccccccccgtagcagtagcc

SEQ ID NO: 185009 - DNA, 35 bp, Artificial Sequence
  Synthetic oligonucleotide
tcgccccgctccgaccccgtgcgcaacgcctcgcc

SEQ ID NO: 185010 - DNA, 35 bp, Artificial Sequence
  Synthetic oligonucleotide
gcgacaccgcccctgccgctaccgttcctgactcc

SEQ ID NO: 185011 - DNA, 35 bp, Artificial Sequence
  Synthetic oligonucleotide
ttggggcactcgccctcccctataagcccccttcc

SEQ ID NO: 185012 - DNA, 35 bp, Artificial Sequence
  Synthetic oligonucleotide
agcggggtccgatctgcgtcgttttcttcctttcc

SEQ ID NO: 185013 - DNA, 35 bp, Artificial Sequence
  Synthetic oligonucleotide
tccgccgacccacagatgtccttcctcgtctttcc

SEQ ID NO: 185014 - DNA, 35 bp, Artificial Sequence
  Synthetic oligonucleotide
gtcctgcctagggtttagccacctccgtattttcc

SEQ ID NO: 185015 - DNA, 35 bp, Artificial Sequence
  Synthetic oligonucleotide
tcgctccaccagcctccgtttgacgaatcccccgc

SEQ ID NO: 185016 - DNA, 34 bp, Artificial Sequence
  Synthetic oligonucleotide
tcgctagatctcgctgcctccaccgacgcctggc

SEQ ID NO: 185017 - DNA, 34 bp, Artificial Sequence
  Synthetic oligonucleotide
ttcatccccagcccatgagcatgcccatcattgc

SEQ ID NO: 185018 - DNA, 35 bp, Artificial Sequence
  Synthetic oligonucleotide
gagtcacgcgtccggctcactccacttcggtactc

SEQ ID NO: 185019 - DNA, 35 bp, Artificial Sequence
  Synthetic oligonucleotide
gacgagtcgcattatcgcgcgttactatgtccctc

SEQ ID NO: 185020 - DNA, 35 bp, Artificial Sequence
  Synthetic oligonucleotide
tagtggcgtcgctttcctcaagccccccctgcctc

SEQ ID NO: 185021 - DNA, 35 bp, Artificial Sequence
  Synthetic oligonucleotide
gcgccctaccctgctgtcctcgtcctgggatcctc

SEQ ID NO: 185022 - DNA, 35 bp, Artificial Sequence
  Synthetic oligonucleotide
tagcgatcggcgacccgtgctcgattgtcttcctc

SEQ ID NO: 185023 - DNA, 35 bp, Artificial Sequence
  Synthetic oligonucleotide
aatgctgtcccatcgctactgttcccactcagctc

SEQ ID NO: 185024 - DNA, 35 bp, Artificial Sequence
  Synthetic oligonucleotide
gggacccccggcaattttctaacactcgccctgtc

SEQ ID NO: 185025 - DNA, 35 bp, Artificial Sequence
  Synthetic oligonucleotide
agtgatacgccgatctatcgcacttaacccctttc

SEQ ID NO: 185026 - DNA, 35 bp, Artificial Sequence
  Synthetic oligonucleotide
gctgaactctgtatcgctccctaccctactgtttc

SEQ ID NO: 185027 - DNA, 35 bp, Artificial Sequence
  Synthetic oligonucleotide
gcaccgcctagtcggtccatctttccttgccaaag

SEQ ID NO: 185028 - DNA, 35 bp, Artificial Sequence
  Synthetic oligonucleotide
gtgaaagcaaatgagggggggcgaggataggcaag

SEQ ID NO: 185029 - DNA, 35 bp, Artificial Sequence
  Synthetic oligonucleotide
ggtatacccccccgcagtcgcctttccctcctcag

SEQ ID NO: 185030 - DNA, 35 bp, Artificial Sequence
  Synthetic oligonucleotide
gattggaaggaaggcatggggtggcccggggcgag

SEQ ID NO: 185031 - DNA, 35 bp, Artificial Sequence
  Synthetic oligonucleotide
gcaatatgggagagcgaactaaggggcacggggag

SEQ ID NO: 185032 - DNA, 35 bp, Artificial Sequence
  Synthetic oligonucleotide
aaacgtgggtgggggaagaggggcttgggtgtgag

SEQ ID NO: 185033 - DNA, 35 bp, Artificial Sequence
  Synthetic oligonucleotide
gttgctccttccccccgatcgtactttgacactag

SEQ ID NO: 185034 - DNA, 35 bp, Artificial Sequence
  Synthetic oligonucleotide
tcaccccgctcctgacgtgctccggttcctgcccg

SEQ ID NO: 185035 - DNA, 35 bp, Artificial Sequence
  Synthetic oligonucleotide
ttgcacgctgtcttgtcgtcccctctccgcagtcg

SEQ ID NO: 185036 - DNA, 35 bp, Artificial Sequence
  Synthetic oligonucleotide
accgccagggggaattgtgggtgggccatctaggg

SEQ ID NO: 185037 - DNA, 35 bp, Artificial Sequence
  Synthetic oligonucleotide
attgcactacctccccccatccgacgggtatatgg

SEQ ID NO: 185038 - DNA, 35 bp, Artificial Sequence
  Synthetic oligonucleotide
atgcgcattgctcgcttcatgtttctttttcctgg

SEQ ID NO: 185039 - DNA, 35 bp, Artificial Sequence
  Synthetic oligonucleotide
gtggaaggtaggcgtggttagggggggtagtgtgg

SEQ ID NO: 185040 - DNA, 35 bp, Artificial Sequence
  Synthetic oligonucleotide
actgctccacgccctcatcagcttaaccggtactg

SEQ ID NO: 185041 - DNA, 35 bp, Artificial Sequence
  Synthetic oligonucleotide
gtcaccccaatacttcaccgtcatttcaatccgtg

SEQ ID NO: 185042 - DNA, 35 bp, Artificial Sequence
  Synthetic oligonucleotide
tgatgagtcgctgttccacccgggcccttatcttg

SEQ ID NO: 185043 - DNA, 35 bp, Artificial Sequence
  Synthetic oligonucleotide
acacactacctaacatgttcgccgttccgctcttg

SEQ ID NO: 185044 - DNA, 35 bp, Artificial Sequence
  Synthetic oligonucleotide
gtgaagggtcgtattgtggggggtagaaccggcat

SEQ ID NO: 185045 - DNA, 35 bp, Artificial Sequence
  Synthetic oligonucleotide
gtcccccctccgtagggttgataccaaacacatat

SEQ ID NO: 185046 - DNA, 35 bp, Artificial Sequence
  Synthetic oligonucleotide
acaagcaagcatacggatatcctctccacgccact

SEQ ID NO: 185047 - DNA, 35 bp, Artificial Sequence
  Synthetic oligonucleotide
gtgcgtattagacccagcgccttccaacttcacct

SEQ ID NO: 185048 - DNA, 35 bp, Artificial Sequence
  Synthetic oligonucleotide
tagttcgccctctgaggctactctttcacttacct

SEQ ID NO: 185049 - DNA, 35 bp, Artificial Sequence
  Synthetic oligonucleotide
accacccgcaatactgttacatgacccttccgcct

SEQ ID NO: 185050 - DNA, 35 bp, Artificial Sequence
  Synthetic oligonucleotide
tagtaccccctcatgcaaaagcacgccgtcttgct

SEQ ID NO: 185051 - DNA, 35 bp, Artificial Sequence
  Synthetic oligonucleotide
aacccccatgttcgtatgtagacgaactgtactct

SEQ ID NO: 185052 - DNA, 35 bp, Artificial Sequence
  Synthetic oligonucleotide
gccacgactacgctgcctaactctagttctcgtct

SEQ ID NO: 185053 - DNA, 35 bp, Artificial Sequence
  Synthetic oligonucleotide
tcgacccttcacagccgcccctacgttgcccttct

SEQ ID NO: 185054 - DNA, 35 bp, Artificial Sequence
  Synthetic oligonucleotide
atgtaccaaggtcaccattaaccccagcccgttct

SEQ ID NO: 185055 - DNA, 35 bp, Artificial Sequence
  Synthetic oligonucleotide
gagacgcatctgtctacttcctccgcgcacactgt

SEQ ID NO: 185056 - DNA, 35 bp, Artificial Sequence
  Synthetic oligonucleotide
ccgtggccctgtttcgtactgccgcctttatcatt

SEQ ID NO: 185057 - DNA, 35 bp, Artificial Sequence
  Synthetic oligonucleotide
ggggctctgtccctttcgctttttgaccgtacctt

SEQ ID NO: 185058 - DNA, 35 bp, Artificial Sequence
  Synthetic oligonucleotide
tttggtcgccgcacatcgttatcccttctggcctt

SEQ ID NO: 185059 - DNA, 35 bp, Artificial Sequence
  Synthetic oligonucleotide
tgcggacaccgtgccatgttcctgttcccccgctt

SEQ ID NO: 185060 - DNA, 35 bp, Artificial Sequence; identical to SEQ ID NO: 102789
  Synthetic oligonucleotide

SEQ ID NO: 185061 - DNA, 35 bp, Artificial Sequence
  Synthetic oligonucleotide
aaatcgccgctcgttttattagcttctcctccgtt

SEQ ID NO: 185062 - DNA, 35 bp, Artificial Sequence
  Synthetic oligonucleotide
gccacctctctgtctccgtgaatatcctcccattt

SEQ ID NO: 185063 - DNA, 35 bp, Artificial Sequence
  Synthetic oligonucleotide
ttctgcacacactgctttaccgttacgtaccacaa

SEQ ID NO: 185064 - DNA, 36 bp, Artificial Sequence
  Synthetic oligonucleotide
gccgcctctcctgcatccagtagcatcaccttacaa

SEQ ID NO: 185065 - DNA, 36 bp, Artificial Sequence
  Synthetic oligonucleotide
ttgcacctgcctccccgtgacccgatgacccgccaa

SEQ ID NO: 185066 - DNA, 35 bp, Artificial Sequence
  Synthetic oligonucleotide
gccatcccgctcatacttcaaccatcgcctgccaa

SEQ ID NO: 185067 - DNA, 36 bp, Artificial Sequence
  Synthetic oligonucleotide
atccagagtcctaggggggagagggagggcacgcaa

SEQ ID NO: 185068 - DNA, 36 bp, Artificial Sequence
  Synthetic oligonucleotide
gaaccaaggaggcggatgatgggtgtcggggggcaa

SEQ ID NO: 185069 - DNA, 36 bp, Artificial Sequence
  Synthetic oligonucleotide
acgtgcctccccagcttaggtcataagctctctcaa

SEQ ID NO: 185070 - DNA, 36 bp, Artificial Sequence
  Synthetic oligonucleotide
tgccaatcgtccgcctgtatttggccactcgttcaa

SEQ ID NO: 185071 - DNA, 36 bp, Artificial Sequence
  Synthetic oligonucleotide
ttatacaccgtgcccatgccccccgttcgttcagaa

SEQ ID NO: 185072 - DNA, 35 bp, Artificial Sequence
  Synthetic oligonucleotide
gttacctgcccacagcccttcgtatcttactggaa

SEQ ID NO: 185073 - DNA, 35 bp, Artificial Sequence
  Synthetic oligonucleotide
gggggtaggggggcgaagtcggctagtaggggtaa

SEQ ID NO: 185074 - DNA, 36 bp, Artificial Sequence
  Synthetic oligonucleotide
acacccccaccccccgttcgcttcgaactcagttaa

SEQ ID NO: 185075 - DNA, 35 bp, Artificial Sequence
  Synthetic oligonucleotide
taacccgccgcttaataatactcctgctgtgcaca

SEQ ID NO: 185076 - DNA, 35 bp, Artificial Sequence
  Synthetic oligonucleotide
gttgcgaccgtctacttccctcctccccgtcgaca

SEQ ID NO: 185077 - DNA, 36 bp, Artificial Sequence
  Synthetic oligonucleotide
agatcccacaccccctcactggtcacacaagggaca

SEQ ID NO: 185078 - DNA, 36 bp, Artificial Sequence
  Synthetic oligonucleotide
accgccccagcgttgaccagaatccgttgcccacca

SEQ ID NO: 185079 - DNA, 34 bp, Artificial Sequence
  Synthetic oligonucleotide
gttgggcccgtgctctattgccgactgcacccca

SEQ ID NO: 185080 - DNA, 36 bp, Artificial Sequence
  Synthetic oligonucleotide
acacccggcctaacaacggacgcccatcctcgccca

SEQ ID NO: 185081 - DNA, 35 bp, Artificial Sequence
  Synthetic oligonucleotide
tctcgcctccctacatcattcagttgcagtgccca

SEQ ID NO: 185082 - DNA, 35 bp, Artificial Sequence
  Synthetic oligonucleotide
ggttgcctccgcgcttctcttcctgccttgttcca

SEQ ID NO: 185083 - DNA, 37 bp, Artificial Sequence
  Synthetic oligonucleotide
gtgcactcctactttatcgaccgcctttctccgcaga

SEQ ID NO: 185084 - DNA, 37 bp, Artificial Sequence
  Synthetic oligonucleotide
gtaccgccccacttgctcactagaagactacttacga

SEQ ID NO: 185085 - DNA, 37 bp, Artificial Sequence
  Synthetic oligonucleotide
tattcagcgcaacatgtcccatacatcctacccccga

SEQ ID NO: 185086 - DNA, 37 bp, Artificial Sequence
  Synthetic oligonucleotide
ttgcctacgctcagtcacatcaatcctggcctcccga

SEQ ID NO: 185087 - DNA, 37 bp, Artificial Sequence
  Synthetic oligonucleotide
gtccccctccgatattatgctcgagtcgttactccga

SEQ ID NO: 185088 - DNA, 37 bp, Artificial Sequence
  Synthetic oligonucleotide
gaaacctcattgtggcccatcgcttacacccctccga

SEQ ID NO: 185089 - DNA, 36 bp, Artificial Sequence
  Synthetic oligonucleotide
tcctatctccgccttaccattattagacgcctccga

SEQ ID NO: 185090 - DNA, 37 bp, Artificial Sequence
  Synthetic oligonucleotide
gtgaccccccagtgcacgagccacccgtccattccga

SEQ ID NO: 185091 - DNA, 37 bp, Artificial Sequence
  Synthetic oligonucleotide
agtaggacggggaacatgggaaggtggtgcgcggcga

SEQ ID NO: 185092 - DNA, 37 bp, Artificial Sequence
  Synthetic oligonucleotide
gaggtcagtgccaacgaagggaagaggagaggggcga

SEQ ID NO: 185093 - DNA, 37 bp, Artificial Sequence
  Synthetic oligonucleotide
taccgcgcatagtgtatgggtgggctgggatgggcga

SEQ ID NO: 185094 - DNA, 36 bp, Artificial Sequence
  Synthetic oligonucleotide
tgcgatgggcagtattgaaccactccacactctcga

SEQ ID NO: 185095 - DNA, 37 bp, Artificial Sequence
  Synthetic oligonucleotide
cacccctgtccgccgctcgcataagccccccagtcga

SEQ ID NO: 185096 - DNA, 36 bp, Artificial Sequence
  Synthetic oligonucleotide
gtgagaggctggaggtaggtaggacaagggggtcga

SEQ ID NO: 185097 - DNA, 37 bp, Artificial Sequence
  Synthetic oligonucleotide
gtgggcaaagggtgcaaaggaggcggggacgaaagga

SEQ ID NO: 185098 - DNA, 37 bp, Artificial Sequence
  Synthetic oligonucleotide
gacacgaaggaaagggcggaaaatggggctaggagga

SEQ ID NO: 185099 - DNA, 37 bp, Artificial Sequence
  Synthetic oligonucleotide
atgacgcgacgggcgggtttgggcatcgggtggcgga

SEQ ID NO: 185100 - DNA, 37 bp, Artificial Sequence
  Synthetic oligonucleotide
gacaagcaggaacggacaggagaaagcaggatgcgga

SEQ ID NO: 185101 - DNA, 37 bp, Artificial Sequence
  Synthetic oligonucleotide
atgtcctcccaacccgtgcgtcctccccaattgcgga

SEQ ID NO: 185102 - DNA, 36 bp, Artificial Sequence
  Synthetic oligonucleotide
gcaaaaagggggagaattaggaaacatagagtcgga

SEQ ID NO: 185103 - DNA, 37 bp, Artificial Sequence
  Synthetic oligonucleotide
tactacaacgcttcgatgggtgcttgggtgggcggga

SEQ ID NO: 185104 - DNA, 37 bp, Artificial Sequence
  Synthetic oligonucleotide
gacgaagccgggggggggtgacgggcttatctgggga

SEQ ID NO: 185105 - DNA, 37 bp, Artificial Sequence
  Synthetic oligonucleotide
atcccaccccgctctgacatccagtactatgaatgga

SEQ ID NO: 185106 - DNA, 37 bp, Artificial Sequence
  Synthetic oligonucleotide
gaagggggggggcgcgaaaacagcagctctatctgga

SEQ ID NO: 185107 - DNA, 37 bp, Artificial Sequence
  Synthetic oligonucleotide
gcacggagagaggaatgaggggtacgtatgcagtgga

SEQ ID NO: 185108 - DNA, 37 bp, Artificial Sequence
  Synthetic oligonucleotide
gttctcacctcatcattgatttcgtaacacccttgga

SEQ ID NO: 185109 - DNA, 35 bp, Artificial Sequence
  Synthetic oligonucleotide
tattgggagggcgggagggcgtggccgtttaatga

SEQ ID NO: 185110 - DNA, 37 bp, Artificial Sequence
  Synthetic oligonucleotide
aactaagggggggatcacaggggcgggcaagagatga

SEQ ID NO: 185111 - DNA, 37 bp, Artificial Sequence
  Synthetic oligonucleotide
acccaacgccgccggattagccccaccccaaggatga

SEQ ID NO: 185112 - DNA, 38 bp, Artificial Sequence
  Synthetic oligonucleotide
acaccctcacgtgcgttaaaacgaccacacgcatatga

SEQ ID NO: 185113 - DNA, 37 bp, Artificial Sequence
  Synthetic oligonucleotide
gtgcacgagaggggatagaggtgacgggagggactga

SEQ ID NO: 185114 - DNA, 38 bp, Artificial Sequence
  Synthetic oligonucleotide
tctgcgtcccatctggctagattcacgcgctcccctga

SEQ ID NO: 185115 - DNA, 35 bp, Artificial Sequence
  Synthetic oligonucleotide
gacccaccgtagatctaacgcgaacgccttcctga

SEQ ID NO: 185116 - DNA, 38 bp, Artificial Sequence
  Synthetic oligonucleotide
tagaacaggggtgagggtggcataggatgcggggctga

SEQ ID NO: 185117 - DNA, 38 bp, Artificial Sequence
  Synthetic oligonucleotide
tgatggtggggggtggggggtcataaggacaaaagtga

SEQ ID NO: 185118 - DNA, 37 bp, Artificial Sequence
  Synthetic oligonucleotide
atatgcgcgtaagggaacggtgagcgggagggagtga

SEQ ID NO: 185119 - DNA, 38 bp, Artificial Sequence
  Synthetic oligonucleotide
tccgaccccttccctgatattgctcggactttccgtga

SEQ ID NO: 185120 - DNA, 37 bp, Artificial Sequence
  Synthetic oligonucleotide
attgcccccgccctcgtgcaccgtacaccggtcgtga

SEQ ID NO: 185121 - DNA, 37 bp, Artificial Sequence
  Synthetic oligonucleotide
gttgcacctcccgtccgtcaactcgtcccattcgtga

SEQ ID NO: 185122 - DNA, 38 bp, Artificial Sequence
  Synthetic oligonucleotide
tgacggtaggggaaatgatggtccgggcgggagggtga

SEQ ID NO: 185123 - DNA, 38 bp, Artificial Sequence
  Synthetic oligonucleotide
actgggggcataaaaggggcagccaacgggcggggtga

SEQ ID NO: 185124 - DNA, 38 bp, Artificial Sequence
  Synthetic oligonucleotide
ggggggaggtagccaagggtgggggtagcaatgggtga

SEQ ID NO: 185125 - DNA, 38 bp, Artificial Sequence
  Synthetic oligonucleotide
agccccggcagagaccttctccaccacccgtcctgtga

SEQ ID NO: 185126 - DNA, 38 bp, Artificial Sequence
  Synthetic oligonucleotide
ttggtcggttcgttatggtccgcgccccccctcattga

SEQ ID NO: 185127 - DNA, 37 bp, Artificial Sequence
  Synthetic oligonucleotide
gctgagcccttcgcgtagccgtgccactttttattga

SEQ ID NO: 185128 - DNA, 38 bp, Artificial Sequence
  Synthetic oligonucleotide
gcacgcggcgatcatcgtcctgttccctactcccttga

SEQ ID NO: 185129 - DNA, 36 bp, Artificial Sequence
  Synthetic oligonucleotide
gtgccaccgcccacattaacttcacttctagcttga

SEQ ID NO: 185130 - DNA, 36 bp, Artificial Sequence
  Synthetic oligonucleotide
gtccaccatcgtgccgcctagttgcacctatcttga

SEQ ID NO: 185131 - DNA, 38 bp, Artificial Sequence
  Synthetic oligonucleotide
tcacgtcttgtcgcctactccgccctgccaactcttga

SEQ ID NO: 185132 - DNA, 38 bp, Artificial Sequence
  Synthetic oligonucleotide
taacccccgcctcctgaagttgcatgagtgcactttga

SEQ ID NO: 185133 - DNA, 35 bp, Artificial Sequence
  Synthetic oligonucleotide
gcctgcacgtcgtttgcccctatgtttgcctttga

SEQ ID NO: 185134 - DNA, 38 bp, Artificial Sequence
  Synthetic oligonucleotide
gtccacctcacctttgcatctcccatgacaagttttga

SEQ ID NO: 185135 - DNA, 35 bp, Artificial Sequence
  Synthetic oligonucleotide
tgccactcccttgcccccgatacgtaggccgaata

SEQ ID NO: 185136 - DNA, 35 bp, Artificial Sequence
  Synthetic oligonucleotide
acatccctcagactacgcactcccactgtcgcata

SEQ ID NO: 185137 - DNA, 35 bp, Artificial Sequence
  Synthetic oligonucleotide
tgatggggggcaaaaaggagaaagcgacgttcata

SEQ ID NO: 185138 - DNA, 36 bp, Artificial Sequence
  Synthetic oligonucleotide
ttagcccttcagtaatgcacacgccgtcctctccta

SEQ ID NO: 185139 - DNA, 36 bp, Artificial Sequence
  Synthetic oligonucleotide
aatctgcaccaccatgtcgccctgcgctactagcta

SEQ ID NO: 185140 - DNA, 36 bp, Artificial Sequence
  Synthetic oligonucleotide
accacctccatcttcctgtatgccagaaaattgcta

SEQ ID NO: 185141 - DNA, 35 bp, Artificial Sequence
  Synthetic oligonucleotide
aaagcaactcggacggtccactgtgcccctctcta

SEQ ID NO: 185142 - DNA, 35 bp, Artificial Sequence
  Synthetic oligonucleotide
gactgtccgcccgtgtatgttccctgtctattcta

SEQ ID NO: 185143 - DNA, 36 bp, Artificial Sequence
  Synthetic oligonucleotide
gattggcccactctcgcttatatggctacactatta

SEQ ID NO: 185144 - DNA, 35 bp, Artificial Sequence
  Synthetic oligonucleotide
gacttccccgcctctgatcttgccacgcaaactta

SEQ ID NO: 185145 - DNA, 35 bp, Artificial Sequence
  Synthetic oligonucleotide
gccccaaccgcctccccgaatgctactggatctta

SEQ ID NO: 185146 - DNA, 38 bp, Artificial Sequence
  Synthetic oligonucleotide
ggggcggggacagctggggttcaaggtacagggggtta

SEQ ID NO: 185147 - DNA, 35 bp, Artificial Sequence
  Synthetic oligonucleotide
gtgacacactcctctccatcccggcctggtattta

SEQ ID NO: 185148 - DNA, 35 bp, Artificial Sequence
  Synthetic oligonucleotide
agctacgcccctccgattccaccggttcaccccac

SEQ ID NO: 185149 - DNA, 35 bp, Artificial Sequence
  Synthetic oligonucleotide
tgactccacatttgcgtgcgcttcctagactccac

SEQ ID NO: 185150 - DNA, 35 bp, Artificial Sequence
  Synthetic oligonucleotide
tcacctcacactcatcccggtccctgttagtagac

SEQ ID NO: 185151 - DNA, 35 bp, Artificial Sequence
  Synthetic oligonucleotide
gcactgttagtgtactgctgccccccgttccctac

SEQ ID NO: 185152 - DNA, 35 bp, Artificial Sequence
  Synthetic oligonucleotide
gctaccccagtcatcgcctcgtcttcgccacgtac

SEQ ID NO: 185153 - DNA, 35 bp, Artificial Sequence
  Synthetic oligonucleotide
acctgcgagctggcctgactcttcgcctcatttac

SEQ ID NO: 185154 - DNA, 34 bp, Artificial Sequence
  Synthetic oligonucleotide
agcacttccttcgccggtatgcaatagcaccacc

SEQ ID NO: 185155 - DNA, 35 bp, Artificial Sequence
  Synthetic oligonucleotide
tacacgtacagccctgattatccccgctcaccacc

SEQ ID NO: 185156 - DNA, 35 bp, Artificial Sequence
  Synthetic oligonucleotide
tgcacgccccatcgttcacataacccagccctacc

SEQ ID NO: 185157 - DNA, 35 bp, Artificial Sequence
  Synthetic oligonucleotide
gccgcatagctcccacgtggacctcattgcctacc

SEQ ID NO: 185158 - DNA, 35 bp, Artificial Sequence
  Synthetic oligonucleotide
gctggttggcctccgtgcgtccctttgcttgtacc

SEQ ID NO: 185159 - DNA, 35 bp, Artificial Sequence
  Synthetic oligonucleotide
ttggcctttcgcgcgttgttgactccccctttacc

SEQ ID NO: 185160 - DNA, 35 bp, Artificial Sequence
  Synthetic oligonucleotide
atttgcacagatgtcaacctctcattgcatcaccc

SEQ ID NO: 185161 - DNA, 35 bp, Artificial Sequence
  Synthetic oligonucleotide
atcttacctcagccgtttttggcactttatacccc

SEQ ID NO: 185162 - DNA, 35 bp, Artificial Sequence
  Synthetic oligonucleotide
acaatgcgcgcaattgactggttactgttcccccc

SEQ ID NO: 185163 - DNA, 35 bp, Artificial Sequence
  Synthetic oligonucleotide
acctgaccgtcacgggcccaccagaccactccccc

SEQ ID NO: 185164 - DNA, 35 bp, Artificial Sequence
  Synthetic oligonucleotide
gagatgcaccagctcgtgccgatccttccgacgcc

SEQ ID NO: 185165 - DNA, 35 bp, Artificial Sequence
  Synthetic oligonucleotide
gttcatgtctccgctctccatgttccgattgggcc

SEQ ID NO: 185166 - DNA, 35 bp, Artificial Sequence
  Synthetic oligonucleotide
tatccgctgctcccctgtactatcccttctgtgcc

SEQ ID NO: 185167 - DNA, 35 bp, Artificial Sequence
  Synthetic oligonucleotide
gaccccacccctgcttatagctgctcgctcgctcc

SEQ ID NO: 185168 - DNA, 35 bp, Artificial Sequence
  Synthetic oligonucleotide
tcctgggacgccacatgttctaactattcctgtcc

SEQ ID NO: 185169 - DNA, 35 bp, Artificial Sequence
  Synthetic oligonucleotide
tcccaacgaaacctagtgcgctcaaacccttgtcc

SEQ ID NO: 185170 - DNA, 35 bp, Artificial Sequence
  Synthetic oligonucleotide
taacgcggcggttcaaatggtcattctgtctttcc

SEQ ID NO: 185171 - DNA, 35 bp, Artificial Sequence
  Synthetic oligonucleotide
tcgcaccccctaccgtacttgagcttatgctgcgc

SEQ ID NO: 185172 - DNA, 35 bp, Artificial Sequence
  Synthetic oligonucleotide
tcccacctcatcagctttacgggcccccgaccggc

SEQ ID NO: 185173 - DNA, 35 bp, Artificial Sequence
  Synthetic oligonucleotide
gttacgtccacccgttacagtgcctcctacactgc

SEQ ID NO: 185174 - DNA, 35 bp, Artificial Sequence
  Synthetic oligonucleotide
acacgcccccgctcaatgcgattgcaacatcctgc

SEQ ID NO: 185175 - DNA, 35 bp, Artificial Sequence
  Synthetic oligonucleotide
ccgaacgcctgaacactgcgtaccaccactcctgc

SEQ ID NO: 185176 - DNA, 35 bp, Artificial Sequence
  Synthetic oligonucleotide
gtacacacagcatcaccagtccttggtttccactc

SEQ ID NO: 185177 - DNA, 35 bp, Artificial Sequence
  Synthetic oligonucleotide
ttcggtcaccgcgcattcttcgtaggccatcgctc

SEQ ID NO: 185178 - DNA, 35 bp, Artificial Sequence
  Synthetic oligonucleotide
gtacgtccccgctgcccctcaactatgtcctagtc

SEQ ID NO: 185179 - DNA, 35 bp, Artificial Sequence
  Synthetic oligonucleotide
atttcccgcccctcccatttagtaccgttaacgtc

SEQ ID NO: 185180 - DNA, 35 bp, Artificial Sequence
  Synthetic oligonucleotide
tgtcttcgtacagtcgtcatcccggccaccacgtc

SEQ ID NO: 185181 - DNA, 35 bp, Artificial Sequence
  Synthetic oligonucleotide
ttcgtcctagatccccgtccatactgagccctgtc

SEQ ID NO: 185182 - DNA, 34 bp, Artificial Sequence
  Synthetic oligonucleotide
gggccgccgcccgccttccttaatttccttcttc

SEQ ID NO: 185183 - DNA, 35 bp, Artificial Sequence
  Synthetic oligonucleotide
actgatctgccccgcgccttgtcataactatgttc

SEQ ID NO: 185184 - DNA, 35 bp, Artificial Sequence
  Synthetic oligonucleotide
gtcagaggcctgatcccttgcgccgtttacatttc

SEQ ID NO: 185185 - DNA, 35 bp, Artificial Sequence
  Synthetic oligonucleotide
tacccctctttgccctgtaacacgggactagtttc

SEQ ID NO: 185186 - DNA, 35 bp, Artificial Sequence
  Synthetic oligonucleotide
tgcccgccggtttattccatcgtccccggatcccg

SEQ ID NO: 185187 - DNA, 35 bp, Artificial Sequence
  Synthetic oligonucleotide
tgagcctgctcccgacctccgcgcccgaccctccg

SEQ ID NO: 185188 - DNA, 32 bp, Artificial Sequence
  Synthetic oligonucleotide
tgtgacttcggtccctatcgaccacccctccg

SEQ ID NO: 185189 - DNA, 35 bp, Artificial Sequence
  Synthetic oligonucleotide
gatgcggacagcgcgtacgaacctcactccctccg

SEQ ID NO: 185190 - DNA, 36 bp, Artificial Sequence
  Synthetic oligonucleotide
tactgcgagtcatgggtgtggtgggatggggtggcg

SEQ ID NO: 185191 - DNA, 35 bp, Artificial Sequence
  Synthetic oligonucleotide
gaccggtattactgtattcccccgccattgtttcg

SEQ ID NO: 185192 - DNA, 35 bp, Artificial Sequence
  Synthetic oligonucleotide
gccaggtgggaggggattaggggaggagctgacgg

SEQ ID NO: 185193 - DNA, 35 bp, Artificial Sequence
  Synthetic oligonucleotide
aaggacgtgagtacggggggaggtgacggtatcgg

SEQ ID NO: 185194 - DNA, 35 bp, Artificial Sequence
  Synthetic oligonucleotide
gccccatccctcgagcgccttgccgattccgttgg

SEQ ID NO: 185195 - DNA, 35 bp, Artificial Sequence
  Synthetic oligonucleotide
tcacgtctcaccgttgcttttccctcgcccccatg

SEQ ID NO: 185196 - DNA, 35 bp, Artificial Sequence
  Synthetic oligonucleotide
tacgaccgaccaaatgccgccctggactccccctg

SEQ ID NO: 185197 - DNA, 35 bp, Artificial Sequence
  Synthetic oligonucleotide
ttgctgtcagccattacaccctcctaatcgtgctg

SEQ ID NO: 185198 - DNA, 35 bp, Artificial Sequence
  Synthetic oligonucleotide
gctggcccatcctcatgcgttgagctactatcttg

SEQ ID NO: 185199 - DNA, 35 bp, Artificial Sequence
  Synthetic oligonucleotide
atcaccgctcccatcttattgacaatctcgacgat

SEQ ID NO: 185200 - DNA, 35 bp, Artificial Sequence
  Synthetic oligonucleotide
aaagggatgtagacgggggatgaaaaggaggcgat

SEQ ID NO: 185201 - DNA, 35 bp, Artificial Sequence
  Synthetic oligonucleotide
agggtgggagtagtcggtttatgggagggtgctat

SEQ ID NO: 185202 - DNA, 34 bp, Artificial Sequence
  Synthetic oligonucleotide
tgccacctgggtgcgggcatcacatcgggccact

SEQ ID NO: 185203 - DNA, 35 bp, Artificial Sequence
  Synthetic oligonucleotide
ttgactcacctgagttatgtgttcgctccatcact

SEQ ID NO: 185204 - DNA, 35 bp, Artificial Sequence
  Synthetic oligonucleotide
ttacttcagccgcaacggtcactttccctgcacct

SEQ ID NO: 185205 - DNA, 35 bp, Artificial Sequence
  Synthetic oligonucleotide
ggacgcacttgcttgcctcgcgattctccgcccct

SEQ ID NO: 185206 - DNA, 35 bp, Artificial Sequence
  Synthetic oligonucleotide
gtgagtcgtggctgctttttcgtttggcccctcct

SEQ ID NO: 185207 - DNA, 35 bp, Artificial Sequence
  Synthetic oligonucleotide
ttcgggccctccctcctggtccaatttctagagct

SEQ ID NO: 185208 - DNA, 35 bp, Artificial Sequence
  Synthetic oligonucleotide
gtcaccatcctcagtatgcagtgccaccttcatct

SEQ ID NO: 185209 - DNA, 35 bp, Artificial Sequence
  Synthetic oligonucleotide
gctgtaggcttgactgcacatttttacatctctct

SEQ ID NO: 185210 - DNA, 35 bp, Artificial Sequence
  Synthetic oligonucleotide
cacgagctcaccagacgtctttgggccctctctct

SEQ ID NO: 185211 - DNA, 35 bp, Artificial Sequence
  Synthetic oligonucleotide
gggtcatggcctgcttttacttcccgatcttgtct

SEQ ID NO: 185212 - DNA, 35 bp, Artificial Sequence
  Synthetic oligonucleotide
gacgttcacgcaatcccacgggtcacgccacttct

SEQ ID NO: 185213 - DNA, 35 bp, Artificial Sequence
  Synthetic oligonucleotide
ttcgttcgctccggtattcgtccctgctcctccgt

SEQ ID NO: 185214 - DNA, 36 bp, Artificial Sequence
  Synthetic oligonucleotide
gttgttccagcgtacaactgttacctctttcctcgt

SEQ ID NO: 185215 - DNA, 35 bp, Artificial Sequence
  Synthetic oligonucleotide
attgtggagaggggcctaatgttgggtgggagggt

SEQ ID NO: 185216 - DNA, 34 bp, Artificial Sequence
  Synthetic oligonucleotide
acccccccgccgcctaatgctcctatacgctggt

SEQ ID NO: 185217 - DNA, 35 bp, Artificial Sequence
  Synthetic oligonucleotide
tgcccgccctcctccgtttcagctccccctctggt

SEQ ID NO: 185218 - DNA, 35 bp, Artificial Sequence
  Synthetic oligonucleotide
acaccccgcccactatacgatggtgctcctgaatt

SEQ ID NO: 185219 - DNA, 35 bp, Artificial Sequence
  Synthetic oligonucleotide
aactgcctcacttcgacgcctgcccatgcaaactt

SEQ ID NO: 185220 - DNA, 35 bp, Artificial Sequence
  Synthetic oligonucleotide
tcaccacgtgaggcagtaaatcactataggccctt

SEQ ID NO: 185221 - DNA, 35 bp, Artificial Sequence
  Synthetic oligonucleotide
atcaactccctccggctgccccccgctagttgttt

SEQ ID NO: 185222 - DNA, 35 bp, Artificial Sequence
  Synthetic oligonucleotide
gtaccccgcctgtatatatactgcccgcccctttt

SEQ ID NO: 185223 - DNA, 35 bp, Artificial Sequence
  Synthetic oligonucleotide
agccacaagcacttgcgcgtaatgcctctcttcaa

SEQ ID NO: 185224 - DNA, 35 bp, Artificial Sequence
  Synthetic oligonucleotide
tttggccactccgccttaccttccgcctgcacgaa

SEQ ID NO: 185225 - DNA, 36 bp, Artificial Sequence
  Synthetic oligonucleotide
tctcatctccgcctccgtagtttcgtagcccttgaa

SEQ ID NO: 185226 - DNA, 36 bp, Artificial Sequence
  Synthetic oligonucleotide
gttgcctcatccgagtgacgccatgccctgccctaa

SEQ ID NO: 185227 - DNA, 36 bp, Artificial Sequence
  Synthetic oligonucleotide
tgcacatcctattttggccattcgactacaagcaca

SEQ ID NO: 185228 - DNA, 35 bp, Artificial Sequence
  Synthetic oligonucleotide
tcctcccactcgccacaatcggtccacaggggaca

SEQ ID NO: 185229 - DNA, 35 bp, Artificial Sequence
  Synthetic oligonucleotide
acgcacaggccttggttatgcgccatcctcataca

SEQ ID NO: 185230 - DNA, 35 bp, Artificial Sequence
  Synthetic oligonucleotide
atacacgggtgcgggttgagggcggggggagtaca

SEQ ID NO: 185231 - DNA, 36 bp, Artificial Sequence
  Synthetic oligonucleotide
tcgtccaaccaccaggtgccctcattccgtcttaca

SEQ ID NO: 185232 - DNA, 36 bp, Artificial Sequence
  Synthetic oligonucleotide
ttctgtcacgcccacctgagtgctcgatgcccccca

SEQ ID NO: 185233 - DNA, 36 bp, Artificial Sequence
  Synthetic oligonucleotide
gacttcccccagttttagtacttgaaagccgcccca

SEQ ID NO: 185234 - DNA, 36 bp, Artificial Sequence
  Synthetic oligonucleotide
tactgctgccattattgccctccgtgctcagtccca

SEQ ID NO: 185235 - DNA, 36 bp, Artificial Sequence
  Synthetic oligonucleotide
gcgaaagcacgccaatttagcggccctgttttccca

SEQ ID NO: 185236 - DNA, 36 bp, Artificial Sequence
  Synthetic oligonucleotide
gtgtccacccaggcaggtattcaatttagtccgcca

SEQ ID NO: 185237 - DNA, 36 bp, Artificial Sequence
  Synthetic oligonucleotide
ataccccgcacattttatcgctcgactaccctgcca

SEQ ID NO: 185238 - DNA, 35 bp, Artificial Sequence
  Synthetic oligonucleotide
gcaattgtgggcgggacgggatgggctgagatcca

SEQ ID NO: 185239 - DNA, 36 bp, Artificial Sequence
  Synthetic oligonucleotide
tctcgcattgctgccgtcggttccgctaccactcca

SEQ ID NO: 185240 - DNA, 36 bp, Artificial Sequence
  Synthetic oligonucleotide
tacctgcctcatgttgctctccttgccgtccctcca

SEQ ID NO: 185241 - DNA, 36 bp, Artificial Sequence
  Synthetic oligonucleotide
gcatccctccgcccgcaaactggaacttctcacgca

SEQ ID NO: 185242 - DNA, 35 bp, Artificial Sequence
  Synthetic oligonucleotide
gccaccctcagacttccgcattctgcctttacgca

SEQ ID NO: 185243 - DNA, 35 bp, Artificial Sequence
  Synthetic oligonucleotide
gttggggggggtgagagggaattccgtagggtgca

SEQ ID NO: 185244 - DNA, 36 bp, Artificial Sequence
  Synthetic oligonucleotide
tagaacaggcgtccatcggatcacccctgccactca

SEQ ID NO: 185245 - DNA, 33 bp, Artificial Sequence
  Synthetic oligonucleotide
tcctccgcagcaccatttcctactcgtgcttca

SEQ ID NO: 185246 - DNA, 36 bp, Artificial Sequence
  Synthetic oligonucleotide
ttatccaactggtccgttgcctttgcgccactttca

SEQ ID NO: 185247 - DNA, 37 bp, Artificial Sequence
  Synthetic oligonucleotide
gacgaaagaaggggggcactagagtcagggggtcaga

SEQ ID NO: 185248 - DNA, 37 bp, Artificial Sequence
  Synthetic oligonucleotide
taagacaaggaggatataggtggagtgggtacggaga

SEQ ID NO: 185249 - DNA, 37 bp, Artificial Sequence
  Synthetic oligonucleotide
tcggtgatgggcggagagggaggggtcagtccggaga

SEQ ID NO: 185250 - DNA, 34 bp, Artificial Sequence
  Synthetic oligonucleotide
tcgatccatgcccccgccgtatctcttctttaga

SEQ ID NO: 185251 - DNA, 36 bp, Artificial Sequence
  Synthetic oligonucleotide
tgacatgtcctgcctccacctgcccctcgtgaacga

SEQ ID NO: 185252 - DNA, 37 bp, Artificial Sequence
  Synthetic oligonucleotide
tccgccaccccatcgccctgcgcgccggtcttcacga

SEQ ID NO: 185253 - DNA, 37 bp, Artificial Sequence
  Synthetic oligonucleotide
atgtcaccgatgcccggcttttctacactcgtcccga

SEQ ID NO: 185254 - DNA, 36 bp, Artificial Sequence
  Synthetic oligonucleotide
tcacgatctacgtcccatggctctcctacgttccga

SEQ ID NO: 185255 - DNA, 37 bp, Artificial Sequence
  Synthetic oligonucleotide
acatccctctcccgtcacgtttccgcccattcggcga

SEQ ID NO: 185256 - DNA, 37 bp, Artificial Sequence
  Synthetic oligonucleotide
tgctccaccgtactcacctacccgacactctcatcga

SEQ ID NO: 185257 - DNA, 37 bp, Artificial Sequence
  Synthetic oligonucleotide
gaagggtcggtaaggggaggtggaggtgagcgatcga

SEQ ID NO: 185258 - DNA, 35 bp, Artificial Sequence
  Synthetic oligonucleotide
tgctgcccccgctctttgatttcccggcttatcga

SEQ ID NO: 185259 - DNA, 35 bp, Artificial Sequence
  Synthetic oligonucleotide
gtcgccaccggtacctctacacacatacgcctcga

SEQ ID NO: 185260 - DNA, 36 bp, Artificial Sequence
  Synthetic oligonucleotide
gaagccaattgatttacgctgaccccctcctctcga

SEQ ID NO: 185261 - DNA, 37 bp, Artificial Sequence
  Synthetic oligonucleotide
taggtggggagtagcgaaggaaaggggcacaggtcga

SEQ ID NO: 185262 - DNA, 37 bp, Artificial Sequence
  Synthetic oligonucleotide
gcatcttaccgcacgtgtacatcatcaccctcttcga

SEQ ID NO: 185263 - DNA, 37 bp, Artificial Sequence
  Synthetic oligonucleotide
tgccgcctccgcttccatctggttcaaactggttcga

SEQ ID NO: 185264 - DNA, 37 bp, Artificial Sequence
  Synthetic oligonucleotide
tgcaagccgcgtgcgtctacgttcttccctggttcga

SEQ ID NO: 185265 - DNA, 36 bp, Artificial Sequence
  Synthetic oligonucleotide
gccgctccgggttgggtagggcgggaggacatagga

SEQ ID NO: 185266 - DNA, 37 bp, Artificial Sequence
  Synthetic oligonucleotide
gcgcaagtactccctccgccctcccgatgaattcgga

SEQ ID NO: 185267 - DNA, 36 bp, Artificial Sequence
  Synthetic oligonucleotide
taccacctcctcaccatctccgaatcccatacggga

SEQ ID NO: 185268 - DNA, 37 bp, Artificial Sequence
  Synthetic oligonucleotide
ggtgcagagctgaggggagtagtaggggtgtacggga

SEQ ID NO: 185269 - DNA, 37 bp, Artificial Sequence
  Synthetic oligonucleotide
gggacgggaacgggggggtgctcaggcgtcgcgggga

SEQ ID NO: 185270 - DNA, 37 bp, Artificial Sequence
  Synthetic oligonucleotide
atgggttgggggcgagactagggggatcatgcgggga

SEQ ID NO: 185271 - DNA, 37 bp, Artificial Sequence
  Synthetic oligonucleotide
taaatgcggggaggaaagtaagacaagggacggggga

SEQ ID NO: 185272 - DNA, 36 bp, Artificial Sequence
  Synthetic oligonucleotide
tcacccagggtggggcgtggggttcataactgggga

SEQ ID NO: 185273 - DNA, 37 bp, Artificial Sequence
  Synthetic oligonucleotide
ggggacgctgaccaggagggggggttggcggttggga

SEQ ID NO: 185274 - DNA, 37 bp, Artificial Sequence
  Synthetic oligonucleotide
gatccctcaatccctctatggacactctcattctgga

SEQ ID NO: 185275 - DNA, 38 bp, Artificial Sequence
  Synthetic oligonucleotide
gccctctgccctctcacgttccaccatgtctttaatga

SEQ ID NO: 185276 - DNA, 38 bp, Artificial Sequence
  Synthetic oligonucleotide
atgccctacccctgcttattttcatgctccctgcatga

SEQ ID NO: 185277 - DNA, 37 bp, Artificial Sequence
  Synthetic oligonucleotide
agccatcggcggggagggagggataatggggtgatga

SEQ ID NO: 185278 - DNA, 37 bp, Artificial Sequence
  Synthetic oligonucleotide
ttggacgcggaaaacttggaacgggcggtggagctga

SEQ ID NO: 185279 - DNA, 38 bp, Artificial Sequence
  Synthetic oligonucleotide
atttgggaggaacgggtgacatagaggagggggagtga

SEQ ID NO: 185280 - DNA, 38 bp, Artificial Sequence
  Synthetic oligonucleotide
agtctggcccgcttgtcattctcgcctgctctccgtga

SEQ ID NO: 185281 - DNA, 37 bp, Artificial Sequence
  Synthetic oligonucleotide
tccgcccctcccagatcgatccatcgcccccctgtga

SEQ ID NO: 185282 - DNA, 38 bp, Artificial Sequence
  Synthetic oligonucleotide
tgcccgccctctcgtgcatccgacctatcccggtgtga

SEQ ID NO: 185283 - DNA, 38 bp, Artificial Sequence
  Synthetic oligonucleotide
aatgtgggcggagggtgggcgtggcccgttgcaattga

SEQ ID NO: 185284 - DNA, 38 bp, Artificial Sequence
  Synthetic oligonucleotide
ggatgcgtacgctttgtttcctgccacccgccgattga

SEQ ID NO: 185285 - DNA, 38 bp, Artificial Sequence
  Synthetic oligonucleotide
tctcgaccacccgccttgacattcgttgaccctattga

SEQ ID NO: 185286 - DNA, 38 bp, Artificial Sequence
  Synthetic oligonucleotide
tcagctctcgacacatgccactactcgaacctccttga

SEQ ID NO: 185287 - DNA, 36 bp, Artificial Sequence
  Synthetic oligonucleotide
gcaaacggaagccggagggagcgggttatgggttga

SEQ ID NO: 185288 - DNA, 38 bp, Artificial Sequence
  Synthetic oligonucleotide
tcaccgttcctcgttatttccgctctcgtacactttga

SEQ ID NO: 185289 - DNA, 38 bp, Artificial Sequence
  Synthetic oligonucleotide
gaagcacccctgcgctatttttttcagtccggttttga

SEQ ID NO: 185290 - DNA, 36 bp, Artificial Sequence
  Synthetic oligonucleotide
ttccgtgttcgcctctctgctgttcttgtctcgata

SEQ ID NO: 185291 - DNA, 36 bp, Artificial Sequence
  Synthetic oligonucleotide
atcagaccgctgctggggaggggggggagttggata

SEQ ID NO: 185292 - DNA, 35 bp, Artificial Sequence
  Synthetic oligonucleotide
tccgcgctgggattgccggctccatcactccacta

SEQ ID NO: 185293 - DNA, 35 bp, Artificial Sequence
  Synthetic oligonucleotide
gtttgcctgccccatttccccctgttcgttcacta

SEQ ID NO: 185294 - DNA, 35 bp, Artificial Sequence
  Synthetic oligonucleotide
gccatgcttgcgagttctaagcctagcccccccta

SEQ ID NO: 185295 - DNA, 35 bp, Artificial Sequence
  Synthetic oligonucleotide
gaccgccgttacacctcagtggtcgcttcccccta

SEQ ID NO: 185296 - DNA, 35 bp, Artificial Sequence
  Synthetic oligonucleotide
ttgagcccccattccgtgcgcattctcccccgcta

SEQ ID NO: 185297 - DNA, 36 bp, Artificial Sequence
  Synthetic oligonucleotide
gcacaacatctgccccctaatacagctatgcttcta

SEQ ID NO: 185298 - DNA, 36 bp, Artificial Sequence
  Synthetic oligonucleotide
acgaatgtcgtacatgagtttgtcacctcttccgta

SEQ ID NO: 185299 - DNA, 35 bp, Artificial Sequence
  Synthetic oligonucleotide
ttgggctcagcacttttgggaccgcccctctcgta

SEQ ID NO: 185300 - DNA, 36 bp, Artificial Sequence
  Synthetic oligonucleotide
cccggaccgcccgctcgttacggttgatttctcgta

SEQ ID NO: 185301 - DNA, 36 bp, Artificial Sequence
  Synthetic oligonucleotide
aattgggacgcggggaaggggaagtggggcgcggac

SEQ ID NO: 185302 - DNA, 35 bp, Artificial Sequence
  Synthetic oligonucleotide
tgaaaccaccctcacgaactgtccaacttgggtac

SEQ ID NO: 185303 - DNA, 35 bp, Artificial Sequence
  Synthetic oligonucleotide
actacaccctacatgtatatcacctctcgacttac

SEQ ID NO: 185304 - DNA, 35 bp, Artificial Sequence
  Synthetic oligonucleotide
gtgtgcacgaacaggctccttcctcttcgttaacc

SEQ ID NO: 185305 - DNA, 35 bp, Artificial Sequence
  Synthetic oligonucleotide
accccatgacagttgctctgtctacccgactcacc

SEQ ID NO: 185306 - DNA, 35 bp, Artificial Sequence
  Synthetic oligonucleotide
tgtctcccccaaccctgtaccgcctgggctcgacc

SEQ ID NO: 185307 - DNA, 35 bp, Artificial Sequence
  Synthetic oligonucleotide
aaggtgctcagcgtttacttccatgcaccccgccc

SEQ ID NO: 185308 - DNA, 35 bp, Artificial Sequence
  Synthetic oligonucleotide
tgcgaggcctgtcctgtttcgctctatagattccc

SEQ ID NO: 185309 - DNA, 35 bp, Artificial Sequence
  Synthetic oligonucleotide
ttgccttaaacccctcgtcagatccgcttcccgcc

SEQ ID NO: 185310 - DNA, 35 bp, Artificial Sequence
  Synthetic oligonucleotide
tcatgcgtcccatctaaatctcgccgcttctcgcc

SEQ ID NO: 185311 - DNA, 35 bp, Artificial Sequence
  Synthetic oligonucleotide
tctgatcctccatcggtctcttctctccagtcgcc

SEQ ID NO: 185312 - DNA, 35 bp, Artificial Sequence
  Synthetic oligonucleotide
gcagccccggccctttttgtaccggtactcctgcc

SEQ ID NO: 185313 - DNA, 35 bp, Artificial Sequence
  Synthetic oligonucleotide
tcctgttagccgcctagcccggtgttcttctatcc

SEQ ID NO: 185314 - DNA, 35 bp, Artificial Sequence
  Synthetic oligonucleotide
tgaccctcgcatcgcttgctgccctcgcagactcc

SEQ ID NO: 185315 - DNA, 35 bp, Artificial Sequence
  Synthetic oligonucleotide
atgccccatcactcgtctggagatgccattcctcc

SEQ ID NO: 185316 - DNA, 35 bp, Artificial Sequence
  Synthetic oligonucleotide
acgaaggcgacgcacgtacccttcttccgcattcc

SEQ ID NO: 185317 - DNA, 35 bp, Artificial Sequence
  Synthetic oligonucleotide
accctcactcgcgtgttgcatattttccgattcgc

SEQ ID NO: 185318 - DNA, 35 bp, Artificial Sequence
  Synthetic oligonucleotide
gcgcgctggtatatcttctgccctttgtggttcgc

SEQ ID NO: 185319 - DNA, 35 bp, Artificial Sequence
  Synthetic oligonucleotide
ttcccccccgaccatgccgcctcactagctaatgc

SEQ ID NO: 185320 - DNA, 35 bp, Artificial Sequence
  Synthetic oligonucleotide
aagccacgtaggctcatattagcgctaacaccatc

SEQ ID NO: 185321 - DNA, 35 bp, Artificial Sequence
  Synthetic oligonucleotide
ggtcctgccccgcctgttgttatacttataccatc

SEQ ID NO: 185322 - DNA, 35 bp, Artificial Sequence
  Synthetic oligonucleotide
ggaccgtcgtttagttgccccattccaccatcatc

SEQ ID NO: 185323 - DNA, 35 bp, Artificial Sequence
  Synthetic oligonucleotide
ttaggctggtctccccgggtcgctatactctcatc

SEQ ID NO: 185324 - DNA, 35 bp, Artificial Sequence
  Synthetic oligonucleotide
tcactcctcgctctccaggtcccttgatcggactc

SEQ ID NO: 185325 - DNA, 35 bp, Artificial Sequence
  Synthetic oligonucleotide
gacagtgcggttgggtccgcttcatacttcacctc

SEQ ID NO: 185326 - DNA, 35 bp, Artificial Sequence
  Synthetic oligonucleotide
gtgtatccggtccggtgcttttgactgtcgccctc

SEQ ID NO: 185327 - DNA, 35 bp, Artificial Sequence
  Synthetic oligonucleotide
agattcaccgctgcctgctacttaagccctcgctc

SEQ ID NO: 185328 - DNA, 35 bp, Artificial Sequence
  Synthetic oligonucleotide
agacgctgcccaaacccttgttctctccagctctc

SEQ ID NO: 185329 - DNA, 35 bp, Artificial Sequence
  Synthetic oligonucleotide
tgatgcccttcgcacttgtttttttgctacgtctc

SEQ ID NO: 185330 - DNA, 35 bp, Artificial Sequence
  Synthetic oligonucleotide
tataccgtcacaattgttccatcttttcgcttctc

SEQ ID NO: 185331 - DNA, 35 bp, Artificial Sequence
  Synthetic oligonucleotide
accccgtaacgctaatgctccctttgctacatgtc

SEQ ID NO: 185332 - DNA, 35 bp, Artificial Sequence
  Synthetic oligonucleotide
tccccgcgaccataaggatcgcttttcatctcttc

SEQ ID NO: 185333 - DNA, 35 bp, Artificial Sequence
  Synthetic oligonucleotide
ttgcaactgctgacgatcatagcttccacctgttc

SEQ ID NO: 185334 - DNA, 35 bp, Artificial Sequence
  Synthetic oligonucleotide
tgtcggaaccaccctgctctatcctcactatacag

SEQ ID NO: 185335 - DNA, 35 bp, Artificial Sequence
  Synthetic oligonucleotide
ggtgctggaagggcgtaaggggggatgccgcgtag

SEQ ID NO: 185336 - DNA, 35 bp, Artificial Sequence
  Synthetic oligonucleotide
gattgcccgccctcaaatcgagtttgtacaccacg

SEQ ID NO: 185337 - DNA, 35 bp, Artificial Sequence
  Synthetic oligonucleotide
atgaccagacagccttcatccaacgatccgctccg

SEQ ID NO: 185338 - DNA, 33 bp, Artificial Sequence
  Synthetic oligonucleotide
attccttgcatccctggtcttctccggtctccg

SEQ ID NO: 185339 - DNA, 35 bp, Artificial Sequence
  Synthetic oligonucleotide
acgtcacataccctgcctagaacgctctctgtccg

SEQ ID NO: 185340 - DNA, 35 bp, Artificial Sequence
  Synthetic oligonucleotide
gtcagtagctctggtcctcgcctgttctcttcgcg

SEQ ID NO: 185341 - DNA, 35 bp, Artificial Sequence
  Synthetic oligonucleotide
gaagggtgaggcgagggggaacaactaagcgtgcg

SEQ ID NO: 185342 - DNA, 35 bp, Artificial Sequence
  Synthetic oligonucleotide
gtcacattagcctcgatttctatcagcccccctcg

SEQ ID NO: 185343 - DNA, 35 bp, Artificial Sequence
  Synthetic oligonucleotide
atccccaccctcctccaatgaccgtttaatcttcg

SEQ ID NO: 185344 - DNA, 35 bp, Artificial Sequence
  Synthetic oligonucleotide
gctacggccacctcgcgttcctggtgccctcttcg

SEQ ID NO: 185345 - DNA, 35 bp, Artificial Sequence
  Synthetic oligonucleotide
gtccaccgacttcttgaatccgcatcccgccccgg

SEQ ID NO: 185346 - DNA, 35 bp, Artificial Sequence
  Synthetic oligonucleotide
tccagacgcccgcctcattctcgcctctttccatg

SEQ ID NO: 185347 - DNA, 35 bp, Artificial Sequence
  Synthetic oligonucleotide
tcccgcctctctggtcctattactgtccacaactg

SEQ ID NO: 185348 - DNA, 35 bp, Artificial Sequence
  Synthetic oligonucleotide
tcgaccccttcgtgcagtttctctccttccagctg

SEQ ID NO: 185349 - DNA, 35 bp, Artificial Sequence
  Synthetic oligonucleotide
attcccccgggtcccactactacctatcagctgtg

SEQ ID NO: 185350 - DNA, 35 bp, Artificial Sequence
  Synthetic oligonucleotide
gcattgcgtactttagtgttttattccggccctat

SEQ ID NO: 185351 - DNA, 35 bp, Artificial Sequence
  Synthetic oligonucleotide
tcaccgtatgttgctgtgggccggcttcgccttat

SEQ ID NO: 185352 - DNA, 35 bp, Artificial Sequence
  Synthetic oligonucleotide
tgcccccacctcgggtctgaacctggtttacaact

SEQ ID NO: 185353 - DNA, 35 bp, Artificial Sequence
  Synthetic oligonucleotide
tagtgcccccaacttctcctgatgagactctccct

SEQ ID NO: 185354 - DNA, 35 bp, Artificial Sequence
  Synthetic oligonucleotide
tgtcacatcaccgctacaaccttccccgggtccct

SEQ ID NO: 185355 - DNA, 35 bp, Artificial Sequence
  Synthetic oligonucleotide
gcacgtcggtactccgttgacgtctctttccgcct

SEQ ID NO: 185356 - DNA, 35 bp, Artificial Sequence
  Synthetic oligonucleotide
tgcaacgtccaatcctttttcccactagcctgcct

SEQ ID NO: 185357 - DNA, 35 bp, Artificial Sequence
  Synthetic oligonucleotide
tccatcttgtgcgttcgcttgctcattacactcct

SEQ ID NO: 185358 - DNA, 35 bp, Artificial Sequence
  Synthetic oligonucleotide
tcacgctcatatgtcatcccattttgcaattcgct

SEQ ID NO: 185359 - DNA, 35 bp, Artificial Sequence
  Synthetic oligonucleotide
gtgacaggccacattgccacacccttcgccactct

SEQ ID NO: 185360 - DNA, 35 bp, Artificial Sequence
  Synthetic oligonucleotide
gtcccgtattcgaccgtgcgctacaagcctcctct

SEQ ID NO: 185361 - DNA, 35 bp, Artificial Sequence
  Synthetic oligonucleotide
gactcgttcatctgtttctttctgctccgggctct

SEQ ID NO: 185362 - DNA, 35 bp, Artificial Sequence
  Synthetic oligonucleotide
attgcgctgtcaatttcccttctgtttgcttcggt

SEQ ID NO: 185363 - DNA, 35 bp, Artificial Sequence
  Synthetic oligonucleotide
atgttcaccgctgcattctcccatgtacactttgt

SEQ ID NO: 185364 - DNA, 35 bp, Artificial Sequence
  Synthetic oligonucleotide
gagcagaactgctgcttcgttctgttactcccatt

SEQ ID NO: 185365 - DNA, 35 bp, Artificial Sequence
  Synthetic oligonucleotide
ttgagtacgccatggtacttcctctcatactcctt

SEQ ID NO: 185366 - DNA, 35 bp, Artificial Sequence
  Synthetic oligonucleotide
tcccttgcacactctgactgcccctcggtctcctt

SEQ ID NO: 185367 - DNA, 35 bp, Artificial Sequence
  Synthetic oligonucleotide
taacactcgcaggtatgtcactcttcaggcctctt

SEQ ID NO: 185368 - DNA, 35 bp, Artificial Sequence
  Synthetic oligonucleotide
accgccgcctgccgaccactagatcctattacgtt

SEQ ID NO: 185369 - DNA, 35 bp, Artificial Sequence
  Synthetic oligonucleotide
tcccaccgcctctgtatcagcctcggccttaattt

SEQ ID NO: 185370 - DNA, 35 bp, Artificial Sequence
  Synthetic oligonucleotide
gatccacacccctatgtctcatcagaattaatttt

SEQ ID NO: 185371 - DNA, 33 bp, Artificial Sequence
  Synthetic oligonucleotide
acatccgtgacatctatcattatgctcattttt

SEQ ID NO: 185372 - DNA, 35 bp, Artificial Sequence
  Synthetic oligonucleotide
tgtggccctgccgtgtcgtgcatcttctttttttt

SEQ ID NO: 185373 - DNA, 36 bp, Artificial Sequence
  Synthetic oligonucleotide
gatggggtaggtgatgggggcatttagggagcagaa

SEQ ID NO: 185374 - DNA, 35 bp, Artificial Sequence
  Synthetic oligonucleotide
tcccgacggcgatcgtgttcccacccacacccgaa

SEQ ID NO: 185375 - DNA, 35 bp, Artificial Sequence
  Synthetic oligonucleotide
taggatgaaagggatggcttgaacggaaggaggaa

SEQ ID NO: 185376 - DNA, 36 bp, Artificial Sequence
  Synthetic oligonucleotide
aacatagaggtgaggaaagggtcggaggtgagggaa

SEQ ID NO: 185377 - DNA, 36 bp, Artificial Sequence
  Synthetic oligonucleotide
attcgccctcctcacgcctcagacagagccaaaaca

SEQ ID NO: 185378 - DNA, 36 bp, Artificial Sequence
  Synthetic oligonucleotide
tcaccacgtggtttgttcttctgcattctcgccaca

SEQ ID NO: 185379 - DNA, 36 bp, Artificial Sequence
  Synthetic oligonucleotide
ttgacagtcgccgttttctacccgccgtagcctaca

SEQ ID NO: 185380 - DNA, 35 bp, Artificial Sequence
  Synthetic oligonucleotide
gtggcacgccactttcgtccttccccgctcttaca

SEQ ID NO: 185381 - DNA, 36 bp, Artificial Sequence
  Synthetic oligonucleotide
tcctgacaacaaactccctctcctgtgttcggacca

SEQ ID NO: 185382 - DNA, 35 bp, Artificial Sequence
  Synthetic oligonucleotide
acccccacccttgtatgtctgtcgtttacccgcca

SEQ ID NO: 185383 - DNA, 36 bp, Artificial Sequence
  Synthetic oligonucleotide
ttgtgcatcccgcacctgtgctttccatactggcca

SEQ ID NO: 185384 - DNA, 35 bp, Artificial Sequence
  Synthetic oligonucleotide
ttcgccttccctgagttcaattctcgtgttttcca

SEQ ID NO: 185385 - DNA, 36 bp, Artificial Sequence
  Synthetic oligonucleotide
actcatcccaccaccctctgatctacgcctcgggca

SEQ ID NO: 185386 - DNA, 36 bp, Artificial Sequence
  Synthetic oligonucleotide
tgctctcccgccgcccccacggtccttgctgttgca

SEQ ID NO: 185387 - DNA, 35 bp, Artificial Sequence
  Synthetic oligonucleotide
gcaaccgccgatccgccttccctgggtaaccctca

SEQ ID NO: 185388 - DNA, 36 bp, Artificial Sequence
  Synthetic oligonucleotide
tctgcacatatgttcaacatcgctgcccttctctca

SEQ ID NO: 185389 - DNA, 36 bp, Artificial Sequence
  Synthetic oligonucleotide
tgagcgtgcgccgcgactcatcaccatctaccttca

SEQ ID NO: 185390 - DNA, 35 bp, Artificial Sequence
  Synthetic oligonucleotide
acacgtcaatagatccggtacgtcctgcctcttca

SEQ ID NO: 185391 - DNA, 36 bp, Artificial Sequence
  Synthetic oligonucleotide
tgtcgcccgccccctgtccttagcttaacaacaaga

SEQ ID NO: 185392 - DNA, 37 bp, Artificial Sequence
  Synthetic oligonucleotide
gagaggggtgggggagactacgggctggaggataaga

SEQ ID NO: 185393 - DNA, 37 bp, Artificial Sequence
  Synthetic oligonucleotide
gaggatgggggtttaggagggagtaggacagtgcaga

SEQ ID NO: 185394 - DNA, 34 bp, Artificial Sequence
  Synthetic oligonucleotide
gaaagggggggagacgggtaaaggccaagagaga

SEQ ID NO: 185395 - DNA, 36 bp, Artificial Sequence
  Synthetic oligonucleotide
gatgcgccaggggaggaagaatgaaatgagcggaga

SEQ ID NO: 185396 - DNA, 37 bp, Artificial Sequence
  Synthetic oligonucleotide
gcaagcgatggaaagggcactgaggaaggggtgtaga

SEQ ID NO: 185397 - DNA, 35 bp, Artificial Sequence
  Synthetic oligonucleotide
gcccgcccatttcaccaccctgttcattacgacga

SEQ ID NO: 185398 - DNA, 37 bp, Artificial Sequence
  Synthetic oligonucleotide
tttagcccaatgttccgccgtgccttccctgtcccga

SEQ ID NO: 185399 - DNA, 37 bp, Artificial Sequence
  Synthetic oligonucleotide
tcttaccgtcgctgtcctctccgcctcgcaaggccga

SEQ ID NO: 185400 - DNA, 36 bp, Artificial Sequence
  Synthetic oligonucleotide
acgccacccgcccgctctgtaatttagtacctccga

SEQ ID NO: 185401 - DNA, 37 bp, Artificial Sequence
  Synthetic oligonucleotide
tgaagcgcaccactcagatgcttcatccgccctccga

SEQ ID NO: 185402 - DNA, 37 bp, Artificial Sequence
  Synthetic oligonucleotide
accccacccatcagccggcatgcgatacggtttccga

SEQ ID NO: 185403 - DNA, 37 bp, Artificial Sequence
  Synthetic oligonucleotide
taggaaggtgaagggagtaagttagggtaaacggcga

SEQ ID NO: 185404 - DNA, 37 bp, Artificial Sequence
  Synthetic oligonucleotide
atctggaagtaggagggatgaagggaaaagcgggcga

SEQ ID NO: 185405 - DNA, 37 bp, Artificial Sequence
  Synthetic oligonucleotide
gacgtgtcacggggatcgcggtgagagcggggggcga

SEQ ID NO: 185406 - DNA, 37 bp, Artificial Sequence
  Synthetic oligonucleotide
gggtgggcggtgggcgggcctaaaacacgtactgcga

SEQ ID NO: 185407 - DNA, 37 bp, Artificial Sequence
  Synthetic oligonucleotide
tgcctgccaatttatgttcctattagccccctctcga

SEQ ID NO: 185408 - DNA, 37 bp, Artificial Sequence
  Synthetic oligonucleotide
ttcccgcccttcaacgatccatccagtgccccttcga

SEQ ID NO: 185409 - DNA, 37 bp, Artificial Sequence
  Synthetic oligonucleotide
cccaactgtccctccctattcgtgctctgtctcagga

SEQ ID NO: 185410 - DNA, 37 bp, Artificial Sequence
  Synthetic oligonucleotide
tttccgccccacatactgtttgcccagcccctgagga

SEQ ID NO: 185411 - DNA, 37 bp, Artificial Sequence
  Synthetic oligonucleotide
tagcgcctccgcaagctgctacccgacccctttagga

SEQ ID NO: 185412 - DNA, 36 bp, Artificial Sequence
  Synthetic oligonucleotide
gtaacgtgagtcggttatcaggggaggaggagcgga

SEQ ID NO: 185413 - DNA, 35 bp, Artificial Sequence
  Synthetic oligonucleotide
tatccccaccgtccctcgcgcgtccaataggcgga

SEQ ID NO: 185414 - DNA, 37 bp, Artificial Sequence
  Synthetic oligonucleotide
tgggacaacaactgcatgggcgaaagggagggtcgga

SEQ ID NO: 185415 - DNA, 37 bp, Artificial Sequence
  Synthetic oligonucleotide
acctcccgcaatctgctctcacgtcctatacttcgga

SEQ ID NO: 185416 - DNA, 37 bp, Artificial Sequence
  Synthetic oligonucleotide
gcccgccctgacttctctatcatgcactccgcatgga

SEQ ID NO: 185417 - DNA, 37 bp, Artificial Sequence
  Synthetic oligonucleotide
aacagcagggagcgggggctaatggcgagaggatgga

SEQ ID NO: 185418 - DNA, 35 bp, Artificial Sequence
  Synthetic oligonucleotide
ggatggtagggaggggaagagacaggggctatgga

SEQ ID NO: 185419 - DNA, 37 bp, Artificial Sequence
  Synthetic oligonucleotide
aacgccccctgtcctcacatatcggctcctacctgga

SEQ ID NO: 185420 - DNA, 37 bp, Artificial Sequence
  Synthetic oligonucleotide
acatcccacttctatctgcatttgcaagacctctgga

SEQ ID NO: 185421 - DNA, 36 bp, Artificial Sequence
  Synthetic oligonucleotide
accacttgccacacgccctacatcgttcgccttgga

SEQ ID NO: 185422 - DNA, 37 bp, Artificial Sequence
  Synthetic oligonucleotide
gtacgtatgggcagggtgggcgatgggatatccatga

SEQ ID NO: 185423 - DNA, 38 bp, Artificial Sequence
  Synthetic oligonucleotide
acgcattgtccactttctctgcccgtccgctctactga

SEQ ID NO: 185424 - DNA, 38 bp, Artificial Sequence
  Synthetic oligonucleotide
attctaccgcccacatctcgactttacagccttcctga

SEQ ID NO: 185425 - DNA, 37 bp, Artificial Sequence
  Synthetic oligonucleotide
aagccctgccgccctttttcatgatccggtcctctga

SEQ ID NO: 185426 - DNA, 35 bp, Artificial Sequence
  Synthetic oligonucleotide
tgcaattccgacacctgcgtccttatccattctga

SEQ ID NO: 185427 - DNA, 37 bp, Artificial Sequence
  Synthetic oligonucleotide
gatcagccttgtgctttgcttttcgtcctccttctga

SEQ ID NO: 185428 - DNA, 36 bp, Artificial Sequence
  Synthetic oligonucleotide
gtgcgtgctgaatcttctcctcctggcccctagtga

SEQ ID NO: 185429 - DNA, 38 bp, Artificial Sequence
  Synthetic oligonucleotide
ttacccaccaccgccgcttgtacaggctgtccacgtga

SEQ ID NO: 185430 - DNA, 38 bp, Artificial Sequence
  Synthetic oligonucleotide
ttggctaagagaggatgggcggaggcgggtagacgtga

SEQ ID NO: 185431 - DNA, 38 bp, Artificial Sequence
  Synthetic oligonucleotide
ttagcgtgtggggggcgagggctggagggcgcgcgtga

SEQ ID NO: 185432 - DNA, 38 bp, Artificial Sequence
  Synthetic oligonucleotide
tcacttgtcacgatagcatatgccaccactattcgtga

SEQ ID NO: 185433 - DNA, 38 bp, Artificial Sequence
  Synthetic oligonucleotide
tgcggggcaagggaggggatttagagctgacggggtga

SEQ ID NO: 185434 - DNA, 37 bp, Artificial Sequence
  Synthetic oligonucleotide
agacctgggtcccagcgtcttaagggagggggggtga

SEQ ID NO: 185435 - DNA, 38 bp, Artificial Sequence
  Synthetic oligonucleotide
tccagggatgaggatgcgggtgggagggtacactgtga

SEQ ID NO: 185436 - DNA, 38 bp, Artificial Sequence
  Synthetic oligonucleotide
ggggggggaccagtgaacattaagcgggaggggtgtga

SEQ ID NO: 185437 - DNA, 38 bp, Artificial Sequence
  Synthetic oligonucleotide
tcatcgcagggtgctcgccctgttcgccctcaacttga

SEQ ID NO: 185438 - DNA, 37 bp, Artificial Sequence
  Synthetic oligonucleotide
tcccgaccgacgcatcttcctgcccatctacacttga

SEQ ID NO: 185439 - DNA, 38 bp, Artificial Sequence
  Synthetic oligonucleotide
gtagcgtcgaagtctccatcgacctcttgcccccttga

SEQ ID NO: 185440 - DNA, 37 bp, Artificial Sequence
  Synthetic oligonucleotide
aacacctccgtatactctcctcggggccactccttga

SEQ ID NO: 185441 - DNA, 36 bp, Artificial Sequence
  Synthetic oligonucleotide
gacaccatccgctctgaaaacgaaaacgttccttga

SEQ ID NO: 185442 - DNA, 36 bp, Artificial Sequence
  Synthetic oligonucleotide
tatgtcacctgtcaacttctcgggcccctctcttga

SEQ ID NO: 185443 - DNA, 38 bp, Artificial Sequence
  Synthetic oligonucleotide
tccctgacaggtctcgtttttgttcatccccattttga

SEQ ID NO: 185444 - DNA, 36 bp, Artificial Sequence
  Synthetic oligonucleotide
accgccaaccctcgcttcttctttgacctccgtata

SEQ ID NO: 185445 - DNA, 36 bp, Artificial Sequence
  Synthetic oligonucleotide
tcagtgtgtcgcaattgtttagtcgcccgtcaccta

SEQ ID NO: 185446 - DNA, 35 bp, Artificial Sequence
  Synthetic oligonucleotide
tatagcatcacattcattcggccctctccacgcta

SEQ ID NO: 185447 - DNA, 36 bp, Artificial Sequence
  Synthetic oligonucleotide
gaccctagcccactgccgtttcacctttcctttgta

SEQ ID NO: 185448 - DNA, 31 bp, Artificial Sequence
  Synthetic oligonucleotide
tggggctatcaatctgttcgttcgtccctta

SEQ ID NO: 185449 - DNA, 35 bp, Artificial Sequence
  Synthetic oligonucleotide
tcaccgtcaaccctgcctccttgttgccagcctta

SEQ ID NO: 185450 - DNA, 36 bp, Artificial Sequence
  Synthetic oligonucleotide
accgacaccctttcatcgcccacgttaactatgtta

SEQ ID NO: 185451 - DNA, 35 bp, Artificial Sequence
  Synthetic oligonucleotide
gcccactgcgtccaccttgccgcactaccgtgtta

SEQ ID NO: 185452 - DNA, 36 bp, Artificial Sequence
  Synthetic oligonucleotide
tgtaggtcctgttgcctctcattgtagccttcttta

SEQ ID NO: 185453 - DNA, 35 bp, Artificial Sequence
  Synthetic oligonucleotide
tccccacgggtagggagggcacgggtgcattttta

SEQ ID NO: 185454 - DNA, 34 bp, Artificial Sequence
  Synthetic oligonucleotide
gcgaccctagtcatcgtccgttattgcgcctcac

SEQ ID NO: 185455 - DNA, 35 bp, Artificial Sequence
  Synthetic oligonucleotide
tcacacttgcccccgcgctcgacaacatcgctgac

SEQ ID NO: 185456 - DNA, 35 bp, Artificial Sequence
  Synthetic oligonucleotide
tctacgaggatcagctcggtccatcgcccctatac

SEQ ID NO: 185457 - DNA, 35 bp, Artificial Sequence
  Synthetic oligonucleotide
atccatcacctgctggaatagtaattcccgactac

SEQ ID NO: 185458 - DNA, 35 bp, Artificial Sequence
  Synthetic oligonucleotide
gtactctcacagccgtaaacgatcgctccgccacc

SEQ ID NO: 185459 - DNA, 35 bp, Artificial Sequence
  Synthetic oligonucleotide
gagcttgcgcagccgataacccagcccctgcaccc

SEQ ID NO: 185460 - DNA, 35 bp, Artificial Sequence
  Synthetic oligonucleotide
ggacgtcgcatgtctcaaagaccacaccccgcccc

SEQ ID NO: 185461 - DNA, 35 bp, Artificial Sequence
  Synthetic oligonucleotide
gacgactccgtccgcgtttttcatggcctttcccc

SEQ ID NO: 185462 - DNA, 35 bp, Artificial Sequence
  Synthetic oligonucleotide
aatgatgggagggaacagagcgaaggggatgggcc

SEQ ID NO: 185463 - DNA, 35 bp, Artificial Sequence
  Synthetic oligonucleotide
gtgagccgcccggcctagtcccgacatttggtgcc

SEQ ID NO: 185464 - DNA, 35 bp, Artificial Sequence
  Synthetic oligonucleotide
gttcagccgtcccatcgcgacatctacattcatcc

SEQ ID NO: 185465 - DNA, 35 bp, Artificial Sequence
  Synthetic oligonucleotide
ttcaccctgaatgcagaccattacgtaggccctcc

SEQ ID NO: 185466 - DNA, 35 bp, Artificial Sequence
  Synthetic oligonucleotide
acagtgccggtggctctgcataattcttgctctcc

SEQ ID NO: 185467 - DNA, 35 bp, Artificial Sequence
  Synthetic oligonucleotide
acgcactccagctgtccttccgtttccagttttcc

SEQ ID NO: 185468 - DNA, 35 bp, Artificial Sequence
  Synthetic oligonucleotide
acacgcaccacaccccccttgcacccgccacgcgc

SEQ ID NO: 185469 - DNA, 35 bp, Artificial Sequence
  Synthetic oligonucleotide
accccctcatctggacctgacgactgcattcgcgc

SEQ ID NO: 185470 - DNA, 35 bp, Artificial Sequence
  Synthetic oligonucleotide
tacgcgcatcctctcgtttgatccacagcgccatc

SEQ ID NO: 185471 - DNA, 35 bp, Artificial Sequence
  Synthetic oligonucleotide
gaggcctacccgtgccactctcactccggttactc

SEQ ID NO: 185472 - DNA, 35 bp, Artificial Sequence
  Synthetic oligonucleotide
tcgatctcaattgtacaatactcgccgacctcctc

SEQ ID NO: 185473 - DNA, 35 bp, Artificial Sequence
  Synthetic oligonucleotide
atgtggacaggcgtccatactcctgccgattcctc

SEQ ID NO: 185474 - DNA, 35 bp, Artificial Sequence
  Synthetic oligonucleotide
tgacctccgcatcctgcacgatactccttgggctc

SEQ ID NO: 185475 - DNA, 35 bp, Artificial Sequence
  Synthetic oligonucleotide
gcccctctgctccgtgtactcagctctgtgatctc

SEQ ID NO: 185476 - DNA, 35 bp, Artificial Sequence
  Synthetic oligonucleotide
gctatcaccgccctgtcatttccctggtccttctc

SEQ ID NO: 185477 - DNA, 35 bp, Artificial Sequence
  Synthetic oligonucleotide
gagccaccttctattcatacgactcatctccggtc

SEQ ID NO: 185478 - DNA, 35 bp, Artificial Sequence
  Synthetic oligonucleotide
gccatgctgcccgtaatatcgccttctggaatgtc

SEQ ID NO: 185479 - DNA, 35 bp, Artificial Sequence
  Synthetic oligonucleotide
acacccatatggttcatcgttgtcccccccgattc

SEQ ID NO: 185480 - DNA, 35 bp, Artificial Sequence
  Synthetic oligonucleotide
gtgactggcccaggtggtcgtcaccgcttatattc

SEQ ID NO: 185481 - DNA, 35 bp, Artificial Sequence
  Synthetic oligonucleotide
gagaccgcacggttggttaatgcgccaccgccttc

SEQ ID NO: 185482 - DNA, 35 bp, Artificial Sequence
  Synthetic oligonucleotide
acgatcacgccgctctaacgccgcttttttccttc

SEQ ID NO: 185483 - DNA, 35 bp, Artificial Sequence
  Synthetic oligonucleotide
gtgaatcatctagctgccgccgctatacattgttc

SEQ ID NO: 185484 - DNA, 35 bp, Artificial Sequence
  Synthetic oligonucleotide
atggggggggagtgagaagggaaggggaagagaag

SEQ ID NO: 185485 - DNA, 35 bp, Artificial Sequence
  Synthetic oligonucleotide
tatcccaccgccccccagtagctgaccccacctag

SEQ ID NO: 185486 - DNA, 35 bp, Artificial Sequence
  Synthetic oligonucleotide
tcccatgtgtacacttggacgttccacctccaccg

SEQ ID NO: 185487 - DNA, 35 bp, Artificial Sequence
  Synthetic oligonucleotide
tcatacgtccatccgctgctttctcaatgaacccg

SEQ ID NO: 185488 - DNA, 35 bp, Artificial Sequence
  Synthetic oligonucleotide
gacacggtgtgggggggtctcgagaaacgggtccg

SEQ ID NO: 185489 - DNA, 35 bp, Artificial Sequence
  Synthetic oligonucleotide
gctgcatcacttctcaaggttcatctccacccgcg

SEQ ID NO: 185490 - DNA, 35 bp, Artificial Sequence
  Synthetic oligonucleotide
tccgccctgccacaacatctgctccccaacgcgcg

SEQ ID NO: 185491 - DNA, 33 bp, Artificial Sequence
  Synthetic oligonucleotide
tctactcatcaccactgcgcgtttcaccaggcg

SEQ ID NO: 185492 - DNA, 35 bp, Artificial Sequence
  Synthetic oligonucleotide
gggaggtgagggcagggatacggactgagcaggcg

SEQ ID NO: 185493 - DNA, 35 bp, Artificial Sequence
  Synthetic oligonucleotide
actatcttgctccactttgcctcaccccctgtgcg

SEQ ID NO: 185494 - DNA, 35 bp, Artificial Sequence
  Synthetic oligonucleotide
ttcaacattcacatcgccacgttaccatgccatcg

SEQ ID NO: 185495 - DNA, 35 bp, Artificial Sequence
  Synthetic oligonucleotide
gggtccaacccccctgtctattaagttccctctcg

SEQ ID NO: 185496 - DNA, 35 bp, Artificial Sequence
  Synthetic oligonucleotide
tcgccacatcgagcccccccgcacttcaaaggtcg

SEQ ID NO: 185497 - DNA, 35 bp, Artificial Sequence
  Synthetic oligonucleotide
tgccgtcaatctcttagcctcatgcttcccggtcg

SEQ ID NO: 185498 - DNA, 35 bp, Artificial Sequence
  Synthetic oligonucleotide
acagctccagtcatgagttcaccgccctcctttcg

SEQ ID NO: 185499 - DNA, 35 bp, Artificial Sequence
  Synthetic oligonucleotide
tcactacaccctccctcaacacctcaggtgtttcg

SEQ ID NO: 185500 - DNA, 35 bp, Artificial Sequence
  Synthetic oligonucleotide
tccccatacctgcacctgatagcctttttgttagg

SEQ ID NO: 185501 - DNA, 35 bp, Artificial Sequence
  Synthetic oligonucleotide
tcgtgcgggtgcggagggggctaaactgggagggg

SEQ ID NO: 185502 - DNA, 35 bp, Artificial Sequence
  Synthetic oligonucleotide
tggggggggagggtgggcagtagaacggtcattgg

SEQ ID NO: 185503 - DNA, 35 bp, Artificial Sequence
  Synthetic oligonucleotide
gtgaacaaccggcttgcgcgcactactagtccctg

SEQ ID NO: 185504 - DNA, 35 bp, Artificial Sequence
  Synthetic oligonucleotide
gtgagtggtgtgggcgaaggaggaggagagatctg

SEQ ID NO: 185505 - DNA, 33 bp, Artificial Sequence
  Synthetic oligonucleotide
atacttgcccccctgatcggtaaccgacctttg

SEQ ID NO: 185506 - DNA, 35 bp, Artificial Sequence
  Synthetic oligonucleotide
tgccatgcaacacgcgtttttctccccggcgcaat

SEQ ID NO: 185507 - DNA, 35 bp, Artificial Sequence
  Synthetic oligonucleotide
gcatcatcaccggtcccacgccccagtgcctgaat

SEQ ID NO: 185508 - DNA, 35 bp, Artificial Sequence
  Synthetic oligonucleotide
gccagacgctgccctgcctaggccataattctaat

SEQ ID NO: 185509 - DNA, 35 bp, Artificial Sequence
  Synthetic oligonucleotide
accgtccatccgcctgtctgtgtccaacccctcat

SEQ ID NO: 185510 - DNA, 35 bp, Artificial Sequence
  Synthetic oligonucleotide
gtgacatcctcctggctcatccccccggtatgtat

SEQ ID NO: 185511 - DNA, 35 bp, Artificial Sequence
  Synthetic oligonucleotide
tagatcccacctgactgtttacggttcctgattat

SEQ ID NO: 185512 - DNA, 35 bp, Artificial Sequence
  Synthetic oligonucleotide
tatgcctgctctgatgcagcacgcccccacccact

SEQ ID NO: 185513 - DNA, 35 bp, Artificial Sequence
  Synthetic oligonucleotide
gcccgctcgcacctttccgtccgcaccgcccgact

SEQ ID NO: 185514 - DNA, 35 bp, Artificial Sequence
  Synthetic oligonucleotide
atggttccatcagggcgccgcaactccctccgact

SEQ ID NO: 185515 - DNA, 35 bp, Artificial Sequence
  Synthetic oligonucleotide
tcagacgcaaatccccgaccattgcagaccaccct

SEQ ID NO: 185516 - DNA, 35 bp, Artificial Sequence
  Synthetic oligonucleotide
gcatgttggttctcttttgtctggcgccttaccct

SEQ ID NO: 185517 - DNA, 36 bp, Artificial Sequence
  Synthetic oligonucleotide
gaacactgtccggcccataataccagctgcccccct

SEQ ID NO: 185518 - DNA, 35 bp, Artificial Sequence
  Synthetic oligonucleotide
tgactccgatcactcgggtagatcctcccatccct

SEQ ID NO: 185519 - DNA, 35 bp, Artificial Sequence
  Synthetic oligonucleotide
gagtcgtccatcctatcggtccacgcgttttccct

SEQ ID NO: 185520 - DNA, 35 bp, Artificial Sequence
  Synthetic oligonucleotide
tacagcgcatcccgggggggcctctctcacttcct

SEQ ID NO: 185521 - DNA, 35 bp, Artificial Sequence
  Synthetic oligonucleotide
acacgctctccgtcacctcaatgccatatgttcct

SEQ ID NO: 185522 - DNA, 35 bp, Artificial Sequence
  Synthetic oligonucleotide
gcatccccgggtcactagggcacgaaattacctct

SEQ ID NO: 185523 - DNA, 36 bp, Artificial Sequence
  Synthetic oligonucleotide
taccggcacccccgtcattacctctcgcgctcctgt

SEQ ID NO: 185524 - DNA, 35 bp, Artificial Sequence
  Synthetic oligonucleotide
acgagggcatgggcgtaaaaagttagggtgggtgt

SEQ ID NO: 185525 - DNA, 35 bp, Artificial Sequence
  Synthetic oligonucleotide
tccgtaccgcaccatgttctattaactcaacttgt

SEQ ID NO: 185526 - DNA, 35 bp, Artificial Sequence
  Synthetic oligonucleotide
gccacctcatccttggcattggtgttctatcaatt

SEQ ID NO: 185527 - DNA, 35 bp, Artificial Sequence
  Synthetic oligonucleotide
atcacatcccccgcgtcctgactcctgcttccctt

SEQ ID NO: 185528 - DNA, 35 bp, Artificial Sequence
  Synthetic oligonucleotide
ttacaacgttggaccactgctgccacctttccctt

SEQ ID NO: 185529 - DNA, 33 bp, Artificial Sequence
  Synthetic oligonucleotide
acacgccggccccatccgtgatccacttctctt

SEQ ID NO: 185530 - DNA, 35 bp, Artificial Sequence
  Synthetic oligonucleotide
gtagcatactgtccctcccacgcctttgttctgtt

SEQ ID NO: 185531 - DNA, 35 bp, Artificial Sequence
  Synthetic oligonucleotide
gagcccgacctatcccccgactgctgacttacttt

SEQ ID NO: 185532 - DNA, 35 bp, Artificial Sequence
  Synthetic oligonucleotide
gttgaacccccgacctgccccgtcgtagaattttt

SEQ ID NO: 185533 - DNA, 36 bp, Artificial Sequence
  Synthetic oligonucleotide
aaacgcaagggaggagtaggctacaagggtggaaaa

SEQ ID NO: 185534 - DNA, 36 bp, Artificial Sequence
  Synthetic oligonucleotide
agccccccgccgcctgccctgtgctcagggataaaa

SEQ ID NO: 185535 - DNA, 36 bp, Artificial Sequence
  Synthetic oligonucleotide
tgtgggtgggagcggtatacgggtcacttcacccaa

SEQ ID NO: 185536 - DNA, 36 bp, Artificial Sequence
  Synthetic oligonucleotide
ggggacaaggggaatagagggaagataagtcgagaa

SEQ ID NO: 185537 - DNA, 36 bp, Artificial Sequence
  Synthetic oligonucleotide
acagagcacaggactgaagtaggtggaggaggtgaa

SEQ ID NO: 185538 - DNA, 35 bp, Artificial Sequence
  Synthetic oligonucleotide
aattggagcgcgggaagggcgggacgactggataa

SEQ ID NO: 185539 - DNA, 36 bp, Artificial Sequence
  Synthetic oligonucleotide
ttggaccaccactcgactgaaaacgccacttactaa

SEQ ID NO: 185540 - DNA, 35 bp, Artificial Sequence
  Synthetic oligonucleotide
atgcccatacggctccttctcgacacctgcaaaca

SEQ ID NO: 185541 - DNA, 36 bp, Artificial Sequence
  Synthetic oligonucleotide
acccacctttacattctcgggcctggttaactaaca

SEQ ID NO: 185542 - DNA, 36 bp, Artificial Sequence
  Synthetic oligonucleotide
tgatgttgccctgcctgcctgaaactcgtgaacaca

SEQ ID NO: 185543 - DNA, 36 bp, Artificial Sequence
  Synthetic oligonucleotide
ttgatgacgccagctagctgcaccaactacccccca

SEQ ID NO: 185544 - DNA, 36 bp, Artificial Sequence
  Synthetic oligonucleotide
tcaccgcccctcacgctagtaattcctgtctcccca

SEQ ID NO: 185545 - DNA, 35 bp, Artificial Sequence
  Synthetic oligonucleotide
tccccttggcgagccgtaactcgtgccgtttccca

SEQ ID NO: 185546 - DNA, 36 bp, Artificial Sequence
  Synthetic oligonucleotide
gcacacgcctctctgaatcacttagacgttctgcca

SEQ ID NO: 185547 - DNA, 36 bp, Artificial Sequence
  Synthetic oligonucleotide
atcacaacacaggtgatccttgggtgcacttctcca

SEQ ID NO: 185548 - DNA, 35 bp, Artificial Sequence
  Synthetic oligonucleotide
gtgcggtgggtcgggcacaggcaaagtggggggca

SEQ ID NO: 185549 - DNA, 36 bp, Artificial Sequence
  Synthetic oligonucleotide
tccgcccgctacaaggctatttctccactcatggca

SEQ ID NO: 185550 - DNA, 35 bp, Artificial Sequence
  Synthetic oligonucleotide
gagcccagcttaagtccaactcaccatctgctgca

SEQ ID NO: 185551 - DNA, 36 bp, Artificial Sequence
  Synthetic oligonucleotide
tgttccccccgggtattactcccaatgccttttgca

SEQ ID NO: 185552 - DNA, 36 bp, Artificial Sequence
  Synthetic oligonucleotide
gcacgcccctatgctcgatccgttcccatgtaatca

SEQ ID NO: 185553 - DNA, 36 bp, Artificial Sequence
  Synthetic oligonucleotide
actatgcaacgagctcatctgtaccagcccctctca

SEQ ID NO: 185554 - DNA, 36 bp, Artificial Sequence
  Synthetic oligonucleotide
ttgcggtcttgccgtccattctatcgggccttctca

SEQ ID NO: 185555 - DNA, 35 bp, Artificial Sequence
  Synthetic oligonucleotide
gcctgtcaggggtgtacctcctcccgcttccgtca

SEQ ID NO: 185556 - DNA, 34 bp, Artificial Sequence
  Synthetic oligonucleotide
gagacgctcacgccgttcaccaccgccgtattca

SEQ ID NO: 185557 - DNA, 37 bp, Artificial Sequence
  Synthetic oligonucleotide
ataagggtcaaagcaggaaggtgagaaaggcggcaga

SEQ ID NO: 185558 - DNA, 37 bp, Artificial Sequence
  Synthetic oligonucleotide
agagaagcagtgggcggggggagtggtgaagcagaga

SEQ ID NO: 185559 - DNA, 37 bp, Artificial Sequence
  Synthetic oligonucleotide
acagatggtggggataggtgaggttgcatggaggaga

SEQ ID NO: 185560 - DNA, 37 bp, Artificial Sequence
  Synthetic oligonucleotide
gtcaatcgggaatggggcggagggggaatcgcggaga

SEQ ID NO: 185561 - DNA, 36 bp, Artificial Sequence
  Synthetic oligonucleotide
tgctgggttgacgggcgggagaacgacgaagggaga

SEQ ID NO: 185562 - DNA, 37 bp, Artificial Sequence
  Synthetic oligonucleotide
ggttgggaggaagggtggcggaggattcaaatggaga

SEQ ID NO: 185563 - DNA, 37 bp, Artificial Sequence
  Synthetic oligonucleotide
gttccgtgtcgggcctatactgacactctccccccga

SEQ ID NO: 185564 - DNA, 37 bp, Artificial Sequence
  Synthetic oligonucleotide
gatccccttgcgctgttcggttcctcgcgttccccga

SEQ ID NO: 185565 - DNA, 37 bp, Artificial Sequence
  Synthetic oligonucleotide
tgcccatcctcctttcttgctgtcaaggaacagccga

SEQ ID NO: 185566 - DNA, 35 bp, Artificial Sequence
  Synthetic oligonucleotide
acatggcctctcttgcaatctgttcttatcgccga

SEQ ID NO: 185567 - DNA, 36 bp, Artificial Sequence
  Synthetic oligonucleotide
tccctgcccacacccgtgcatcccaatgccatccga

SEQ ID NO: 185568 - DNA, 37 bp, Artificial Sequence
  Synthetic oligonucleotide
gccatccgccagcccgctaccatagccgaccctgcga

SEQ ID NO: 185569 - DNA, 36 bp, Artificial Sequence
  Synthetic oligonucleotide
gccaacctccgctagatcgcgttcgtctcatatcga

SEQ ID NO: 185570 - DNA, 35 bp, Artificial Sequence
  Synthetic oligonucleotide
tccgacatgtcgatactctaccctagcaccctcga

SEQ ID NO: 185571 - DNA, 37 bp, Artificial Sequence
  Synthetic oligonucleotide
acctacaccccacatttaccgattgcgagattctcga

SEQ ID NO: 185572 - DNA, 36 bp, Artificial Sequence
  Synthetic oligonucleotide
acagcctccgcttctttcaacgccctatgccttcga

SEQ ID NO: 185573 - DNA, 37 bp, Artificial Sequence
  Synthetic oligonucleotide
agacggtaacggaacatagggtggaagggtgagagga

SEQ ID NO: 185574 - DNA, 36 bp, Artificial Sequence
  Synthetic oligonucleotide
acgccctgcgacggccctctctcctctcagtacgga

SEQ ID NO: 185575 - DNA, 37 bp, Artificial Sequence
  Synthetic oligonucleotide
gactcgccccccgcccctatcactagccgtctgcgga

SEQ ID NO: 185576 - DNA, 37 bp, Artificial Sequence
  Synthetic oligonucleotide
aagcgggggaacggagtagggaagtgctggtatcgga

SEQ ID NO: 185577 - DNA, 37 bp, Artificial Sequence
  Synthetic oligonucleotide
attcgcaggaggggaggcgaacagggtaggaaaggga

SEQ ID NO: 185578 - DNA, 37 bp, Artificial Sequence
  Synthetic oligonucleotide
atgggcaaaggtatggggtgcgaagggctgaagggga

SEQ ID NO: 185579 - DNA, 37 bp, Artificial Sequence
  Synthetic oligonucleotide
tgtggaggcggaattgaaggcattggcgggtggggga

SEQ ID NO: 185580 - DNA, 37 bp, Artificial Sequence
  Synthetic oligonucleotide
gccggggctgctcagggttggggcatgtagatgggga

SEQ ID NO: 185581 - DNA, 36 bp, Artificial Sequence
  Synthetic oligonucleotide
ttatcccacgcctttgtctcgtaaaactccactgga

SEQ ID NO: 185582 - DNA, 37 bp, Artificial Sequence
  Synthetic oligonucleotide
gaacgggcgggccgtcagggaggggaagaaccctgga

SEQ ID NO: 185583 - DNA, 36 bp, Artificial Sequence
  Synthetic oligonucleotide
acacccctcctgtgctcccacggttatccgcctgga

SEQ ID NO: 185584 - DNA, 34 bp, Artificial Sequence
  Synthetic oligonucleotide
taggagaggggggggggtcacgggctagtgtgga

SEQ ID NO: 185585 - DNA, 37 bp, Artificial Sequence
  Synthetic oligonucleotide
gtgccacaggggagcgggggtggagagggagcaatga

SEQ ID NO: 185586 - DNA, 38 bp, Artificial Sequence
  Synthetic oligonucleotide
acccgccgcccggctcgcattacccgctctcacgctga

SEQ ID NO: 185587 - DNA, 37 bp, Artificial Sequence
  Synthetic oligonucleotide
actacacctcgctttggtccatcagcttactcgctga

SEQ ID NO: 185588 - DNA, 37 bp, Artificial Sequence
  Synthetic oligonucleotide
atcatcgcatctcgtactcagccgctcccccgcgtga

SEQ ID NO: 185589 - DNA, 37 bp, Artificial Sequence
  Synthetic oligonucleotide
agtacatgcctacttccgtgccacgccttcctcgtga

SEQ ID NO: 185590 - DNA, 37 bp, Artificial Sequence
  Synthetic oligonucleotide
agtcgaggagcaacggggaaacgggtgacgagggtga

SEQ ID NO: 185591 - DNA, 38 bp, Artificial Sequence
  Synthetic oligonucleotide
acatcgtgcaggaagacggagggtagggggaaatgtga

SEQ ID NO: 185592 - DNA, 38 bp, Artificial Sequence
  Synthetic oligonucleotide
tttcgccgcaagtcattgaacctccccattcaccttga

SEQ ID NO: 185593 - DNA, 36 bp, Artificial Sequence
  Synthetic oligonucleotide
tgcgcccaccgctccgtctgttcacatctctcttga

SEQ ID NO: 185594 - DNA, 38 bp, Artificial Sequence
  Synthetic oligonucleotide
ttcgactagcccagtgcccctctcctctgccacgttga

SEQ ID NO: 185595 - DNA, 38 bp, Artificial Sequence
  Synthetic oligonucleotide
tcacacgccccttttgatagttgtttcctccctgttga

SEQ ID NO: 185596 - DNA, 38 bp, Artificial Sequence
  Synthetic oligonucleotide
gggtgagtgggggcagggtgatagggaagggaatttga

SEQ ID NO: 185597 - DNA, 36 bp, Artificial Sequence
  Synthetic oligonucleotide
acatgcaccccgcgccgtgctatcgacccatcccta

SEQ ID NO: 185598 - DNA, 35 bp, Artificial Sequence
  Synthetic oligonucleotide
acttgcgcgctcttacggtcgttcgtcacctccta

SEQ ID NO: 185599 - DNA, 35 bp, Artificial Sequence
  Synthetic oligonucleotide
tccctacgatcgttgggcttatcattcccccgcta

SEQ ID NO: 185600 - DNA, 36 bp, Artificial Sequence
  Synthetic oligonucleotide
tcataccaccggctcactttgtctacatttgcgcta

SEQ ID NO: 185601 - DNA, 35 bp, Artificial Sequence
  Synthetic oligonucleotide
tccccacttccccagccgatagcttttaagctcta

SEQ ID NO: 185602 - DNA, 36 bp, Artificial Sequence
  Synthetic oligonucleotide
gtcaccccctcatccatggtctagctcatttccgta

SEQ ID NO: 185603 - DNA, 34 bp, Artificial Sequence
  Synthetic oligonucleotide
tacttctgcccctgtcggcgttttcgccccgtta

SEQ ID NO: 185604 - DNA, 36 bp, Artificial Sequence
  Synthetic oligonucleotide
tgacaccccattcgagttttggggtaccacctttta

SEQ ID NO: 185605 - DNA, 35 bp, Artificial Sequence
  Synthetic oligonucleotide
atcgcccagtttgccgcgatgccatctccaaccac

SEQ ID NO: 185606 - DNA, 35 bp, Artificial Sequence
  Synthetic oligonucleotide
tccagccggggccgcctccttgttctctgttccac

SEQ ID NO: 185607 - DNA, 35 bp, Artificial Sequence
  Synthetic oligonucleotide
gttccgtacctcacatcgtgcttctagcatccgac

SEQ ID NO: 185608 - DNA, 35 bp, Artificial Sequence
  Synthetic oligonucleotide
gccgactttccccagcctacgccacccggtccgac

SEQ ID NO: 185609 - DNA, 35 bp, Artificial Sequence
  Synthetic oligonucleotide
gtccccccactacatgtacgttccacgttttgtac

SEQ ID NO: 185610 - DNA, 35 bp, Artificial Sequence
  Synthetic oligonucleotide
ggatcctgtgcgtgtttcttcgggcctcttcttac

SEQ ID NO: 185611 - DNA, 35 bp, Artificial Sequence
  Synthetic oligonucleotide
tgtggtgatcaatccgtacaatccccgacctttac

SEQ ID NO: 185612 - DNA, 35 bp, Artificial Sequence
  Synthetic oligonucleotide
tcgccgtaccttcccgaccccggactgtaaacacc

SEQ ID NO: 185613 - DNA, 35 bp, Artificial Sequence
  Synthetic oligonucleotide
tggactccgctctctcctcggacacgacctacacc

SEQ ID NO: 185614 - DNA, 35 bp, Artificial Sequence
  Synthetic oligonucleotide
tacacgtacagccctgattatcctcgcgcaccacc

SEQ ID NO: 185615 - DNA, 35 bp, Artificial Sequence
  Synthetic oligonucleotide
gctacgacatcgagctgcttggttaccccccaccc

SEQ ID NO: 185616 - DNA, 35 bp, Artificial Sequence
  Synthetic oligonucleotide
taccccatgagttctgttcgttcattcactagccc

SEQ ID NO: 185617 - DNA, 34 bp, Artificial Sequence
  Synthetic oligonucleotide
atcgcaaggtaagtcccgccaatcagccgccgcc

SEQ ID NO: 185618 - DNA, 35 bp, Artificial Sequence
  Synthetic oligonucleotide
tatgcacgattccagcctcatttttgccctgcgcc

SEQ ID NO: 185619 - DNA, 35 bp, Artificial Sequence
  Synthetic oligonucleotide
tgagatccatcgcattcgggccttagacaccatcc

SEQ ID NO: 185620 - DNA, 35 bp, Artificial Sequence
  Synthetic oligonucleotide
gcatcattacggtagtaatgctctcgttactctcc

SEQ ID NO: 185621 - DNA, 35 bp, Artificial Sequence
  Synthetic oligonucleotide
gtccaccttcccccattgacccgcattaatttagc

SEQ ID NO: 185622 - DNA, 35 bp, Artificial Sequence
  Synthetic oligonucleotide
gctaccccttctgcagtcccaggtaactcccccgc

SEQ ID NO: 185623 - DNA, 35 bp, Artificial Sequence
  Synthetic oligonucleotide
tgtaaccgcctcgctatacagtgataacttcccgc

SEQ ID NO: 185624 - DNA, 35 bp, Artificial Sequence
  Synthetic oligonucleotide
ttgctctccgcctgctcctccccattcgaagcggc

SEQ ID NO: 185625 - DNA, 35 bp, Artificial Sequence
  Synthetic oligonucleotide
gaatctccctccctgtgtcacatgcctacctgggc

SEQ ID NO: 185626 - DNA, 35 bp, Artificial Sequence
  Synthetic oligonucleotide
agcgacgtaggagcccactctaccacactttaatc

SEQ ID NO: 185627 - DNA, 35 bp, Artificial Sequence
  Synthetic oligonucleotide
gtgtgtcccagcacctctgtcccatggccgccatc

SEQ ID NO: 185628 - DNA, 35 bp, Artificial Sequence
  Synthetic oligonucleotide
aagaccacctcaccatctgccctcgtagaaacctc

SEQ ID NO: 185629 - DNA, 35 bp, Artificial Sequence
  Synthetic oligonucleotide
tcagacccacgttggccttatcgacgcttcacctc

SEQ ID NO: 185630 - DNA, 35 bp, Artificial Sequence
  Synthetic oligonucleotide
actacttcgccactgtttgcgatttttgtatcctc

SEQ ID NO: 185631 - DNA, 35 bp, Artificial Sequence
  Synthetic oligonucleotide
tcatgaagccgcatgcaatacacatgttctcgctc

SEQ ID NO: 185632 - DNA, 35 bp, Artificial Sequence
  Synthetic oligonucleotide
tcaccatactcctccgtgccaatagcccatcagtc

SEQ ID NO: 185633 - DNA, 35 bp, Artificial Sequence
  Synthetic oligonucleotide
gctgatgcctcacctttactcgatctcgttctgtc

SEQ ID NO: 185634 - DNA, 35 bp, Artificial Sequence
  Synthetic oligonucleotide
aacacccgcacccttttttgcgcccgacgcttgtc

SEQ ID NO: 185635 - DNA, 35 bp, Artificial Sequence
  Synthetic oligonucleotide
tacgccaattccctccgcccgttatgctactgttc

SEQ ID NO: 185636 - DNA, 35 bp, Artificial Sequence
  Synthetic oligonucleotide
tgcggtcaccctcgtctcctttcgtggtctatttc

SEQ ID NO: 185637 - DNA, 35 bp, Artificial Sequence
  Synthetic oligonucleotide
gactacccaccgcatgaataaggccggcccttttc

SEQ ID NO: 185638 - DNA, 35 bp, Artificial Sequence
  Synthetic oligonucleotide
gaagggagaataggcaggggtgggtgggtcctgag

SEQ ID NO: 185639 - DNA, 35 bp, Artificial Sequence
  Synthetic oligonucleotide
gttccatcacgaccgcgctagctcctttacccccg

SEQ ID NO: 185640 - DNA, 35 bp, Artificial Sequence
  Synthetic oligonucleotide
atgctggcgttacccgtcgtcttacccgcatcccg

SEQ ID NO: 185641 - DNA, 35 bp, Artificial Sequence
  Synthetic oligonucleotide
gccagactacaaccttggctgccccccgctctccg

SEQ ID NO: 185642 - DNA, 35 bp, Artificial Sequence
  Synthetic oligonucleotide
tcccgtcctctggtccggtattttctctgtattcg

SEQ ID NO: 185643 - DNA, 35 bp, Artificial Sequence
  Synthetic oligonucleotide
gagaaggttcagggtcggggggggcacgaacacgg

SEQ ID NO: 185644 - DNA, 35 bp, Artificial Sequence
  Synthetic oligonucleotide
acaccgcctccgcccgtcagctcacgtcacaccgg

SEQ ID NO: 185645 - DNA, 35 bp, Artificial Sequence
  Synthetic oligonucleotide
acacaggttcaaggggagcatgggttggcctgggg

SEQ ID NO: 185646 - DNA, 35 bp, Artificial Sequence
  Synthetic oligonucleotide
gggccgggagggtgggtgtggatgctgaactttgg

SEQ ID NO: 185647 - DNA, 35 bp, Artificial Sequence
  Synthetic oligonucleotide
ggactcccgccaatttcctcgccgcaaactcgctg

SEQ ID NO: 185648 - DNA, 37 bp, Artificial Sequence
  Synthetic oligonucleotide
tgagggttagaggggggggaatacgaaaaacatgttg

SEQ ID NO: 185649 - DNA, 35 bp, Artificial Sequence
  Synthetic oligonucleotide
attgcccggcccactaacgtactgctccatttttg

SEQ ID NO: 185650 - DNA, 35 bp, Artificial Sequence
  Synthetic oligonucleotide
tgctctgcccacccgttgtaatttggtccctccat

SEQ ID NO: 185651 - DNA, 35 bp, Artificial Sequence
  Synthetic oligonucleotide
ggagggggtagataagccggcgggggtgaatgcat

SEQ ID NO: 185652 - DNA, 35 bp, Artificial Sequence
  Synthetic oligonucleotide
ttcaatccctccgatggcaattcgggatcacctat

SEQ ID NO: 185653 - DNA, 35 bp, Artificial Sequence
  Synthetic oligonucleotide
acgtacccatcctagctctgccccggttactctat

SEQ ID NO: 185654 - DNA, 35 bp, Artificial Sequence
  Synthetic oligonucleotide
gccgctacaagctgccatgtggtcccgcccgttat

SEQ ID NO: 185655 - DNA, 35 bp, Artificial Sequence
  Synthetic oligonucleotide
acgcacacccgcctctttgcacagctagttgtact

SEQ ID NO: 185656 - DNA, 35 bp, Artificial Sequence
  Synthetic oligonucleotide
tcgctataccctcctcctttgttatagtccaccct

SEQ ID NO: 185657 - DNA, 35 bp, Artificial Sequence
  Synthetic oligonucleotide
gacaggtcgccgcccgacaactaccagcaccccct

SEQ ID NO: 185658 - DNA, 35 bp, Artificial Sequence
  Synthetic oligonucleotide
gcccctgccctgcacttgagcctgttactttcgct

SEQ ID NO: 185659 - DNA, 35 bp, Artificial Sequence
  Synthetic oligonucleotide
ttaaaccgccgacgccgcccttctcatctgatgct

SEQ ID NO: 185660 - DNA, 35 bp, Artificial Sequence
  Synthetic oligonucleotide
acccgttgtctcagcgcaagtctactgttccatct

SEQ ID NO: 185661 - DNA, 35 bp, Artificial Sequence
  Synthetic oligonucleotide
agcacaccctctgcccccatgttttgacagactct

SEQ ID NO: 185662 - DNA, 35 bp, Artificial Sequence
  Synthetic oligonucleotide
gacgcatcagaccctgcttcttacccgtaggctct

SEQ ID NO: 185663 - DNA, 35 bp, Artificial Sequence
  Synthetic oligonucleotide
atgcgggggaggtgattgggcgggtacgatcgtct

SEQ ID NO: 185664 - DNA, 35 bp, Artificial Sequence
  Synthetic oligonucleotide
ttcccattccaccgccctgttatgctccagtttct

SEQ ID NO: 185665 - DNA, 36 bp, Artificial Sequence
  Synthetic oligonucleotide
tgctccatccctactctgccaagcttcatctgcagt

SEQ ID NO: 185666 - DNA, 35 bp, Artificial Sequence
  Synthetic oligonucleotide
gacatctgtgtgcccgtcgtagtcacctccctagt

SEQ ID NO: 185667 - DNA, 35 bp, Artificial Sequence
  Synthetic oligonucleotide
ttcccgacccagcgcatcgactcattatcccccgt

SEQ ID NO: 185668 - DNA, 35 bp, Artificial Sequence
  Synthetic oligonucleotide
gcacttaccgctgctacaccatcacctccaaaggt

SEQ ID NO: 185669 - DNA, 31 bp, Artificial Sequence
  Synthetic oligonucleotide
tcgccattcgcccctcttttctacctcaggt

SEQ ID NO: 185670 - DNA, 35 bp, Artificial Sequence
  Synthetic oligonucleotide
gaccatgtccggttagcccccccctgccctatggt

SEQ ID NO: 185671 - DNA, 33 bp, Artificial Sequence
  Synthetic oligonucleotide
tctcctactcacgccactgtttgcccttctggt

SEQ ID NO: 185672 - DNA, 35 bp, Artificial Sequence
  Synthetic oligonucleotide
ttacgtgcacctccacggcatccctagcccactgt

SEQ ID NO: 185673 - DNA, 35 bp, Artificial Sequence
  Synthetic oligonucleotide
tccgtcgccgcacctttacactccagttactactt

SEQ ID NO: 185674 - DNA, 35 bp, Artificial Sequence
  Synthetic oligonucleotide
aaattgggcggggtggggagaaagggggtcttctt

SEQ ID NO: 185675 - DNA, 35 bp, Artificial Sequence
  Synthetic oligonucleotide
tcgatcacccctcgctttgtaccacctttcttctt

SEQ ID NO: 185676 - DNA, 35 bp, Artificial Sequence
  Synthetic oligonucleotide
tcaccaccgtgtgcccggtcccgatccattatgtt

SEQ ID NO: 185677 - DNA, 35 bp, Artificial Sequence
  Synthetic oligonucleotide
ttaccctgcccccgaccgtcacttggacgcacttt

SEQ ID NO: 185678 - DNA, 36 bp, Artificial Sequence
  Synthetic oligonucleotide
atgcctcctcctccgttcgagcttgaaccagtgaaa

SEQ ID NO: 185679 - DNA, 35 bp, Artificial Sequence
  Synthetic oligonucleotide
gtggcggaggcggggggtggatggagggcaataaa

SEQ ID NO: 185680 - DNA, 36 bp, Artificial Sequence
  Synthetic oligonucleotide
gtgggtggggggctaattggacaacgggaaatggaa

SEQ ID NO: 185681 - DNA, 35 bp, Artificial Sequence
  Synthetic oligonucleotide
tacgctttcaccacctgcagccattctatcgaaca

SEQ ID NO: 185682 - DNA, 36 bp, Artificial Sequence
  Synthetic oligonucleotide
acccacctgatccaaggtctatcataacgcacacca

SEQ ID NO: 185683 - DNA, 36 bp, Artificial Sequence
  Synthetic oligonucleotide
aacacccttcactccggtcattggacaactcgacca

SEQ ID NO: 185684 - DNA, 36 bp, Artificial Sequence
  Synthetic oligonucleotide
tgctgcccccagctcgtctagcttttcgccccgcca

SEQ ID NO: 185685 - DNA, 36 bp, Artificial Sequence
  Synthetic oligonucleotide
atgcacccctggagcttatgttccagtaatcctcca

SEQ ID NO: 185686 - DNA, 36 bp, Artificial Sequence
  Synthetic oligonucleotide
tgcgtgacccctgcaccatgcttacgctctgctcca

SEQ ID NO: 185687 - DNA, 36 bp, Artificial Sequence
  Synthetic oligonucleotide
tactggggtcgggaaggaggaatgaagggcttagca

SEQ ID NO: 185688 - DNA, 36 bp, Artificial Sequence
  Synthetic oligonucleotide
ttcccatcatcctggtttatcgtccacccctacgca

SEQ ID NO: 185689 - DNA, 36 bp, Artificial Sequence
  Synthetic oligonucleotide
gcacaaaacggtggaggatggagtggattcggtgca

SEQ ID NO: 185690 - DNA, 36 bp, Artificial Sequence
  Synthetic oligonucleotide
atccagacccttccgtttaccgcctcagtgcgatca

SEQ ID NO: 185691 - DNA, 35 bp, Artificial Sequence
  Synthetic oligonucleotide
tgtatcgtctccctgatgcttctgtctccccgtca

SEQ ID NO: 185692 - DNA, 35 bp, Artificial Sequence
  Synthetic oligonucleotide
tggaagccgcagatggtgtcgtccgcccttcttca

SEQ ID NO: 185693 - DNA, 36 bp, Artificial Sequence
  Synthetic oligonucleotide
accgcacattccccgatctcatgcatgcctcgttca

SEQ ID NO: 185694 - DNA, 34 bp, Artificial Sequence
  Synthetic oligonucleotide
tctgaccctgtcgctctgttcactaaacatttca

SEQ ID NO: 185695 - DNA, 37 bp, Artificial Sequence
  Synthetic oligonucleotide
tactccgcccccctgtaagatcactcgttgaccaaga

SEQ ID NO: 185696 - DNA, 37 bp, Artificial Sequence
  Synthetic oligonucleotide
gtggggggggatagaccaagattgaaggggacgcaga

SEQ ID NO: 185697 - DNA, 37 bp, Artificial Sequence
  Synthetic oligonucleotide
acgaccccgcccccatatttgtactttgtattgcaga

SEQ ID NO: 185698 - DNA, 36 bp, Artificial Sequence
  Synthetic oligonucleotide
tgggataatcgaagggggggtagggaggacaggaga

SEQ ID NO: 185699 - DNA, 36 bp, Artificial Sequence
  Synthetic oligonucleotide
tatgggacgagggggtgaggtagttggaagaggaga

SEQ ID NO: 185700 - DNA, 36 bp, Artificial Sequence
  Synthetic oligonucleotide
gctagtctgggggaggggaagaaggtagatgggaga

SEQ ID NO: 185701 - DNA, 37 bp, Artificial Sequence
  Synthetic oligonucleotide
gttcagcaattgctgcgatctatacatgcccccccga

SEQ ID NO: 185702 - DNA, 37 bp, Artificial Sequence
  Synthetic oligonucleotide
gctcccccgacaccttgtaccaccacgacggctccga

SEQ ID NO: 185703 - DNA, 37 bp, Artificial Sequence
  Synthetic oligonucleotide
tgacatcttcagccgcccgtactcgcccgccacgcga

SEQ ID NO: 185704 - DNA, 37 bp, Artificial Sequence
  Synthetic oligonucleotide
atcttcagcctgttgccgtcccatctttacacctcga

SEQ ID NO: 185705 - DNA, 37 bp, Artificial Sequence
  Synthetic oligonucleotide
actcaactgccgtcccgcaaacgccaccccgcctcga

SEQ ID NO: 185706 - DNA, 37 bp, Artificial Sequence
  Synthetic oligonucleotide
tttacccgccgttctgcccttaggcgtcctgtctcga

SEQ ID NO: 185707 - DNA, 37 bp, Artificial Sequence
  Synthetic oligonucleotide
gggattggaaagggtatgaacaggggcgggggaagga

SEQ ID NO: 185708 - DNA, 37 bp, Artificial Sequence
  Synthetic oligonucleotide
gggggtgggatgggaaaacgttgcgggtctaagagga

SEQ ID NO: 185709 - DNA, 35 bp, Artificial Sequence
  Synthetic oligonucleotide
gctggccactcctgcattatatttcacgttccgga

SEQ ID NO: 185710 - DNA, 36 bp, Artificial Sequence
  Synthetic oligonucleotide
gatgggcggggataacgggcttacgttgagcaggga

SEQ ID NO: 185711 - DNA, 37 bp, Artificial Sequence
  Synthetic oligonucleotide
tgcacggtggggggggcgagtaagtaacgcgtaggga

SEQ ID NO: 185712 - DNA, 36 bp, Artificial Sequence
  Synthetic oligonucleotide
acgatcagagcaaaatgggaagtggcgggaagggga

SEQ ID NO: 185713 - DNA, 37 bp, Artificial Sequence
  Synthetic oligonucleotide
gatcagccagtgcgtagattagaacggggggagggga

SEQ ID NO: 185714 - DNA, 37 bp, Artificial Sequence
  Synthetic oligonucleotide
tatgggaaggggaaggtggttcgtggttgatcgggga

SEQ ID NO: 185715 - DNA, 36 bp, Artificial Sequence
  Synthetic oligonucleotide
agttgaggccggggctgagacggagagtggggggga

SEQ ID NO: 185716 - DNA, 37 bp, Artificial Sequence
  Synthetic oligonucleotide
aaggaggacgttgcggacggaggggcttgggaatgga

SEQ ID NO: 185717 - DNA, 37 bp, Artificial Sequence
  Synthetic oligonucleotide
gtccgggtggagggcgtacgtgggagggtgctatgga

SEQ ID NO: 185718 - DNA, 37 bp, Artificial Sequence
  Synthetic oligonucleotide
tcgcactcaccgacagcttctatcccctcgcacatga

SEQ ID NO: 185719 - DNA, 38 bp, Artificial Sequence
  Synthetic oligonucleotide
gccctttgccgtccatctgcccaacctcgccgccatga

SEQ ID NO: 185720 - DNA, 37 bp, Artificial Sequence
  Synthetic oligonucleotide
gagatactgcgggagacagaggcggggggagggatga

SEQ ID NO: 185721 - DNA, 36 bp, Artificial Sequence
  Synthetic oligonucleotide
gctcagtcccttccacgtgccttgcccacttactga

SEQ ID NO: 185722 - DNA, 38 bp, Artificial Sequence
  Synthetic oligonucleotide
accaccctagaccgcccattagttgcaattcatcctga

SEQ ID NO: 185723 - DNA, 37 bp, Artificial Sequence
  Synthetic oligonucleotide
agaccacccacgccactgttattgtttacactcctga

SEQ ID NO: 185724 - DNA, 37 bp, Artificial Sequence
  Synthetic oligonucleotide
aacccagacccacctgctgatggtgccactccgctga

SEQ ID NO: 185725 - DNA, 38 bp, Artificial Sequence
  Synthetic oligonucleotide
gcgggacacgcacatgtgcttttttcccttcctgctga

SEQ ID NO: 185726 - DNA, 38 bp, Artificial Sequence
  Synthetic oligonucleotide
gccccctcctctccacttattcgatcagtccgtgctga

SEQ ID NO: 185727 - DNA, 38 bp, Artificial Sequence
  Synthetic oligonucleotide
gagaatgaacaggtgcgagataagcggggtggaggtga

SEQ ID NO: 185728 - DNA, 37 bp, Artificial Sequence
  Synthetic oligonucleotide
gaaggagggggtcgaagggcattggtgcgcgtggtga

SEQ ID NO: 185729 - DNA, 36 bp, Artificial Sequence
  Synthetic oligonucleotide
gtgcccaccagccttaccgtccctttacttctgtga

SEQ ID NO: 185730 - DNA, 37 bp, Artificial Sequence
  Synthetic oligonucleotide
gggacggtggaggaggagatacagagaagggaattga

SEQ ID NO: 185731 - DNA, 38 bp, Artificial Sequence
  Synthetic oligonucleotide
ggtgcaccagccgctgctaacctatccatgctccttga

SEQ ID NO: 185732 - DNA, 36 bp, Artificial Sequence
  Synthetic oligonucleotide
tacctctagcctcacgtcgtctctccgcaatcttga

SEQ ID NO: 185733 - DNA, 37 bp, Artificial Sequence
  Synthetic oligonucleotide
aacacactccacgatctagtcctcttcacagtcttga

SEQ ID NO: 185734 - DNA, 36 bp, Artificial Sequence
  Synthetic oligonucleotide
tcatatcgcgcccctctccgtccttcgactggttga

SEQ ID NO: 185735 - DNA, 38 bp, Artificial Sequence
  Synthetic oligonucleotide
ttccacccgtcgccccttgccatcctctgtctggttga

SEQ ID NO: 185736 - DNA, 38 bp, Artificial Sequence
  Synthetic oligonucleotide
cacccgcctcacttgcctcctacgactcctgcttttga

SEQ ID NO: 185737 - DNA, 38 bp, Artificial Sequence
  Synthetic oligonucleotide
acacttccgacacttatggtaatgccgcccctttttga

SEQ ID NO: 185738 - DNA, 36 bp, Artificial Sequence
  Synthetic oligonucleotide
tcctgctccggccttgacactctacagacctgcata

SEQ ID NO: 185739 - DNA, 36 bp, Artificial Sequence
  Synthetic oligonucleotide
gtccacccgccctcaaattaccggtacctgtgcata

SEQ ID NO: 185740 - DNA, 35 bp, Artificial Sequence
  Synthetic oligonucleotide
gcgagagccgctcaatgtccccggttcccttcata

SEQ ID NO: 185741 - DNA, 35 bp, Artificial Sequence
  Synthetic oligonucleotide
atctggaccgccgacgtgatactcttgctctccta

SEQ ID NO: 185742 - DNA, 35 bp, Artificial Sequence
  Synthetic oligonucleotide
tcgctccacctcaagctggtctctgttgattccta

SEQ ID NO: 185743 - DNA, 35 bp, Artificial Sequence
  Synthetic oligonucleotide
acccccgatacgtccagttcacggtccatttccta

SEQ ID NO: 185744 - DNA, 36 bp, Artificial Sequence
  Synthetic oligonucleotide
tactctgcccatcattgtcctgcccgcgcccttcta

SEQ ID NO: 185745 - DNA, 36 bp, Artificial Sequence
  Synthetic oligonucleotide
acagggtacgaggctggaggggaggggtatacagta

SEQ ID NO: 185746 - DNA, 36 bp, Artificial Sequence
  Synthetic oligonucleotide
tatcccgcccgatgcgaagccctgcaatttctcgta

SEQ ID NO: 185747 - DNA, 35 bp, Artificial Sequence
  Synthetic oligonucleotide
ttgccaccccatctttccggatcgtaccggcggta

SEQ ID NO: 185748 - DNA, 36 bp, Artificial Sequence
  Synthetic oligonucleotide
tgtccacatccatgcgcataatccacccgtccctta

SEQ ID NO: 185749 - DNA, 35 bp, Artificial Sequence
  Synthetic oligonucleotide
ggtcaatctccgtctcgtacctgtcccgtgtctta

SEQ ID NO: 185750 - DNA, 35 bp, Artificial Sequence
  Synthetic oligonucleotide
tcgccacttccggcccggttagcccgcacttttta

SEQ ID NO: 185751 - DNA, 35 bp, Artificial Sequence
  Synthetic oligonucleotide
gatccctcgtccatccttgctgatccggtcgtaac

SEQ ID NO: 185752 - DNA, 35 bp, Artificial Sequence
  Synthetic oligonucleotide
ggactcgaatcgggtctctctcttcccagttacac

SEQ ID NO: 185753 - DNA, 35 bp, Artificial Sequence
  Synthetic oligonucleotide
attcctgcccaggtccagcattgtaaccttcccac

SEQ ID NO: 185754 - DNA, 35 bp, Artificial Sequence
  Synthetic oligonucleotide
gtcactcccctgtcctgctacatattatgctctac

SEQ ID NO: 185755 - DNA, 35 bp, Artificial Sequence
  Synthetic oligonucleotide
aacttacacctgcagttgttttccatccttagtac

SEQ ID NO: 185756 - DNA, 35 bp, Artificial Sequence
  Synthetic oligonucleotide
tcgcggcctcacatctctgaccatgcgcaatttac

SEQ ID NO: 185757 - DNA, 35 bp, Artificial Sequence
  Synthetic oligonucleotide
gcccaccgattgaaagtcccccgctgtccagtacc

SEQ ID NO: 185758 - DNA, 36 bp, Artificial Sequence
  Synthetic oligonucleotide
aacccttgcgcgcccaccgtgttccttcatcgtacc

SEQ ID NO: 185759 - DNA, 35 bp, Artificial Sequence
  Synthetic oligonucleotide
gccatctacagccgctttgtaccacacccgtcccc

SEQ ID NO: 185760 - DNA, 35 bp, Artificial Sequence
  Synthetic oligonucleotide
tgcccctccgacctctattatagcactgctggccc

SEQ ID NO: 185761 - DNA, 35 bp, Artificial Sequence
  Synthetic oligonucleotide
gttccgctgtgacacacgccgcctgccctgtgccc

SEQ ID NO: 185762 - DNA, 35 bp, Artificial Sequence
  Synthetic oligonucleotide
ggatcatcgcgtgccttactttgctcgactctccc

SEQ ID NO: 185763 - DNA, 35 bp, Artificial Sequence
  Synthetic oligonucleotide
accatctcgaaaattggccatcataccagcccgcc

SEQ ID NO: 185764 - DNA, 35 bp, Artificial Sequence
  Synthetic oligonucleotide
gcgcccatccccgcctctgttggcccgcttaggcc

SEQ ID NO: 185765 - DNA, 35 bp, Artificial Sequence
  Synthetic oligonucleotide
gaacgcccagtggcctggtccgttatttcgcctcc

SEQ ID NO: 185766 - DNA, 35 bp, Artificial Sequence
  Synthetic oligonucleotide
ttcgcaccctacaccttgcgacccagaccacccgc

SEQ ID NO: 185767 - DNA, 35 bp, Artificial Sequence
  Synthetic oligonucleotide
gcgccattaattcacgtcgatgtagccccccccgc

SEQ ID NO: 185768 - DNA, 35 bp, Artificial Sequence
  Synthetic oligonucleotide
ttcgcgacaagcgcattgcccccgaacacctccgc

SEQ ID NO: 185769 - DNA, 35 bp, Artificial Sequence
  Synthetic oligonucleotide
aaatgaccactgaagggctcgggaagggagggcgc

SEQ ID NO: 185770 - DNA, 35 bp, Artificial Sequence
  Synthetic oligonucleotide
acctgcccccttcctgtaatgcgaattgtcccggc

SEQ ID NO: 185771 - DNA, 35 bp, Artificial Sequence
  Synthetic oligonucleotide
acagccgcctctcactcgaagggtacccctctggc

SEQ ID NO: 185772 - DNA, 35 bp, Artificial Sequence
  Synthetic oligonucleotide
agttacctgttcgctgcctcctatcactccactgc

SEQ ID NO: 185773 - DNA, 35 bp, Artificial Sequence
  Synthetic oligonucleotide
tgagccggtcctgttcacatgcgttctcccgctgc

SEQ ID NO: 185774 - DNA, 35 bp, Artificial Sequence
  Synthetic oligonucleotide
gccacgccctgccaacccgccagggttacgtaatc

SEQ ID NO: 185775 - DNA, 34 bp, Artificial Sequence
  Synthetic oligonucleotide
tatgtgacaccgcgccttccgcctaatttacatc

SEQ ID NO: 185776 - DNA, 35 bp, Artificial Sequence
  Synthetic oligonucleotide
ttcccccctgcgcccactcgactcggcattctatc

SEQ ID NO: 185777 - DNA, 35 bp, Artificial Sequence
  Synthetic oligonucleotide
tgcccactcggaagggcaagcactatcctcgcctc

SEQ ID NO: 185778 - DNA, 35 bp, Artificial Sequence
  Synthetic oligonucleotide
gatcggtccattcctcattttcattcctggggctc

SEQ ID NO: 185779 - DNA, 35 bp, Artificial Sequence
  Synthetic oligonucleotide
tcacgccaccattcctgtgcttctcaaggaatctc

SEQ ID NO: 185780 - DNA, 35 bp, Artificial Sequence
  Synthetic oligonucleotide
actgacacacctcgagccttctgcatctgtctctc

SEQ ID NO: 185781 - DNA, 34 bp, Artificial Sequence
  Synthetic oligonucleotide
tatgttcaccgctccatggttctttcgtttggtc

SEQ ID NO: 185782 - DNA, 35 bp, Artificial Sequence
  Synthetic oligonucleotide
gcctcgcctattataccctcacggtctgtccattc

SEQ ID NO: 185783 - DNA, 35 bp, Artificial Sequence
  Synthetic oligonucleotide
atctacattgcgtcccctctctccgatccgcattc

SEQ ID NO: 185784 - DNA, 35 bp, Artificial Sequence
  Synthetic oligonucleotide
gactcacaattccgccacactctgtactaggcttc

SEQ ID NO: 185785 - DNA, 35 bp, Artificial Sequence
  Synthetic oligonucleotide
gcctcgcctgaaagacgttattggccctctctttc

SEQ ID NO: 185786 - DNA, 35 bp, Artificial Sequence
  Synthetic oligonucleotide
gagggacggggaggggctcaggtggacagttacag

SEQ ID NO: 185787 - DNA, 35 bp, Artificial Sequence
  Synthetic oligonucleotide
tcattgcattgccaccccgccttaggacagactag

SEQ ID NO: 185788 - DNA, 35 bp, Artificial Sequence
  Synthetic oligonucleotide
acctgcgcatccggagcacgatccctccttcctag

SEQ ID NO: 185789 - DNA, 35 bp, Artificial Sequence
  Synthetic oligonucleotide
ttgcctctgccccaccgtgtcgttccatactctag

SEQ ID NO: 185790 - DNA, 35 bp, Artificial Sequence
  Synthetic oligonucleotide
gccaaaccgctctgcttcgtttttccctctcgacg

SEQ ID NO: 185791 - DNA, 35 bp, Artificial Sequence
  Synthetic oligonucleotide
acttggtcaacttcctatctgctatactccccgcg

SEQ ID NO: 185792 - DNA, 35 bp, Artificial Sequence
  Synthetic oligonucleotide
agtgacgccagttgcaccacaccacgctaccatcg

SEQ ID NO: 185793 - DNA, 35 bp, Artificial Sequence
  Synthetic oligonucleotide
aatccatctacccgcacatgtgtcatcggtgctcg

SEQ ID NO: 185794 - DNA, 35 bp, Artificial Sequence
  Synthetic oligonucleotide
gtagatctgcatacttcgccgttacgctcccttcg

SEQ ID NO: 185795 - DNA, 35 bp, Artificial Sequence
  Synthetic oligonucleotide
gatgacatgaatcgtgggagggctggatgatgagg

SEQ ID NO: 185796 - DNA, 35 bp, Artificial Sequence
  Synthetic oligonucleotide
gcctgctgctcactgtccttcgtcttattcactgg

SEQ ID NO: 185797 - DNA, 35 bp, Artificial Sequence
  Synthetic oligonucleotide
atctccccgccatcccggcataacccatgaacatg

SEQ ID NO: 185798 - DNA, 35 bp, Artificial Sequence
  Synthetic oligonucleotide
ttcacgccgaagaaatcacatgtaccgtccccctg

SEQ ID NO: 185799 - DNA, 35 bp, Artificial Sequence
  Synthetic oligonucleotide
gatgcacacagctcgcgtacacccttccattcctg

SEQ ID NO: 185800 - DNA, 35 bp, Artificial Sequence
  Synthetic oligonucleotide
aatggccccgctacgttcgttcatgctcgctcttg

SEQ ID NO: 185801 - DNA, 35 bp, Artificial Sequence
  Synthetic oligonucleotide
atggtgtatcactccaccaactccctccttgtttg

SEQ ID NO: 185802 - DNA, 35 bp, Artificial Sequence
  Synthetic oligonucleotide
attcgccgcccgcctcaagtccctcttaatttttg

SEQ ID NO: 185803 - DNA, 35 bp, Artificial Sequence
  Synthetic oligonucleotide
ggtgccccatccagccttttcctgttacgactaat

SEQ ID NO: 185804 - DNA, 35 bp, Artificial Sequence
  Synthetic oligonucleotide
gacagtctatccaggtccatattgccgctgcccat

SEQ ID NO: 185805 - DNA, 35 bp, Artificial Sequence
  Synthetic oligonucleotide
aatggccacccgccttgtcgcctaaatcttactat

SEQ ID NO: 185806 - DNA, 35 bp, Artificial Sequence
  Synthetic oligonucleotide
acactgcgcggctctaagatccccctgcttccact

SEQ ID NO: 185807 - DNA, 35 bp, Artificial Sequence
  Synthetic oligonucleotide
ttcccctccgacgttccgagtccatggccctcact

SEQ ID NO: 185808 - DNA, 35 bp, Artificial Sequence
  Synthetic oligonucleotide
tcccctgaccccttgtgttatttcaattatcccct

SEQ ID NO: 185809 - DNA, 35 bp, Artificial Sequence
  Synthetic oligonucleotide
cacaccctccgttgcccctgttctttagatgtcct

SEQ ID NO: 185810 - DNA, 35 bp, Artificial Sequence
  Synthetic oligonucleotide
gccatcacgctccggagcaatatcgcccctcatct

SEQ ID NO: 185811 - DNA, 35 bp, Artificial Sequence
  Synthetic oligonucleotide
acagcgaatcatcggtatgcacccacttcacctct

SEQ ID NO: 185812 - DNA, 35 bp, Artificial Sequence
  Synthetic oligonucleotide
ttcgaccaggctagggacctgcctcttatacctct

SEQ ID NO: 185813 - DNA, 35 bp, Artificial Sequence
  Synthetic oligonucleotide
tatacgatcgcgcctttagttcctagttgtcctct

SEQ ID NO: 185814 - DNA, 35 bp, Artificial Sequence
  Synthetic oligonucleotide
tccgcgcatgcagacatttctcttcgttgctctct

SEQ ID NO: 185815 - DNA, 35 bp, Artificial Sequence
  Synthetic oligonucleotide
gccaaccgttactgcctgggccgccctgaccgtct

SEQ ID NO: 185816 - DNA, 33 bp, Artificial Sequence
  Synthetic oligonucleotide
atatcctccgcgcattacgcagcccagccttct

SEQ ID NO: 185817 - DNA, 35 bp, Artificial Sequence
  Synthetic oligonucleotide
gtacaccccgtgttaatcgctacctgacacctcgt

SEQ ID NO: 185818 - DNA, 34 bp, Artificial Sequence
  Synthetic oligonucleotide
acgccatctgcggttcacactgtctctccacggt

SEQ ID NO: 185819 - DNA, 35 bp, Artificial Sequence
  Synthetic oligonucleotide
atgtatccctcatcttgtccgctacttccaatggt

SEQ ID NO: 185820 - DNA, 35 bp, Artificial Sequence
  Synthetic oligonucleotide
tccgctcctctgcgtatttcttcgtccacccttgt

SEQ ID NO: 185821 - DNA, 35 bp, Artificial Sequence
  Synthetic oligonucleotide
taacatggcctcatgatccaacgctccatccttgt

SEQ ID NO: 185822 - DNA, 35 bp, Artificial Sequence
  Synthetic oligonucleotide
gcccagccgtagttagccatagttccgcctgcatt

SEQ ID NO: 185823 - DNA, 35 bp, Artificial Sequence
  Synthetic oligonucleotide
agccctagcaccccggtttatcactccacttcatt

SEQ ID NO: 185824 - DNA, 35 bp, Artificial Sequence
  Synthetic oligonucleotide
gttccagttccatgtcttcgctgctggcacacctt

SEQ ID NO: 185825 - DNA, 35 bp, Artificial Sequence
  Synthetic oligonucleotide
gatctcccagccctccactcgccccggacctggtt

SEQ ID NO: 185826 - DNA, 35 bp, Artificial Sequence
  Synthetic oligonucleotide
gtaccgagcggcctgcttctctaggtcacccattt

SEQ ID NO: 185827 - DNA, 36 bp, Artificial Sequence
  Synthetic oligonucleotide
attggtgaagcagtagagaagggcgggctagaaaaa

SEQ ID NO: 185828 - DNA, 36 bp, Artificial Sequence
  Synthetic oligonucleotide
tacatggcaagaaagggaggaacggggggtgtaaaa

SEQ ID NO: 185829 - DNA, 35 bp, Artificial Sequence
  Synthetic oligonucleotide
tacacggccggatcgtacccctcccagctccacaa

SEQ ID NO: 185830 - DNA, 36 bp, Artificial Sequence
  Synthetic oligonucleotide
tcgtcgacccgcccatgcgcaacgcctctataccaa

SEQ ID NO: 185831 - DNA, 35 bp, Artificial Sequence
  Synthetic oligonucleotide
tattctatccgacctgcgtacgcgcccgctcccaa

SEQ ID NO: 185832 - DNA, 36 bp, Artificial Sequence
  Synthetic oligonucleotide
acaccttctcatgccgtttttcctggcccacaggaa

SEQ ID NO: 185833 - DNA, 35 bp, Artificial Sequence
  Synthetic oligonucleotide
gtgcatcccgtcgtcttacttctggtccttgctaa

SEQ ID NO: 185834 - DNA, 36 bp, Artificial Sequence
  Synthetic oligonucleotide
agctccccacctgttttgcctgtttattttcaacca

SEQ ID NO: 185835 - DNA, 35 bp, Artificial Sequence
  Synthetic oligonucleotide
gctacgacgacgaggcggctcccgtttcctcccca

SEQ ID NO: 185836 - DNA, 35 bp, Artificial Sequence
  Synthetic oligonucleotide
tagcccaacccctatgctttggttaaatcatccca

SEQ ID NO: 185837 - DNA, 36 bp, Artificial Sequence
  Synthetic oligonucleotide
tgccaccatccccagcaagctgacgcattaccgcca

SEQ ID NO: 185838 - DNA, 36 bp, Artificial Sequence
  Synthetic oligonucleotide
gcgagagcgcttgttttcgtagccactccgcctcca

SEQ ID NO: 185839 - DNA, 35 bp, Artificial Sequence
  Synthetic oligonucleotide
taacacgcggggctttgtacgttcctgtccgcgca

SEQ ID NO: 185840 - DNA, 36 bp, Artificial Sequence
  Synthetic oligonucleotide
aacatcgcgttggctccatcgatacccttctgcgca

SEQ ID NO: 185841 - DNA, 36 bp, Artificial Sequence
  Synthetic oligonucleotide
acacccactcctttgtagcaacacccatagttcgca

SEQ ID NO: 185842 - DNA, 37 bp, Artificial Sequence
  Synthetic oligonucleotide
ggagtggacggggggacgagcggaaattccggaggca

SEQ ID NO: 185843 - DNA, 35 bp, Artificial Sequence
  Synthetic oligonucleotide
gcctgcctcgccttaaatagttttcaccttgtgca

SEQ ID NO: 185844 - DNA, 36 bp, Artificial Sequence
  Synthetic oligonucleotide
gttaccgtcaaccctggcacctcctacgatcttgca

SEQ ID NO: 185845 - DNA, 36 bp, Artificial Sequence
  Synthetic oligonucleotide
gacccgggcccttccctccatgaccataggacatca

SEQ ID NO: 185846 - DNA, 36 bp, Artificial Sequence
  Synthetic oligonucleotide
gtaccagtcccagactccttgacgcctaccccctca

SEQ ID NO: 185847 - DNA, 35 bp, Artificial Sequence
  Synthetic oligonucleotide
tccgaggccctcgatagttcttgtccgttccctca

SEQ ID NO: 185848 - DNA, 36 bp, Artificial Sequence
  Synthetic oligonucleotide
gatcgctgtcggtccacctggtttaacctccgctca

SEQ ID NO: 185849 - DNA, 36 bp, Artificial Sequence
  Synthetic oligonucleotide
gctgacatagtgcgttgatcgccgttttccatttca

SEQ ID NO: 185850 - DNA, 36 bp, Artificial Sequence
  Synthetic oligonucleotide
tcatcacgcgcgcctgtcgtcgccccactgttttca

SEQ ID NO: 185851 - DNA, 37 bp, Artificial Sequence
  Synthetic oligonucleotide
acactacccctccgtcttcgcttgctcgtcctccaga

SEQ ID NO: 185852 - DNA, 37 bp, Artificial Sequence
  Synthetic oligonucleotide
tcagtcaaagtcgggggagggatggcagtggtggaga

SEQ ID NO: 185853 - DNA, 37 bp, Artificial Sequence
  Synthetic oligonucleotide
ggtttggcgacgggggggaggcaaggaacaacgtaga

SEQ ID NO: 185854 - DNA, 37 bp, Artificial Sequence
  Synthetic oligonucleotide
tcagccgttcgacaatccgcctatcgtcctctaccga

SEQ ID NO: 185855 - DNA, 37 bp, Artificial Sequence
  Synthetic oligonucleotide
gcactacgcggctaaccgactatcttgcaccccccga

SEQ ID NO: 185856 - DNA, 36 bp, Artificial Sequence
  Synthetic oligonucleotide
tgaatgcgcctagttctcgcttacttcacgccccga

SEQ ID NO: 185857 - DNA, 35 bp, Artificial Sequence
  Synthetic oligonucleotide
tctccaccccattcttattagacgccaatgcccga

SEQ ID NO: 185858 - DNA, 37 bp, Artificial Sequence
  Synthetic oligonucleotide
agttaacgcatcaccgtgcactgtcccctcccgccga

SEQ ID NO: 185859 - DNA, 37 bp, Artificial Sequence
  Synthetic oligonucleotide
gacacttcagtaccgccgcccttgatcctcattccga

SEQ ID NO: 185860 - DNA, 37 bp, Artificial Sequence
  Synthetic oligonucleotide
gctgagcaggaaacggggtggagaatttgaggggcga

SEQ ID NO: 185861 - DNA, 37 bp, Artificial Sequence
  Synthetic oligonucleotide
tgggggggagggataacggaggggggaggtaaatcga

SEQ ID NO: 185862 - DNA, 36 bp, Artificial Sequence
  Synthetic oligonucleotide
gatgcatgggaagggcctgaggagatagcgcgtcga

SEQ ID NO: 185863 - DNA, 36 bp, Artificial Sequence
  Synthetic oligonucleotide
ttgccacgcggcactgcctagcaacttcttcttcga

SEQ ID NO: 185864 - DNA, 37 bp, Artificial Sequence
  Synthetic oligonucleotide
actaacgaacagggaggggttgaggtgggaccaagga

SEQ ID NO: 185865 - DNA, 35 bp, Artificial Sequence
  Synthetic oligonucleotide
ttaggacagggggggcgacggttcaggggagagga

SEQ ID NO: 185866 - DNA, 37 bp, Artificial Sequence
  Synthetic oligonucleotide
agcccaccggccgggagttagggaggtagggggagga

SEQ ID NO: 185867 - DNA, 37 bp, Artificial Sequence
  Synthetic oligonucleotide
gcaatgagtgatggtataagaaggggggcgggacgga

SEQ ID NO: 185868 - DNA, 37 bp, Artificial Sequence
  Synthetic oligonucleotide
acccaccgatgacctgcttgatatcacgccctacgga

SEQ ID NO: 185869 - DNA, 37 bp, Artificial Sequence
  Synthetic oligonucleotide
gggagcaggacaagtacggaatcaaaagggggaggga

SEQ ID NO: 185870 - DNA, 35 bp, Artificial Sequence
  Synthetic oligonucleotide
tctacacaaaggtggtggatggggtggggccggga

SEQ ID NO: 185871 - DNA, 35 bp, Artificial Sequence
  Synthetic oligonucleotide
gttgaagtcgggtagggagacgagacgggtcggga

SEQ ID NO: 185872 - DNA, 37 bp, Artificial Sequence
  Synthetic oligonucleotide
agggcgggtggggtgatctactatagtcatgtcggga

SEQ ID NO: 185873 - DNA, 37 bp, Artificial Sequence
  Synthetic oligonucleotide
tagggcgacgggtgggactgggaacggacgcagggga

SEQ ID NO: 185874 - DNA, 36 bp, Artificial Sequence
  Synthetic oligonucleotide
agtggggcaaagggggtaaggggcactatgcgggga

SEQ ID NO: 185875 - DNA, 35 bp, Artificial Sequence
  Synthetic oligonucleotide
atggtctgggcgggagggacatccgagccggggga

SEQ ID NO: 185876 - DNA, 35 bp, Artificial Sequence
  Synthetic oligonucleotide
gacgtggcaacctgcctgcctttaatctccatgga

SEQ ID NO: 185877 - DNA, 37 bp, Artificial Sequence
  Synthetic oligonucleotide
gcgctcatcaagtgcgttctgccaccgccctcctgga

SEQ ID NO: 185878 - DNA, 37 bp, Artificial Sequence
  Synthetic oligonucleotide
aagggatcaggacggagggcaagggcaaagtggtgga

SEQ ID NO: 185879 - DNA, 37 bp, Artificial Sequence
  Synthetic oligonucleotide
tcggagggagggaatgcatgggtgggaagactttgga

SEQ ID NO: 185880 - DNA, 37 bp, Artificial Sequence
  Synthetic oligonucleotide
gctgtcacggtccccctgttcgcctcgcttcccatga

SEQ ID NO: 185881 - DNA, 38 bp, Artificial Sequence
  Synthetic oligonucleotide
acactgtggtccatcgctcatcccagccctatccatga

SEQ ID NO: 185882 - DNA, 37 bp, Artificial Sequence
  Synthetic oligonucleotide
aaggatagtgaaggggtgtgaacgggcagggagatga

SEQ ID NO: 185883 - DNA, 38 bp, Artificial Sequence
  Synthetic oligonucleotide
gtcctcccccgatgtctacagacatcgcctacccctga

SEQ ID NO: 185884 - DNA, 36 bp, Artificial Sequence
  Synthetic oligonucleotide
aacgtcccgcactgagcctctcaccctcgcccctga

SEQ ID NO: 185885 - DNA, 37 bp, Artificial Sequence
  Synthetic oligonucleotide
acccgccctgttatacatctttcccccgttggcctga

SEQ ID NO: 185886 - DNA, 37 bp, Artificial Sequence
  Synthetic oligonucleotide
tgtacgcctcaccctaatgttgggtcgcccttcctga

SEQ ID NO: 185887 - DNA, 38 bp, Artificial Sequence
  Synthetic oligonucleotide
gtgggctccacctggccatatggcccctcctttcctga

SEQ ID NO: 185888 - DNA, 38 bp, Artificial Sequence
  Synthetic oligonucleotide
gtcaggcccgcgcactttaccgcctccgcccttgctga

SEQ ID NO: 185889 - DNA, 38 bp, Artificial Sequence
  Synthetic oligonucleotide
gaccccagatcccgtcgccgccccatacccatgtctga

SEQ ID NO: 185890 - DNA, 38 bp, Artificial Sequence
  Synthetic oligonucleotide
aacgacgcaaagagggaacgaggaagggcgagcggtga

SEQ ID NO: 185891 - DNA, 38 bp, Artificial Sequence
  Synthetic oligonucleotide
aaatggggagtccggtggtcggaggggtgacatggtga

SEQ ID NO: 185892 - DNA, 37 bp, Artificial Sequence
  Synthetic oligonucleotide
aacgcgccccgctcccaatgtcctcgtgtcccattga

SEQ ID NO: 185893 - DNA, 37 bp, Artificial Sequence
  Synthetic oligonucleotide
tgccctccccctctggccacgctagcaatcaccttga

SEQ ID NO: 185894 - DNA, 36 bp, Artificial Sequence
  Synthetic oligonucleotide
tgatgcccctccgttcctattagctccttcccttga

SEQ ID NO: 185895 - DNA, 37 bp, Artificial Sequence
  Synthetic oligonucleotide
taggaggacgagtgcagggacggagaggtgatgttga

SEQ ID NO: 185896 - DNA, 38 bp, Artificial Sequence
  Synthetic oligonucleotide
tgtcaatcccttgccttggtgtcgccctgttcctttga

SEQ ID NO: 185897 - DNA, 38 bp, Artificial Sequence
  Synthetic oligonucleotide
aagtcctacgccccgtttccgccgacactgccttttga

SEQ ID NO: 185898 - DNA, 36 bp, Artificial Sequence
  Synthetic oligonucleotide
tcctcacatcacgtgctacggccctcatggcaccta

SEQ ID NO: 185899 - DNA, 36 bp, Artificial Sequence
  Synthetic oligonucleotide
gcactccgacctcgtgattacaaccctgcctaccta

SEQ ID NO: 185900 - DNA, 36 bp, Artificial Sequence
  Synthetic oligonucleotide
gtcatactgccaaacattgttttggacccttaccta

SEQ ID NO: 185901 - DNA, 36 bp, Artificial Sequence
  Synthetic oligonucleotide
gcctctcaccgcccgcccgcatgccggaattatcta

SEQ ID NO: 185902 - DNA, 36 bp, Artificial Sequence
  Synthetic oligonucleotide
ttaacagtgcagtactgcatttctgtcgcctctcta

SEQ ID NO: 185903 - DNA, 36 bp, Artificial Sequence
  Synthetic oligonucleotide
tccgtaccacccaaatcgcgtctatccttaggtcta

SEQ ID NO: 185904 - DNA, 35 bp, Artificial Sequence
  Synthetic oligonucleotide
atgggaatcgacggaaaaggggccgaagggaggta

SEQ ID NO: 185905 - DNA, 35 bp, Artificial Sequence
  Synthetic oligonucleotide
gcatgaccagctgaacggggggactgggaagggta

SEQ ID NO: 185906 - DNA, 36 bp, Artificial Sequence
  Synthetic oligonucleotide
atcggtagggagtggtgaagcgggaaactgcgggta

SEQ ID NO: 185907 - DNA, 35 bp, Artificial Sequence
  Synthetic oligonucleotide
agcctccaacgcccgcttttccttcgtatactgta

SEQ ID NO: 185908 - DNA, 36 bp, Artificial Sequence
  Synthetic oligonucleotide
tgcccgcctacccctgtctattggcttttccgtgta

SEQ ID NO: 185909 - DNA, 36 bp, Artificial Sequence
  Synthetic oligonucleotide
aaggctggcccccacgcgttgttcttctcccttgta

SEQ ID NO: 185910 - DNA, 36 bp, Artificial Sequence
  Synthetic oligonucleotide
accccccgtgtttcctgttgtttgcttttaccctta

SEQ ID NO: 185911 - DNA, 36 bp, Artificial Sequence
  Synthetic oligonucleotide
gacgggaggagggtgggacctggttgacgaccgtta

SEQ ID NO: 185912 - DNA, 35 bp, Artificial Sequence
  Synthetic oligonucleotide
gacgatccttatgcctgtgtcctaccagcctgtta

SEQ ID NO: 185913 - DNA, 36 bp, Artificial Sequence
  Synthetic oligonucleotide
ttgcaccacccggcgtgccatcttcgggtctcttta

SEQ ID NO: 185914 - DNA, 36 bp, Artificial Sequence
  Synthetic oligonucleotide
tcagcctacgcccctattataacgtctctccgttta

SEQ ID NO: 185915 - DNA, 36 bp, Artificial Sequence
  Synthetic oligonucleotide
tgtcactccatcctgaggcgaccctttttctgttta

SEQ ID NO: 185916 - DNA, 35 bp, Artificial Sequence
  Synthetic oligonucleotide
gccaccccgccactcgcgccctcgactccctacac

SEQ ID NO: 185917 - DNA, 35 bp, Artificial Sequence
  Synthetic oligonucleotide
tccatcactgccctaattggttattcacagttgac

SEQ ID NO: 185918 - DNA, 35 bp, Artificial Sequence
  Synthetic oligonucleotide
gcctggcacctccgttctaaacacccgccatctac

SEQ ID NO: 185919 - DNA, 35 bp, Artificial Sequence
  Synthetic oligonucleotide
gagccctgatatcctcgcgcccttatgcttcgtac

SEQ ID NO: 185920 - DNA, 35 bp, Artificial Sequence
  Synthetic oligonucleotide
gcccacgccgacaacgtccggccctaacctgcacc

SEQ ID NO: 185921 - DNA, 35 bp, Artificial Sequence
  Synthetic oligonucleotide
gtccgactcatctccggcctttaagtttactaccc

SEQ ID NO: 185922 - DNA, 35 bp, Artificial Sequence
  Synthetic oligonucleotide
ttgcgatctctgacgctggtcccttcgtagtcccc

SEQ ID NO: 185923 - DNA, 35 bp, Artificial Sequence
  Synthetic oligonucleotide
aggacactcacacaggttcttttctgcacttcccc

SEQ ID NO: 185924 - DNA, 35 bp, Artificial Sequence
  Synthetic oligonucleotide
tccccatctcggccctaggaccactcgacatgccc

SEQ ID NO: 185925 - DNA, 35 bp, Artificial Sequence
  Synthetic oligonucleotide
tgctggtccgcaaaaacgctcggcccctattgccc

SEQ ID NO: 185926 - DNA, 35 bp, Artificial Sequence
  Synthetic oligonucleotide
atgtgcggagctgacgtccgaccagaccccctccc

SEQ ID NO: 185927 - DNA, 35 bp, Artificial Sequence
  Synthetic oligonucleotide
gacccacatcgtcgtcattcctagcatcttgtccc

SEQ ID NO: 185928 - DNA, 35 bp, Artificial Sequence
  Synthetic oligonucleotide
acgcccgctgtaggcgtggtccttcgctttgtccc

SEQ ID NO: 185929 - DNA, 35 bp, Artificial Sequence
  Synthetic oligonucleotide
gacccgtgcgcgccctcttcgctgatagctttccc

SEQ ID NO: 185930 - DNA, 35 bp, Artificial Sequence
  Synthetic oligonucleotide
tccaggaccatacgctgctgttgcttgtactcgcc

SEQ ID NO: 185931 - DNA, 35 bp, Artificial Sequence
  Synthetic oligonucleotide
tacgccttggccaagagttgctcctccacgcctcc

SEQ ID NO: 185932 - DNA, 35 bp, Artificial Sequence
  Synthetic oligonucleotide
actcactgcatatacgtcgccacatgagctcttcc

SEQ ID NO: 185933 - DNA, 35 bp, Artificial Sequence
  Synthetic oligonucleotide
atacctcgttctcgctcacatgaggtctccgttcc

SEQ ID NO: 185934 - DNA, 35 bp, Artificial Sequence
  Synthetic oligonucleotide
agccggatcatctcgtggctcaacacaccttttcc

SEQ ID NO: 185935 - DNA, 35 bp, Artificial Sequence
  Synthetic oligonucleotide
tcaccaccccatgctctggttctcgaacgttttcc

SEQ ID NO: 185936 - DNA, 35 bp, Artificial Sequence
  Synthetic oligonucleotide
gggggggacggggcgataagtagatgacggtaagc

SEQ ID NO: 185937 - DNA, 35 bp, Artificial Sequence
  Synthetic oligonucleotide
attgatctaccgacccgggcccacctgtgactcgc

SEQ ID NO: 185938 - DNA, 35 bp, Artificial Sequence
  Synthetic oligonucleotide
gtgtctcctcgcctcctcgtgctcagggctttggc

SEQ ID NO: 185939 - DNA, 35 bp, Artificial Sequence
  Synthetic oligonucleotide
atggccgccacctaacgttcattattgatccctgc

SEQ ID NO: 185940 - DNA, 35 bp, Artificial Sequence
  Synthetic oligonucleotide
gtcgcttcactgtcgtcgactcaccgttcgttatc

SEQ ID NO: 185941 - DNA, 35 bp, Artificial Sequence
  Synthetic oligonucleotide
tcccgcggcccgctccttgactgtgctctgtcctc

SEQ ID NO: 185942 - DNA, 35 bp, Artificial Sequence
  Synthetic oligonucleotide
gctaccactgaagtggcttctccacaccatatctc

SEQ ID NO: 185943 - DNA, 35 bp, Artificial Sequence
  Synthetic oligonucleotide
tgataccgcctatgcgatcgttgtcttcccgtctc

SEQ ID NO: 185944 - DNA, 35 bp, Artificial Sequence
  Synthetic oligonucleotide
tctgggcccgtgttgcgcccaccttgacccaattc

SEQ ID NO: 185945 - DNA, 35 bp, Artificial Sequence
  Synthetic oligonucleotide
gctagccacgcaatcgtacgtccgcctgcaccttc

SEQ ID NO: 185946 - DNA, 35 bp, Artificial Sequence
  Synthetic oligonucleotide
tggaccggcttagagttttcccagccccccccttc

SEQ ID NO: 185947 - DNA, 35 bp, Artificial Sequence
  Synthetic oligonucleotide
tagaacgtccacaattggccatcctgttctctttc

SEQ ID NO: 185948 - DNA, 35 bp, Artificial Sequence
  Synthetic oligonucleotide
ggggatggggtaagggcagtgagaggggagccaag

SEQ ID NO: 185949 - DNA, 35 bp, Artificial Sequence
  Synthetic oligonucleotide
gggcccgcccgctgctcccatcaccctcctcccag

SEQ ID NO: 185950 - DNA, 35 bp, Artificial Sequence
  Synthetic oligonucleotide
tgccccacacccagagtttaactacgccattaccg

SEQ ID NO: 185951 - DNA, 35 bp, Artificial Sequence
  Synthetic oligonucleotide
tgctcgcctattggtcctcgcccgttcgttacccg

SEQ ID NO: 185952 - DNA, 35 bp, Artificial Sequence
  Synthetic oligonucleotide
gtccgggccttatgtatccgcgatttaccaccccg

SEQ ID NO: 185953 - DNA, 35 bp, Artificial Sequence
  Synthetic oligonucleotide
tacccgttgtagtactggcctcattgaatcccccg

SEQ ID NO: 185954 - DNA, 35 bp, Artificial Sequence
  Synthetic oligonucleotide
gcgtccacgctgacctttgcatcataattcccccg

SEQ ID NO: 185955 - DNA, 35 bp, Artificial Sequence
  Synthetic oligonucleotide
gaacgcccgtccggtcagagcccatcaaacctccg

SEQ ID NO: 185956 - DNA, 35 bp, Artificial Sequence
  Synthetic oligonucleotide
gaggggggactcgaggatggagcgaggatgacgcg

SEQ ID NO: 185957 - DNA, 35 bp, Artificial Sequence
  Synthetic oligonucleotide
gattatgctccatcgccggcgcccatctgccatcg

SEQ ID NO: 185958 - DNA, 35 bp, Artificial Sequence
  Synthetic oligonucleotide
acctcacgtacatcatccaatcatcttggccctcg

SEQ ID NO: 185959 - DNA, 35 bp, Artificial Sequence
  Synthetic oligonucleotide
gcctcatcggcggtccccttcataccttaccttcg

SEQ ID NO: 185960 - DNA, 35 bp, Artificial Sequence
  Synthetic oligonucleotide
ggaaggtggaggtgaagattggatgggaggaaagg

SEQ ID NO: 185961 - DNA, 35 bp, Artificial Sequence
  Synthetic oligonucleotide
ccctcgccggatctccgccccccgtactacaccgg

SEQ ID NO: 185962 - DNA, 35 bp, Artificial Sequence
  Synthetic oligonucleotide
tccatagcgaacggggggagggaggattgggaggg

SEQ ID NO: 185963 - DNA, 35 bp, Artificial Sequence
  Synthetic oligonucleotide
acccttcccgttcagctaccttatgcccttccatg

SEQ ID NO: 185964 - DNA, 35 bp, Artificial Sequence
  Synthetic oligonucleotide
tctcgggcgtcgtgttcccccggtcatcctccctg

SEQ ID NO: 185965 - DNA, 35 bp, Artificial Sequence
  Synthetic oligonucleotide
ttgcgccctcccgaactgattagtacgcgatcttg

SEQ ID NO: 185966 - DNA, 35 bp, Artificial Sequence
  Synthetic oligonucleotide
acgcatgcccgcggctgctccctccatcgactttg

SEQ ID NO: 185967 - DNA, 35 bp, Artificial Sequence
  Synthetic oligonucleotide
gcgtagcgacccgcttgcctctatcaccgtttcat

SEQ ID NO: 185968 - DNA, 35 bp, Artificial Sequence
  Synthetic oligonucleotide
ttggcaagcacctcgcctttcataccgccgccgat

SEQ ID NO: 185969 - DNA, 35 bp, Artificial Sequence
  Synthetic oligonucleotide
agagatgcctgcattgtcgttccatctttgcctat

SEQ ID NO: 185970 - DNA, 35 bp, Artificial Sequence
  Synthetic oligonucleotide
accgctctccccatgttctcttagtctaaacacct

SEQ ID NO: 185971 - DNA, 35 bp, Artificial Sequence
  Synthetic oligonucleotide
gtcgactcctcttatcttgcccgctgagacatcct

SEQ ID NO: 185972 - DNA, 35 bp, Artificial Sequence
  Synthetic oligonucleotide
actccactgttcacctaaggccacgctcttgtcct

SEQ ID NO: 185973 - DNA, 35 bp, Artificial Sequence
  Synthetic oligonucleotide
gtcacgtcttgacgtgattcccccctgttttagct

SEQ ID NO: 185974 - DNA, 35 bp, Artificial Sequence
  Synthetic oligonucleotide
tccaaagagcgaagctgccccgatgcctgccctct

SEQ ID NO: 185975 - DNA, 35 bp, Artificial Sequence
  Synthetic oligonucleotide
tcccgtcacaatttgcccaagctgcccccttctct

SEQ ID NO: 185976 - DNA, 35 bp, Artificial Sequence
  Synthetic oligonucleotide
tcccacccgttatgggatattccacccttattagt

SEQ ID NO: 185977 - DNA, 35 bp, Artificial Sequence
  Synthetic oligonucleotide
tgcatggggtcataccgtcacgctccatctccggt

SEQ ID NO: 185978 - DNA, 35 bp, Artificial Sequence
  Synthetic oligonucleotide
accctgtcctctagtactgttatccctctccgggt

SEQ ID NO: 185979 - DNA, 35 bp, Artificial Sequence
  Synthetic oligonucleotide
tgtacccacatgtggcaccctttcgtttccatggt

SEQ ID NO: 185980 - DNA, 35 bp, Artificial Sequence
  Synthetic oligonucleotide
tcgcatccccctccctggttaatcctggcccttgt

SEQ ID NO: 185981 - DNA, 36 bp, Artificial Sequence
  Synthetic oligonucleotide
ttcgggcaccaccttcaccttgaatcgccctccatt

SEQ ID NO: 185982 - DNA, 35 bp, Artificial Sequence
  Synthetic oligonucleotide
gctccgtatggcccgtaccctgcatgttcagcatt

SEQ ID NO: 185983 - DNA, 35 bp, Artificial Sequence
  Synthetic oligonucleotide
atcgccccaccgtagccaacccgtgccttctgctt

SEQ ID NO: 185984 - DNA, 35 bp, Artificial Sequence
  Synthetic oligonucleotide
tgctcgctactcccctcccacagcgtatattcgtt

SEQ ID NO: 185985 - DNA, 35 bp, Artificial Sequence
  Synthetic oligonucleotide
gcccacccccgctggttcctgttcttgttaatgtt

SEQ ID NO: 185986 - DNA, 35 bp, Artificial Sequence
  Synthetic oligonucleotide
ttgtcgcacggcacacgcgcccttcctacaccttt

SEQ ID NO: 185987 - DNA, 35 bp, Artificial Sequence
  Synthetic oligonucleotide
gagcgcctccggactagcgcgccccctccttgttt

SEQ ID NO: 185988 - DNA, 35 bp, Artificial Sequence
  Synthetic oligonucleotide
ggtatgccccccattgttcaagttcttttgctttt

SEQ ID NO: 185989 - DNA, 36 bp, Artificial Sequence
  Synthetic oligonucleotide
accacacccgccccattgtacccatgtcgcacaaaa

SEQ ID NO: 185990 - DNA, 36 bp, Artificial Sequence
  Synthetic oligonucleotide
tctgtcgttagatagggcggggggggaaggataaaa

SEQ ID NO: 185991 - DNA, 36 bp, Artificial Sequence
  Synthetic oligonucleotide
tacaccacccgtaggcacacaggttcgacctagaaa

SEQ ID NO: 185992 - DNA, 36 bp, Artificial Sequence
  Synthetic oligonucleotide
taggggagggcgggttaaatgggtcggacaagtaaa

SEQ ID NO: 185993 - DNA, 35 bp, Artificial Sequence
  Synthetic oligonucleotide
gttcaccctcctgctggtccattggtagccccgaa

SEQ ID NO: 185994 - DNA, 35 bp, Artificial Sequence
  Synthetic oligonucleotide
tcaattcgctgaattgggttcctttgttcacttaa

SEQ ID NO: 185995 - DNA, 31 bp, Artificial Sequence
  Synthetic oligonucleotide
tgtaggaatagggggggagctacggggaaca

SEQ ID NO: 185996 - DNA, 36 bp, Artificial Sequence
  Synthetic oligonucleotide
agggaagggggtggggataggaaccttgagataaca

SEQ ID NO: 185997 - DNA, 36 bp, Artificial Sequence
  Synthetic oligonucleotide
actgctgatcctgattccctgtcgcactctttcaca

SEQ ID NO: 185998 - DNA, 36 bp, Artificial Sequence
  Synthetic oligonucleotide
acatgaagctgggtgggttcgggtcgtgggtgccca

SEQ ID NO: 185999 - DNA, 36 bp, Artificial Sequence
  Synthetic oligonucleotide
acccctcccgccctgtctcttagttacgtgatggca

SEQ ID NO: 186000 - DNA, 35 bp, Artificial Sequence
  Synthetic oligonucleotide
ttccaccatcgagcagccttgcactgcgacctgca

SEQ ID NO: 186001 - DNA, 35 bp, Artificial Sequence
  Synthetic oligonucleotide
tcacatccacgccttgtagacttcatgtttcatca

SEQ ID NO: 186002 - DNA, 36 bp, Artificial Sequence
  Synthetic oligonucleotide
agagtcacgcgctgtacgtaccaccccctttcctca

SEQ ID NO: 186003 - DNA, 36 bp, Artificial Sequence
  Synthetic oligonucleotide
actgcgcaaccatcctcattggccctccctgcgaga

SEQ ID NO: 186004 - DNA, 37 bp, Artificial Sequence
  Synthetic oligonucleotide
acactagtgcgtgcgggggggagggtggttcgctaga

SEQ ID NO: 186005 - DNA, 36 bp, Artificial Sequence
  Synthetic oligonucleotide
tagcgactccgcccgatttcgccccctgactttaga

SEQ ID NO: 186006 - DNA, 36 bp, Artificial Sequence
  Synthetic oligonucleotide
gtccagctccactgtctcatctagccccgcacacga

SEQ ID NO: 186007 - DNA, 37 bp, Artificial Sequence
  Synthetic oligonucleotide
acccactcacctctatacgcatcactctcggacacga

SEQ ID NO: 186008 - DNA, 36 bp, Artificial Sequence
  Synthetic oligonucleotide
tagccaccctaccctcctgactctcgcctcggacga

SEQ ID NO: 186009 - DNA, 37 bp, Artificial Sequence
  Synthetic oligonucleotide
tccccccgcatgtccctcacctaccgcagaactgcga

SEQ ID NO: 186010 - DNA, 36 bp, Artificial Sequence
  Synthetic oligonucleotide
gttcatacctcctcgtgtcccgtcgccttctatcga

SEQ ID NO: 186011 - DNA, 37 bp, Artificial Sequence
  Synthetic oligonucleotide
gcgcacccccccggcctgtagtagacgcctacttcga

SEQ ID NO: 186012 - DNA, 37 bp, Artificial Sequence
  Synthetic oligonucleotide
tgcgaaactagggggggtcaaaaagctgttgggagga

SEQ ID NO: 186013 - DNA, 35 bp, Artificial Sequence
  Synthetic oligonucleotide
ggagggagggctacagggggggatcaatgaccgga

SEQ ID NO: 186014 - DNA, 37 bp, Artificial Sequence
  Synthetic oligonucleotide
gtgtcgtatcattgctttcgccgtcccccgccccgga

SEQ ID NO: 186015 - DNA, 37 bp, Artificial Sequence
  Synthetic oligonucleotide
gctcgtgctgcacgctccttatgttccttcgcccgga

SEQ ID NO: 186016 - DNA, 37 bp, Artificial Sequence
  Synthetic oligonucleotide
ggaacgtgagacagggactgaatgggtggggggcgga

SEQ ID NO: 186017 - DNA, 37 bp, Artificial Sequence
  Synthetic oligonucleotide
gaagctgagggaatggatagggaggggctgtaaggga

SEQ ID NO: 186018 - DNA, 37 bp, Artificial Sequence
  Synthetic oligonucleotide
gaggggaggcggagagctacaagtggaattggcggga

SEQ ID NO: 186019 - DNA, 35 bp, Artificial Sequence
  Synthetic oligonucleotide
ggggtgggtacgtggggtctaactttttcagggga

SEQ ID NO: 186020 - DNA, 37 bp, Artificial Sequence
  Synthetic oligonucleotide
gggtcatagagggggtacgggagggacgcagggggga

SEQ ID NO: 186021 - DNA, 37 bp, Artificial Sequence
  Synthetic oligonucleotide
tgatgggaggaaggcacgggaggatggcacttgggga

SEQ ID NO: 186022 - DNA, 37 bp, Artificial Sequence
  Synthetic oligonucleotide
gtgaggggggatagcagatcggacagatagggtggga

SEQ ID NO: 186023 - DNA, 37 bp, Artificial Sequence
  Synthetic oligonucleotide
acatcactccacagctgcgtcctacactgcccctgga

SEQ ID NO: 186024 - DNA, 38 bp, Artificial Sequence
  Synthetic oligonucleotide
tgagcgttagtaccgtgacccccccgcctcacccatga

SEQ ID NO: 186025 - DNA, 38 bp, Artificial Sequence
  Synthetic oligonucleotide
tgaccattcatcttccctgttttcgcctgacacactga

SEQ ID NO: 186026 - DNA, 36 bp, Artificial Sequence
  Synthetic oligonucleotide
tgcctgctgcctatatttacgttcgcacctcactga

SEQ ID NO: 186027 - DNA, 38 bp, Artificial Sequence
  Synthetic oligonucleotide
gggggggagtggaggggtaacaccaatcaggcacctga

SEQ ID NO: 186028 - DNA, 36 bp, Artificial Sequence
  Synthetic oligonucleotide
acatttgctgtgcccgccgtgccttggaccccctga

SEQ ID NO: 186029 - DNA, 38 bp, Artificial Sequence
  Synthetic oligonucleotide
tgacccgtgcaaacgcctcccaacgatactccccctga

SEQ ID NO: 186030 - DNA, 38 bp, Artificial Sequence
  Synthetic oligonucleotide
gacgtgctgtcaccggggttctatcgctccatccctga

SEQ ID NO: 186031 - DNA, 36 bp, Artificial Sequence
  Synthetic oligonucleotide
gaccactcctcttttactcgctagaacactccctga

SEQ ID NO: 186032 - DNA, 37 bp, Artificial Sequence
  Synthetic oligonucleotide
tccgccctcgcacagactacctaccgtacctccgtga

SEQ ID NO: 186033 - DNA, 38 bp, Artificial Sequence
  Synthetic oligonucleotide
actgggagggccgggtagggaatcagactaattcgtga

SEQ ID NO: 186034 - DNA, 38 bp, Artificial Sequence
  Synthetic oligonucleotide
gccaccctccgttccagccgggctacacttgttcgtga

SEQ ID NO: 186035 - DNA, 36 bp, Artificial Sequence
  Synthetic oligonucleotide
ggtgccacgaggcggtgggaagggacgggagggtga

SEQ ID NO: 186036 - DNA, 38 bp, Artificial Sequence
  Synthetic oligonucleotide
ttccgccccccgctctattgccgttatgcccctggtga

SEQ ID NO: 186037 - DNA, 36 bp, Artificial Sequence
  Synthetic oligonucleotide
gtgcgtgccttccatgcgatgtcccgttccctgtga

SEQ ID NO: 186038 - DNA, 37 bp, Artificial Sequence
  Synthetic oligonucleotide
gacctgggcaaggtgaaggaaatgggaacgggtgtga

SEQ ID NO: 186039 - DNA, 37 bp, Artificial Sequence
  Synthetic oligonucleotide
tgggaggggcaatagtgggtcggggaaagggttgtga

SEQ ID NO: 186040 - DNA, 38 bp, Artificial Sequence
  Synthetic oligonucleotide
tacgtactggcgcaaacgtttcccttccctcgcattga

SEQ ID NO: 186041 - DNA, 37 bp, Artificial Sequence
  Synthetic oligonucleotide
ggtggggagcagaaggggggtgcacgggctgtattga

SEQ ID NO: 186042 - DNA, 38 bp, Artificial Sequence
  Synthetic oligonucleotide
tgccttgcctctatgtcagctcgcctcccctttattga

SEQ ID NO: 186043 - DNA, 38 bp, Artificial Sequence
  Synthetic oligonucleotide
acacctcctgctttgaacgcgccacatccttgacttga

SEQ ID NO: 186044 - DNA, 37 bp, Artificial Sequence
  Synthetic oligonucleotide
atggatgcgtctatcagcatccgttctccccccttga

SEQ ID NO: 186045 - DNA, 37 bp, Artificial Sequence
  Synthetic oligonucleotide
gcccaggacagttgtgtcccttgccgccccatcttga

SEQ ID NO: 186046 - DNA, 38 bp, Artificial Sequence
  Synthetic oligonucleotide
aaccgcacagcgcacctgccattattccctcgctttga

SEQ ID NO: 186047 - DNA, 38 bp, Artificial Sequence
  Synthetic oligonucleotide
tgcccccctcccgccactcgactgagaaccagttttga

SEQ ID NO: 186048 - DNA, 38 bp, Artificial Sequence
  Synthetic oligonucleotide
gctcactcgttccatgccccttatcgccttgtttttga

SEQ ID NO: 186049 - DNA, 36 bp, Artificial Sequence
  Synthetic oligonucleotide
taagcgcggaaccgccgttgccctcgccctggacta

SEQ ID NO: 186050 - DNA, 36 bp, Artificial Sequence
  Synthetic oligonucleotide
acgactcacatcgtggcccccttagttactttccta

SEQ ID NO: 186051 - DNA, 35 bp, Artificial Sequence
  Synthetic oligonucleotide
actcggcggtaggcgggggaggagaaggtggtcta

SEQ ID NO: 186052 - DNA, 36 bp, Artificial Sequence
  Synthetic oligonucleotide
gtgtgcaacaatgctcatccattcatccaccttgta

SEQ ID NO: 186053 - DNA, 36 bp, Artificial Sequence
  Synthetic oligonucleotide
gaatccgcccatagcttgttaacacctgctccctta

SEQ ID NO: 186054 - DNA, 36 bp, Artificial Sequence
  Synthetic oligonucleotide
gagggtggcgggtgggggtccatagggcgaacgtta

SEQ ID NO: 186055 - DNA, 36 bp, Artificial Sequence
  Synthetic oligonucleotide
tgaaacaatgggggaggggcgagtgagggtagttta

SEQ ID NO: 186056 - DNA, 36 bp, Artificial Sequence
  Synthetic oligonucleotide
gtgtccggtccggctcctgatcatcttccgctttta

SEQ ID NO: 186057 - DNA, 35 bp, Artificial Sequence
  Synthetic oligonucleotide
tcacacgccatcgccttcaacaagacttttaccac

SEQ ID NO: 186058 - DNA, 35 bp, Artificial Sequence
  Synthetic oligonucleotide
ataacatgcgcctcgactcttcgccacctgttcac

SEQ ID NO: 186059 - DNA, 35 bp, Artificial Sequence
  Synthetic oligonucleotide
ggacgccgcgcacgtctagtacacttcccgtctac

SEQ ID NO: 186060 - DNA, 35 bp, Artificial Sequence
  Synthetic oligonucleotide
gaatgccaggctggcagtccctagctccctcgtac

SEQ ID NO: 186061 - DNA, 35 bp, Artificial Sequence
  Synthetic oligonucleotide
gcacccgtgcagtcagatcaacccgctttcattac

SEQ ID NO: 186062 - DNA, 35 bp, Artificial Sequence
  Synthetic oligonucleotide
ttgccacgcgtgtagttaccgtacccttgctttac

SEQ ID NO: 186063 - DNA, 35 bp, Artificial Sequence
  Synthetic oligonucleotide
gatgcatccgccatccatagggcctatatcgaacc

SEQ ID NO: 186064 - DNA, 35 bp, Artificial Sequence
  Synthetic oligonucleotide
tcctccctgctctactcgagtctatctcgccgacc

SEQ ID NO: 186065 - DNA, 35 bp, Artificial Sequence
  Synthetic oligonucleotide
agtgcgaacccctggctatccctcgtacgctgacc

SEQ ID NO: 186066 - DNA, 35 bp, Artificial Sequence
  Synthetic oligonucleotide
accacgccccgcctgcactccctgtcatcttaccc

SEQ ID NO: 186067 - DNA, 35 bp, Artificial Sequence
  Synthetic oligonucleotide
aaagcgcgccgcaccctcttagctcagaccgcccc

SEQ ID NO: 186068 - DNA, 35 bp, Artificial Sequence
  Synthetic oligonucleotide
agaacgtccctgttgccggccgcagcacttgcccc

SEQ ID NO: 186069 - DNA, 35 bp, Artificial Sequence
  Synthetic oligonucleotide
tagacagaccgccaactgttttcgcaccggtcccc

SEQ ID NO: 186070 - DNA, 35 bp, Artificial Sequence
  Synthetic oligonucleotide
agtgtccctcggtgttcacatggcccatcttcccc

SEQ ID NO: 186071 - DNA, 35 bp, Artificial Sequence
  Synthetic oligonucleotide
gttaccagccccgtatccgtaggatcccatagccc

SEQ ID NO: 186072 - DNA, 35 bp, Artificial Sequence
  Synthetic oligonucleotide
gcaccgcatggtccaccagtcttgctttgtctccc

SEQ ID NO: 186073 - DNA, 35 bp, Artificial Sequence
  Synthetic oligonucleotide
tagaccatcagtttccgtaacggtccttttctccc

SEQ ID NO: 186074 - DNA, 35 bp, Artificial Sequence
  Synthetic oligonucleotide
gccaagctcccgctgcgatccactctcctatggcc

SEQ ID NO: 186075 - DNA, 35 bp, Artificial Sequence
  Synthetic oligonucleotide
atgacccctcttgcatggcgcatctatctttggcc

SEQ ID NO: 186076 - DNA, 35 bp, Artificial Sequence
  Synthetic oligonucleotide
accttttgcgccccgaacatgtttccataccctcc

SEQ ID NO: 186077 - DNA, 35 bp, Artificial Sequence
  Synthetic oligonucleotide
actatcgtgcgtatcctgcgttcgcttcctgctcc

SEQ ID NO: 186078 - DNA, 35 bp, Artificial Sequence
  Synthetic oligonucleotide
tcttatcgttctgccggttacgccccgttgtctcc

SEQ ID NO: 186079 - DNA, 36 bp, Artificial Sequence
  Synthetic oligonucleotide
atcgacctcgcctccattcgtctccttccacggtcc

SEQ ID NO: 186080 - DNA, 35 bp, Artificial Sequence
  Synthetic oligonucleotide
gatgttgtcccctgctcccgttccaggctctgtcc

SEQ ID NO: 186081 - DNA, 35 bp, Artificial Sequence
  Synthetic oligonucleotide
gatccacagtcaggcatagtgctgcgctgccttcc

SEQ ID NO: 186082 - DNA, 35 bp, Artificial Sequence
  Synthetic oligonucleotide
gactgcttccgacaccccgatcgtcccaccgttcc

SEQ ID NO: 186083 - DNA, 35 bp, Artificial Sequence
  Synthetic oligonucleotide
gttgccccctcagtgaactcctgcaattgcaatgc

SEQ ID NO: 186084 - DNA, 35 bp, Artificial Sequence
  Synthetic oligonucleotide
gccccgcaccaccgaagctcttccgattcttatgc

SEQ ID NO: 186085 - DNA, 35 bp, Artificial Sequence
  Synthetic oligonucleotide
gccgccgtactcagacatagtttcagccccccatc

SEQ ID NO: 186086 - DNA, 35 bp, Artificial Sequence
  Synthetic oligonucleotide
gtgccctgtcaggatatccgcagctccacccgatc

SEQ ID NO: 186087 - DNA, 35 bp, Artificial Sequence
  Synthetic oligonucleotide
gcgcttgttcggcattgaatcgttctatctccctc

SEQ ID NO: 186088 - DNA, 35 bp, Artificial Sequence
  Synthetic oligonucleotide
tacatccgccactgccccgagcctcattttccctc

SEQ ID NO: 186089 - DNA, 35 bp, Artificial Sequence
  Synthetic oligonucleotide
actagccacctcattgagtcacttcactttgcctc

SEQ ID NO: 186090 - DNA, 35 bp, Artificial Sequence
  Synthetic oligonucleotide
aacaaccgtaaggtctgctacgtagctcctcgctc

SEQ ID NO: 186091 - DNA, 35 bp, Artificial Sequence
  Synthetic oligonucleotide
tgcgctctaccggtgacccgttcttttctatgctc

SEQ ID NO: 186092 - DNA, 35 bp, Artificial Sequence
  Synthetic oligonucleotide
tccgaccatccctctttcccgtttgctactatgtc

SEQ ID NO: 186093 - DNA, 35 bp, Artificial Sequence
  Synthetic oligonucleotide
tgagacatactcacgtctgtaccacaccatccttc

SEQ ID NO: 186094 - DNA, 35 bp, Artificial Sequence
  Synthetic oligonucleotide
actggtcgccccacccaagactattaacctgcttc

SEQ ID NO: 186095 - DNA, 35 bp, Artificial Sequence
  Synthetic oligonucleotide
ggaaccattgggcactaacacccagtcctttcttc

SEQ ID NO: 186096 - DNA, 35 bp, Artificial Sequence
  Synthetic oligonucleotide
gtaaccaccgcgtcgccaccctccggtccctgttc

SEQ ID NO: 186097 - DNA, 35 bp, Artificial Sequence
  Synthetic oligonucleotide
acttacgaagcccgcgatcgttcttcccccatttc

SEQ ID NO: 186098 - DNA, 35 bp, Artificial Sequence
  Synthetic oligonucleotide
tcccctccgcgctatacctagttgctttctctttc

SEQ ID NO: 186099 - DNA, 35 bp, Artificial Sequence
  Synthetic oligonucleotide
gcatgcaccaggtgcccggccgtatcacttctttc

SEQ ID NO: 186100 - DNA, 35 bp, Artificial Sequence
  Synthetic oligonucleotide
aggaagtcacgggaaaggagagtggggaggtgcag

SEQ ID NO: 186101 - DNA, 36 bp, Artificial Sequence
  Synthetic oligonucleotide
ttcgacaccacccctgttttaccgtttacagccacg

SEQ ID NO: 186102 - DNA, 35 bp, Artificial Sequence
  Synthetic oligonucleotide
ttcgcctgccgcccgactattaaaaccgttctccg

SEQ ID NO: 186103 - DNA, 35 bp, Artificial Sequence
  Synthetic oligonucleotide
agggagagcaagagggactagggtcgggtggggcg

SEQ ID NO: 186104 - DNA, 35 bp, Artificial Sequence
  Synthetic oligonucleotide
gcaatctcgccgctgctactcggaatcttatctcg

SEQ ID NO: 186105 - DNA, 35 bp, Artificial Sequence
  Synthetic oligonucleotide
caaccgctccaccgtacgctcgttttgcaccttcg

SEQ ID NO: 186106 - DNA, 35 bp, Artificial Sequence
  Synthetic oligonucleotide
accacgatcgtttgcaccttatttcctgactttcg

SEQ ID NO: 186107 - DNA, 35 bp, Artificial Sequence
  Synthetic oligonucleotide
acaatgggaagggagggggacagtggtcttaacgg

SEQ ID NO: 186108 - DNA, 35 bp, Artificial Sequence
  Synthetic oligonucleotide
gtcccacgcctgaacaccaccttcgtacgcccatg

SEQ ID NO: 186109 - DNA, 35 bp, Artificial Sequence
  Synthetic oligonucleotide
atatcctgccgatctgctttcgcccctagtaactg

SEQ ID NO: 186110 - DNA, 35 bp, Artificial Sequence
  Synthetic oligonucleotide
gccctcctccctcagtgcgccgttgacccgcactg

SEQ ID NO: 186111 - DNA, 35 bp, Artificial Sequence
  Synthetic oligonucleotide
gtcaccccaggcttaacagtattaacccacccctg

SEQ ID NO: 186112 - DNA, 35 bp, Artificial Sequence
  Synthetic oligonucleotide
taccccttgtcccaccgcgcgcccgcagtatgctg

SEQ ID NO: 186113 - DNA, 35 bp, Artificial Sequence
  Synthetic oligonucleotide
gcaccatccgggcccctgtaacctacgcactgctg

SEQ ID NO: 186114 - DNA, 35 bp, Artificial Sequence
  Synthetic oligonucleotide
tagtaccaccaaccttccgaaggccaccatgagtg

SEQ ID NO: 186115 - DNA, 35 bp, Artificial Sequence
  Synthetic oligonucleotide
gatcgcccccagcttccccagccctaaacaccgtg

SEQ ID NO: 186116 - DNA, 35 bp, Artificial Sequence
  Synthetic oligonucleotide
tgactcccccacagctttatcgcccttgaacgaat

SEQ ID NO: 186117 - DNA, 35 bp, Artificial Sequence
  Synthetic oligonucleotide
gtgaggaggagaaaaagtagaacgaggcggtagat

SEQ ID NO: 186118 - DNA, 35 bp, Artificial Sequence
  Synthetic oligonucleotide
gacgtcactgcattcttccgcccttgcaccggtat

SEQ ID NO: 186119 - DNA, 35 bp, Artificial Sequence
  Synthetic oligonucleotide
gggtgacaatcgggcgaggggggtacagagggtat

SEQ ID NO: 186120 - DNA, 35 bp, Artificial Sequence
  Synthetic oligonucleotide
ttcatgcaccgcttgacggttttatctttcaccct

SEQ ID NO: 186121 - DNA, 35 bp, Artificial Sequence
  Synthetic oligonucleotide
gcgcccaattggctaagtggcgcttctattcccct

SEQ ID NO: 186122 - DNA, 35 bp, Artificial Sequence
  Synthetic oligonucleotide
tcgcccctgtcgccataccgtactgctctcatcct

SEQ ID NO: 186123 - DNA, 35 bp, Artificial Sequence
  Synthetic oligonucleotide
tcacccgtccgtaagtatttgctcaaactcctcct

SEQ ID NO: 186124 - DNA, 35 bp, Artificial Sequence
  Synthetic oligonucleotide
atcatccccagcccgggtgtctcccgtgaattcct

SEQ ID NO: 186125 - DNA, 35 bp, Artificial Sequence
  Synthetic oligonucleotide
gtgacgtacgtatgcccatgccccgcccgtgcgct

SEQ ID NO: 186126 - DNA, 35 bp, Artificial Sequence
  Synthetic oligonucleotide
ttgccgacgatcgtctttgcctattccactatgct

SEQ ID NO: 186127 - DNA, 35 bp, Artificial Sequence
  Synthetic oligonucleotide
gttcgtaccgttcattggcgtctcttgcacctgct

SEQ ID NO: 186128 - DNA, 35 bp, Artificial Sequence
  Synthetic oligonucleotide
gtgcacacgcggctttttacgggtctcttgcttct

SEQ ID NO: 186129 - DNA, 35 bp, Artificial Sequence
  Synthetic oligonucleotide
gggggagaagtagcgggaggggatgtcggtaccgt

SEQ ID NO: 186130 - DNA, 35 bp, Artificial Sequence
  Synthetic oligonucleotide
gagtgccccactcgcatcaccttcgattgtcctgt

SEQ ID NO: 186131 - DNA, 35 bp, Artificial Sequence
  Synthetic oligonucleotide
gtgggggtgacgggatgactaggggaaggctaatt

SEQ ID NO: 186132 - DNA, 35 bp, Artificial Sequence
  Synthetic oligonucleotide
actaaccgccgccctgttctcttgtgccaatgatt

SEQ ID NO: 186133 - DNA, 35 bp, Artificial Sequence
  Synthetic oligonucleotide
accgcatgtaggtgtatgccctctgtcgtcgcctt

SEQ ID NO: 186134 - DNA, 35 bp, Artificial Sequence
  Synthetic oligonucleotide
gaccatccagaccgttactgtgctcactatgcctt

SEQ ID NO: 186135 - DNA, 35 bp, Artificial Sequence
  Synthetic oligonucleotide
tggacggcaccaccgtccgtcgcgcttctttcctt

SEQ ID NO: 186136 - DNA, 35 bp, Artificial Sequence
  Synthetic oligonucleotide
gtgtcgcacggcacacgctcccttcctacaccttt

SEQ ID NO: 186137 - DNA, 36 bp, Artificial Sequence
  Synthetic oligonucleotide
accccccagggtcatgtcgtactccttgctccacaa

SEQ ID NO: 186138 - DNA, 35 bp, Artificial Sequence
  Synthetic oligonucleotide
gtggtggtaggggggtcgcttatggggaggggcaa

SEQ ID NO: 186139 - DNA, 36 bp, Artificial Sequence
  Synthetic oligonucleotide
gctggacaagggttcacggaagggacgggatggcaa

SEQ ID NO: 186140 - DNA, 36 bp, Artificial Sequence
  Synthetic oligonucleotide
gtaggggggggaactgggcgaaggagctagcatcaa

SEQ ID NO: 186141 - DNA, 36 bp, Artificial Sequence
  Synthetic oligonucleotide
gtccaccccctgaaccgtacgcattccttctaggaa

SEQ ID NO: 186142 - DNA, 35 bp, Artificial Sequence
  Synthetic oligonucleotide
gagaaagggcgaggtggaatggccgatggggggaa

SEQ ID NO: 186143 - DNA, 35 bp, Artificial Sequence
  Synthetic oligonucleotide
gtacggggggtggagaaggggagcgggtctgggaa

SEQ ID NO: 186144 - DNA, 35 bp, Artificial Sequence
  Synthetic oligonucleotide
tcagtatctgcctcttgtcctcttgcctacctgaa

SEQ ID NO: 186145 - DNA, 35 bp, Artificial Sequence
  Synthetic oligonucleotide
gtctacgggcagattgatatccccgctcccctgaa

SEQ ID NO: 186146 - DNA, 35 bp, Artificial Sequence
  Synthetic oligonucleotide
acaaccacctccgagtaattgctcgtcttcttgaa

SEQ ID NO: 186147 - DNA, 35 bp, Artificial Sequence
  Synthetic oligonucleotide
gtcggagggggggtctggcaatggggtagggctaa

SEQ ID NO: 186148 - DNA, 36 bp, Artificial Sequence
  Synthetic oligonucleotide
tccagggagggcggggatggtttcaggggaagcaca

SEQ ID NO: 186149 - DNA, 36 bp, Artificial Sequence
  Synthetic oligonucleotide
ttccgtggcgcccttcgcctgtgctcgaacctacca

SEQ ID NO: 186150 - DNA, 36 bp, Artificial Sequence
  Synthetic oligonucleotide
taagtaagctcagccccgtcacctgtcaccctgcca

SEQ ID NO: 186151 - DNA, 36 bp, Artificial Sequence
  Synthetic oligonucleotide
aaagccactccgcccggatcgccgagcctatctcca

SEQ ID NO: 186152 - DNA, 35 bp, Artificial Sequence
  Synthetic oligonucleotide
gatgccgcccaccactctggattatcccagtagca

SEQ ID NO: 186153 - DNA, 36 bp, Artificial Sequence
  Synthetic oligonucleotide
gaccctcacttgttaccactgccctttagtaacgca

SEQ ID NO: 186154 - DNA, 35 bp, Artificial Sequence
  Synthetic oligonucleotide
tcctcacctcggcacctgtttgtttctccgcctca

SEQ ID NO: 186155 - DNA, 36 bp, Artificial Sequence
  Synthetic oligonucleotide
tcgcataccacgattttccgttacaccgttcgctca

SEQ ID NO: 186156 - DNA, 36 bp, Artificial Sequence
  Synthetic oligonucleotide
accgatcaacgccgctctccagaacccggattctca

SEQ ID NO: 186157 - DNA, 36 bp, Artificial Sequence
  Synthetic oligonucleotide
gccctcgcgtctcctccgtcgtgtctttccgcttca

SEQ ID NO: 186158 - DNA, 36 bp, Artificial Sequence
  Synthetic oligonucleotide
gacggggagggtgggtacgaattccttgggctttca

SEQ ID NO: 186159 - DNA, 37 bp, Artificial Sequence
  Synthetic oligonucleotide
gacatcgggcggtgcgaaaatgcgggcggggctaaga

SEQ ID NO: 186160 - DNA, 35 bp, Artificial Sequence
  Synthetic oligonucleotide
tccgctactccggcatcactacgcccccaccgaga

SEQ ID NO: 186161 - DNA, 37 bp, Artificial Sequence
  Synthetic oligonucleotide
tcccagaggggaagggaataaacggggggagggtaga

SEQ ID NO: 186162 - DNA, 37 bp, Artificial Sequence
  Synthetic oligonucleotide
aatgcgggtggtaaacagggtgggtgggcacgtacga

SEQ ID NO: 186163 - DNA, 35 bp, Artificial Sequence
  Synthetic oligonucleotide
gtccaaccctcagctctgcaacattacaccaccga

SEQ ID NO: 186164 - DNA, 35 bp, Artificial Sequence
  Synthetic oligonucleotide
gtctttccggcccctatgcccatgttcttctccga

SEQ ID NO: 186165 - DNA, 37 bp, Artificial Sequence
  Synthetic oligonucleotide
ggaacgagtgcgaggggaaggaggcgtagtagcgcga

SEQ ID NO: 186166 - DNA, 37 bp, Artificial Sequence
  Synthetic oligonucleotide
gctggttccgctgcatttcctccctcacttatggcga

SEQ ID NO: 186167 - DNA, 37 bp, Artificial Sequence
  Synthetic oligonucleotide
tgccatatcacttagtggatcctgttctacccttcga

SEQ ID NO: 186168 - DNA, 36 bp, Artificial Sequence
  Synthetic oligonucleotide
gaggatatggctgagacggagaggggacgggcagga

SEQ ID NO: 186169 - DNA, 36 bp, Artificial Sequence
  Synthetic oligonucleotide
gggaaagaggctcagggcgggagggactattgagga

SEQ ID NO: 186170 - DNA, 35 bp, Artificial Sequence
  Synthetic oligonucleotide
accggagtgagtgggaggaaagcggagagttcgga

SEQ ID NO: 186171 - DNA, 37 bp, Artificial Sequence
  Synthetic oligonucleotide
accacgccatcttgccctcgctctccagaccaaggga

SEQ ID NO: 186172 - DNA, 37 bp, Artificial Sequence
  Synthetic oligonucleotide
gtctaggaccaggacgggtggaaaggcggaacgggga

SEQ ID NO: 186173 - DNA, 37 bp, Artificial Sequence
  Synthetic oligonucleotide
aggggctaggtggaaggatgttgcagggcgggatgga

SEQ ID NO: 186174 - DNA, 36 bp, Artificial Sequence
  Synthetic oligonucleotide
taacgcaccatccgcaactgcaatattgatcctgga

SEQ ID NO: 186175 - DNA, 37 bp, Artificial Sequence
  Synthetic oligonucleotide
gcacgcccttctctgccggtacgattcgccctgtgga

SEQ ID NO: 186176 - DNA, 38 bp, Artificial Sequence
  Synthetic oligonucleotide
ggggaacgaggtgggggtaaacacggctaggtaaatga

SEQ ID NO: 186177 - DNA, 38 bp, Artificial Sequence
  Synthetic oligonucleotide
tactccgacgtacgacccttatgcgtgaccccccatga

SEQ ID NO: 186178 - DNA, 38 bp, Artificial Sequence
  Synthetic oligonucleotide
actgcatgagatcgggtttaggggctgggtgaggatga

SEQ ID NO: 186179 - DNA, 38 bp, Artificial Sequence
  Synthetic oligonucleotide
agcggagcggagtgggccatggggaaaggggcggatga

SEQ ID NO: 186180 - DNA, 36 bp, Artificial Sequence
  Synthetic oligonucleotide
gagtacccagagaggagggggggaggagttggatga

SEQ ID NO: 186181 - DNA, 36 bp, Artificial Sequence
  Synthetic oligonucleotide
tcgcatctccctgcccatatctactgccacaactga

SEQ ID NO: 186182 - DNA, 37 bp, Artificial Sequence
  Synthetic oligonucleotide
acgtaagcgctccgtctctcgcacctcacctcactga

SEQ ID NO: 186183 - DNA, 38 bp, Artificial Sequence
  Synthetic oligonucleotide
acgccccaacgccagacccgcgccactgcacaccctga

SEQ ID NO: 186184 - DNA, 37 bp, Artificial Sequence
  Synthetic oligonucleotide
tgccgcccgtttcacgataagggccttccccccctga

SEQ ID NO: 186185 - DNA, 38 bp, Artificial Sequence
  Synthetic oligonucleotide
ttgggccccaaccaatctgtgagtacccgcctccctga

SEQ ID NO: 186186 - DNA, 36 bp, Artificial Sequence
  Synthetic oligonucleotide
acaccgatccccctatgctattctccagtcttctga

SEQ ID NO: 186187 - DNA, 38 bp, Artificial Sequence
  Synthetic oligonucleotide
agtgacgggcatgggtagggtgggctaaacctaagtga

SEQ ID NO: 186188 - DNA, 38 bp, Artificial Sequence
  Synthetic oligonucleotide
ttacagccatatatgccgttataccttctccatcgtga

SEQ ID NO: 186189 - DNA, 37 bp, Artificial Sequence
  Synthetic oligonucleotide
gttgagtaggagcaaggaggagcagggcgttcggtga

SEQ ID NO: 186190 - DNA, 38 bp, Artificial Sequence
  Synthetic oligonucleotide
tctacttcgccctgcttgttcaatccctgtacctgtga

SEQ ID NO: 186191 - DNA, 37 bp, Artificial Sequence
  Synthetic oligonucleotide
gtcggtgatggaggaactgaaggggagggagctgtga

SEQ ID NO: 186192 - DNA, 38 bp, Artificial Sequence
  Synthetic oligonucleotide
gcgactgtccggcacatttcctccgctagcacgcttga

SEQ ID NO: 186193 - DNA, 37 bp, Artificial Sequence
  Synthetic oligonucleotide
tgatgggaagggaggtacggggtaaatgggatgttga

SEQ ID NO: 186194 - DNA, 38 bp, Artificial Sequence
  Synthetic oligonucleotide
agtggggggaaatggggtagaactgaggagaggtttga

SEQ ID NO: 186195 - DNA, 38 bp, Artificial Sequence
  Synthetic oligonucleotide
tttggcctctgtgcctgttaccgcctcctccgttttga

SEQ ID NO: 186196 - DNA, 35 bp, Artificial Sequence
  Synthetic oligonucleotide
tgccacctttatgcttccgttcacgggcccgccta

SEQ ID NO: 186197 - DNA, 36 bp, Artificial Sequence
  Synthetic oligonucleotide
actaagagacgcggggggggaactggggaaaggcta

SEQ ID NO: 186198 - DNA, 36 bp, Artificial Sequence
  Synthetic oligonucleotide
tccgatcacccgtctgccttctccccgactgccgta

SEQ ID NO: 186199 - DNA, 36 bp, Artificial Sequence
  Synthetic oligonucleotide
gccactagtggatcgcgccctgtttcctccctggta

SEQ ID NO: 186200 - DNA, 36 bp, Artificial Sequence
  Synthetic oligonucleotide
tacccccctcccattgtacagaaagatctgcgctta

SEQ ID NO: 186201 - DNA, 36 bp, Artificial Sequence
  Synthetic oligonucleotide
cctcaccccggtccattgtccattagttcttgctta

SEQ ID NO: 186202 - DNA, 36 bp, Artificial Sequence
  Synthetic oligonucleotide
gacacaatgccgctccctgttcaatcctggtcgtta

SEQ ID NO: 186203 - DNA, 36 bp, Artificial Sequence
  Synthetic oligonucleotide
accactaccgcccttctgtccgctaaacgcagttta

SEQ ID NO: 186204 - DNA, 35 bp, Artificial Sequence
  Synthetic oligonucleotide
gaacgacgtcccgcattacccttcttcgacgcaac

SEQ ID NO: 186205 - DNA, 35 bp, Artificial Sequence
  Synthetic oligonucleotide
tctgtgcaggtgctacatcctcttccccggcgaac

SEQ ID NO: 186206 - DNA, 35 bp, Artificial Sequence
  Synthetic oligonucleotide
ggtctcgcagtcctgtccgcccattagacctccac

SEQ ID NO: 186207 - DNA, 35 bp, Artificial Sequence
  Synthetic oligonucleotide
gttaactgacgcatattgcctgtactatcactcac

SEQ ID NO: 186208 - DNA, 35 bp, Artificial Sequence
  Synthetic oligonucleotide
gaccccctcgctccttttgcccacgtaccccggac

SEQ ID NO: 186209 - DNA, 35 bp, Artificial Sequence
  Synthetic oligonucleotide
ggtggtcccccttgttacttgtctgccatccgacc

SEQ ID NO: 186210 - DNA, 35 bp, Artificial Sequence
  Synthetic oligonucleotide
agatgccccgcccgcccacgatttatttgctgacc

SEQ ID NO: 186211 - DNA, 35 bp, Artificial Sequence
  Synthetic oligonucleotide
ccatcccaagcctgtccttaggaccgttcgcaccc

SEQ ID NO: 186212 - DNA, 35 bp, Artificial Sequence
  Synthetic oligonucleotide
gtcccggccctgggcttacatctttcacgcacccc

SEQ ID NO: 186213 - DNA, 35 bp, Artificial Sequence
  Synthetic oligonucleotide
acgctttaccatcatagcctgatattgccaccccc

SEQ ID NO: 186214 - DNA, 35 bp, Artificial Sequence
  Synthetic oligonucleotide
gctctgctcggctgttgttcttctcaccatgcccc

SEQ ID NO: 186215 - DNA, 35 bp, Artificial Sequence
  Synthetic oligonucleotide
agccgtgccgttcatcagggccccttacgctcccc

SEQ ID NO: 186216 - DNA, 35 bp, Artificial Sequence
  Synthetic oligonucleotide
gcccgctttcttgcctgggtatgtccccgttcccc

SEQ ID NO: 186217 - DNA, 35 bp, Artificial Sequence
  Synthetic oligonucleotide
ggtgacgtagcctacgtgcgtccatccggttcccc

SEQ ID NO: 186218 - DNA, 35 bp, Artificial Sequence
  Synthetic oligonucleotide
tatgctgtcacctcggctgctatctgtacaatccc

SEQ ID NO: 186219 - DNA, 34 bp, Artificial Sequence
  Synthetic oligonucleotide
agcccccacgttgtatttctgtcgcgcgtatccc

SEQ ID NO: 186220 - DNA, 35 bp, Artificial Sequence
  Synthetic oligonucleotide
tcgaacgccctccaatacgccgaccacagtatgcc

SEQ ID NO: 186221 - DNA, 35 bp, Artificial Sequence
  Synthetic oligonucleotide
agcggccatgtgaagtatcgtcaccgcctccatcc

SEQ ID NO: 186222 - DNA, 35 bp, Artificial Sequence
  Synthetic oligonucleotide
gaccacgctttcaatcctctctgggcacatcatcc

SEQ ID NO: 186223 - DNA, 35 bp, Artificial Sequence
  Synthetic oligonucleotide
tctcgtccacccagacgcccttatacgcgctatcc

SEQ ID NO: 186224 - DNA, 35 bp, Artificial Sequence
  Synthetic oligonucleotide
ccctcgaacggtacatgtccgtggctcacacctcc

SEQ ID NO: 186225 - DNA, 35 bp, Artificial Sequence
  Synthetic oligonucleotide
gtgcctcccacgctatgctagttaaactgtcctcc

SEQ ID NO: 186226 - DNA, 33 bp, Artificial Sequence
  Synthetic oligonucleotide
agctgtgacaccgcgtatccaactttcgtctcc

SEQ ID NO: 186227 - DNA, 35 bp, Artificial Sequence
  Synthetic oligonucleotide
gtagctgtccccgcgtcgccttgtcggttccgtcc

SEQ ID NO: 186228 - DNA, 35 bp, Artificial Sequence
  Synthetic oligonucleotide
tagccccccatgttgaatacctgtcccaccgccgc

SEQ ID NO: 186229 - DNA, 35 bp, Artificial Sequence
  Synthetic oligonucleotide
atgacactgatcagtttgcaattccccctgccggc

SEQ ID NO: 186230 - DNA, 35 bp, Artificial Sequence
  Synthetic oligonucleotide
acatgcatctgcccgccccttcccgcggtattggc

SEQ ID NO: 186231 - DNA, 35 bp, Artificial Sequence
  Synthetic oligonucleotide
accgcccactctctgtcgatcgcacacctgcttgc

SEQ ID NO: 186232 - DNA, 35 bp, Artificial Sequence
  Synthetic oligonucleotide
acgtaacccccgccgttgacactgcgaccttttgc

SEQ ID NO: 186233 - DNA, 35 bp, Artificial Sequence
  Synthetic oligonucleotide
aatttgcagtgacgatctcgttccgcccttccatc

SEQ ID NO: 186234 - DNA, 35 bp, Artificial Sequence
  Synthetic oligonucleotide
taccgtccgccactgccctagctagacacaatatc

SEQ ID NO: 186235 - DNA, 35 bp, Artificial Sequence
  Synthetic oligonucleotide
aggggtggaggcggggaattgggagggtcagtatc

SEQ ID NO: 186236 - DNA, 35 bp, Artificial Sequence
  Synthetic oligonucleotide
ggtttcctgccccgaatgtccctccgtaccgtatc

SEQ ID NO: 186237 - DNA, 35 bp, Artificial Sequence
  Synthetic oligonucleotide
ttgtcgcacccagttcttgtaccaataccgttatc

SEQ ID NO: 186238 - DNA, 35 bp, Artificial Sequence
  Synthetic oligonucleotide
agacactcccccgattcgagtctcagtaaccactc

SEQ ID NO: 186239 - DNA, 35 bp, Artificial Sequence
  Synthetic oligonucleotide
ttgttacgttcacgtccggttccctgccatacctc

SEQ ID NO: 186240 - DNA, 35 bp, Artificial Sequence
  Synthetic oligonucleotide
gcgagcagtccaactgaccctgcctcacctacctc

SEQ ID NO: 186241 - DNA, 35 bp, Artificial Sequence
  Synthetic oligonucleotide
tggctcggtgcgctgcagcatcttgaccactcctc

SEQ ID NO: 186242 - DNA, 35 bp, Artificial Sequence
  Synthetic oligonucleotide
tgtgcaagtatggcccgcgtagattccccccgctc

SEQ ID NO: 186243 - DNA, 35 bp, Artificial Sequence
  Synthetic oligonucleotide
ggtcccttacgcctgaccacgtgcctgaattattc

SEQ ID NO: 186244 - DNA, 35 bp, Artificial Sequence
  Synthetic oligonucleotide
acacagtatcactatcctcaggctctaggctcttc

SEQ ID NO: 186245 - DNA, 35 bp, Artificial Sequence
  Synthetic oligonucleotide
gcttcgccaccgttgttatggcccctcgtcgtttc

SEQ ID NO: 186246 - DNA, 35 bp, Artificial Sequence
  Synthetic oligonucleotide
atgtgacatgggaaggtagggacggagggatcgag

SEQ ID NO: 186247 - DNA, 35 bp, Artificial Sequence
  Synthetic oligonucleotide
taccgagcagacagacggggttggacgggggggag

SEQ ID NO: 186248 - DNA, 34 bp, Artificial Sequence
  Synthetic oligonucleotide
accgtccgccgatcgctcccctttgcacctcacg

SEQ ID NO: 186249 - DNA, 35 bp, Artificial Sequence
  Synthetic oligonucleotide
tctgtccccacgactgtacacctgcctgtttgacg

SEQ ID NO: 186250 - DNA, 35 bp, Artificial Sequence
  Synthetic oligonucleotide
tccctcgttccgcggtgcatgatccccaccacccg

SEQ ID NO: 186251 - DNA, 35 bp, Artificial Sequence
  Synthetic oligonucleotide
tagatgctgtgcccccggttctcgctcttgacccg

SEQ ID NO: 186252 - DNA, 35 bp, Artificial Sequence
  Synthetic oligonucleotide
ggtcaccgaacactgctcacccatcttaacgcccg

SEQ ID NO: 186253 - DNA, 35 bp, Artificial Sequence
  Synthetic oligonucleotide
ggagagggggtggagtggagtgcagaaagccgccg

SEQ ID NO: 186254 - DNA, 35 bp, Artificial Sequence
  Synthetic oligonucleotide
gcccctgcacgtcccattcttcaagtcttgtgccg

SEQ ID NO: 186255 - DNA, 35 bp, Artificial Sequence
  Synthetic oligonucleotide
gcgacactcaggcgtaatgcatttaatcccctccg

SEQ ID NO: 186256 - DNA, 35 bp, Artificial Sequence
  Synthetic oligonucleotide
atgtccgctagttatgtctctttctttctcctgcg

SEQ ID NO: 186257 - DNA, 35 bp, Artificial Sequence
  Synthetic oligonucleotide
gtgagagacggatctgggaaggaaatggtggtgcg

SEQ ID NO: 186258 - DNA, 35 bp, Artificial Sequence
  Synthetic oligonucleotide
actgcccgcaccttctgctatcagccgtaacctcg

SEQ ID NO: 186259 - DNA, 35 bp, Artificial Sequence
  Synthetic oligonucleotide
attgcctccgtttctgcccgcgccttactctgcgg

SEQ ID NO: 186260 - DNA, 35 bp, Artificial Sequence
  Synthetic oligonucleotide
ttggagagtgggtgggagggttctggaaccactgg

SEQ ID NO: 186261 - DNA, 35 bp, Artificial Sequence
  Synthetic oligonucleotide
ttgcgacggggggggcgggtaggtccgtgaaaatg

SEQ ID NO: 186262 - DNA, 35 bp, Artificial Sequence
  Synthetic oligonucleotide
gatcaaagcgggaaggttaggggggggggatcatg

SEQ ID NO: 186263 - DNA, 35 bp, Artificial Sequence
  Synthetic oligonucleotide
gaagaacagggctgtggacggggatttggggcgtg

SEQ ID NO: 186264 - DNA, 35 bp, Artificial Sequence
  Synthetic oligonucleotide
tcacgcaccaaccgcttaatgtcccgttttttcat

SEQ ID NO: 186265 - DNA, 35 bp, Artificial Sequence
  Synthetic oligonucleotide
aaccaccttcgcctgtgctaacctggaccttgtat

SEQ ID NO: 186266 - DNA, 35 bp, Artificial Sequence
  Synthetic oligonucleotide
ttctcacttccgcccatgttctacacgtgtcaact

SEQ ID NO: 186267 - DNA, 35 bp, Artificial Sequence
  Synthetic oligonucleotide
tccccgcaaacttgtcctcgatctccctctgacct

SEQ ID NO: 186268 - DNA, 35 bp, Artificial Sequence
  Synthetic oligonucleotide
tcagcgcaatcccatccatctccgcccacggccct

SEQ ID NO: 186269 - DNA, 35 bp, Artificial Sequence
  Synthetic oligonucleotide
gccaccattgatatgtctagtattacctcttccct

SEQ ID NO: 186270 - DNA, 35 bp, Artificial Sequence
  Synthetic oligonucleotide
tccccgctcagatgttagcctacgtcttgtctcct

SEQ ID NO: 186271 - DNA, 35 bp, Artificial Sequence
  Synthetic oligonucleotide
gatgcgcaaactggtacgcagttgagcatgttcct

SEQ ID NO: 186272 - DNA, 35 bp, Artificial Sequence
  Synthetic oligonucleotide
gtcacctgcgtaagctttccccgccatctgatcgt

SEQ ID NO: 186273 - DNA, 35 bp, Artificial Sequence
  Synthetic oligonucleotide
tccacgcccgaatgccgtgatccttttattctcgt

SEQ ID NO: 186274 - DNA, 35 bp, Artificial Sequence
  Synthetic oligonucleotide
atgtccccctgggcctgcgctttacgtgccacctt

SEQ ID NO: 186275 - DNA, 35 bp, Artificial Sequence
  Synthetic oligonucleotide
gatcgtcacgcagttgttctcgccacatctcgctt

SEQ ID NO: 186276 - DNA, 35 bp, Artificial Sequence
  Synthetic oligonucleotide
gctcccgcctccctatgaactgacattgcagtgtt

SEQ ID NO: 186277 - DNA, 35 bp, Artificial Sequence
  Synthetic oligonucleotide
acgacgttccgtgccatctatcgcctggacttgtt

SEQ ID NO: 186278 - DNA, 35 bp, Artificial Sequence
  Synthetic oligonucleotide
atctcgccgaccatctcctgctcttcaccagtttt

SEQ ID NO: 186279 - DNA, 35 bp, Artificial Sequence
  Synthetic oligonucleotide
gacggagctggtccgcctcccttaaccgtcaccaa

SEQ ID NO: 186280 - DNA, 35 bp, Artificial Sequence
  Synthetic oligonucleotide
gccatcccacctcgcttgtcacagtaacccccgaa

SEQ ID NO: 186281 - DNA, 35 bp, Artificial Sequence
  Synthetic oligonucleotide
aagatgtgtcagtggggtcggagggatgagcggaa

SEQ ID NO: 186282 - DNA, 36 bp, Artificial Sequence
  Synthetic oligonucleotide
atcgaccctgtactatcctgaaagatccacctataa

SEQ ID NO: 186283 - DNA, 35 bp, Artificial Sequence
  Synthetic oligonucleotide
ttgagagcggcggggtggtggggggaggtggcaca

SEQ ID NO: 186284 - DNA, 36 bp, Artificial Sequence
  Synthetic oligonucleotide
tcattcctcctgcttggtatatactctcgttggaca

SEQ ID NO: 186285 - DNA, 35 bp, Artificial Sequence
  Synthetic oligonucleotide
tcaaccgagcccacctctcgaccgcttctcgtaca

SEQ ID NO: 186286 - DNA, 35 bp, Artificial Sequence
  Synthetic oligonucleotide
agctcgccaggcccgtgaactttgcccgtttccca

SEQ ID NO: 186287 - DNA, 36 bp, Artificial Sequence
  Synthetic oligonucleotide
aagtcatagccacccggtttcaccagactcgctcca

SEQ ID NO: 186288 - DNA, 35 bp, Artificial Sequence
  Synthetic oligonucleotide
acgtagcaggccatctccgttactcgaccgccgca

SEQ ID NO: 186289 - DNA, 35 bp, Artificial Sequence
  Synthetic oligonucleotide
gcataacctacctcctgcaaatgcagtgcctcgca

SEQ ID NO: 186290 - DNA, 36 bp, Artificial Sequence
  Synthetic oligonucleotide
tcaccgctccatctctacgtacacctacgctgggca

SEQ ID NO: 186291 - DNA, 36 bp, Artificial Sequence
  Synthetic oligonucleotide
acgacatggcacatcgccctttccctctgacatgca

SEQ ID NO: 186292 - DNA, 35 bp, Artificial Sequence
  Synthetic oligonucleotide
gtcactcagtatcctggtaccgtacacccgcttca

SEQ ID NO: 186293 - DNA, 36 bp, Artificial Sequence
  Synthetic oligonucleotide
tgttgcctcacccacccccgtcctaggctcacgaga

SEQ ID NO: 186294 - DNA, 36 bp, Artificial Sequence
  Synthetic oligonucleotide
acgacgccctgctttctctctggatccgctcctaga

SEQ ID NO: 186295 - DNA, 37 bp, Artificial Sequence
  Synthetic oligonucleotide
atgtcgccctccatgtacttatctgtttccagctaga

SEQ ID NO: 186296 - DNA, 35 bp, Artificial Sequence
  Synthetic oligonucleotide
ttcccgcataccacccccattgattcgtccgtaga

SEQ ID NO: 186297 - DNA, 37 bp, Artificial Sequence
  Synthetic oligonucleotide
aggggcgggagggaagcgtggcgggatagaaggtaga

SEQ ID NO: 186298 - DNA, 37 bp, Artificial Sequence
  Synthetic oligonucleotide
gatgaaagttagaagggaagggtggggtcgggttaga

SEQ ID NO: 186299 - DNA, 35 bp, Artificial Sequence
  Synthetic oligonucleotide
ttgcacgtgtcctgcccctcttgacccttatacga

SEQ ID NO: 186300 - DNA, 36 bp, Artificial Sequence
  Synthetic oligonucleotide
gtgccacctgcattaaccaaccgcgcttacttacga

SEQ ID NO: 186301 - DNA, 37 bp, Artificial Sequence
  Synthetic oligonucleotide
gtcgaggaggctgatagaagaaagggggggcgaccga

SEQ ID NO: 186302 - DNA, 35 bp, Artificial Sequence
  Synthetic oligonucleotide
tcgaaccttcttgggactaactcactctcctccga

SEQ ID NO: 186303 - DNA, 37 bp, Artificial Sequence
  Synthetic oligonucleotide
gggatgggtcgcaagagggaacgggaacaggatgcga

SEQ ID NO: 186304 - DNA, 37 bp, Artificial Sequence
  Synthetic oligonucleotide
tccaccactcgcggtcacaatggcccatctttttcga

SEQ ID NO: 186305 - DNA, 37 bp, Artificial Sequence
  Synthetic oligonucleotide
actccccgctggatggtcctccctcgccactacagga

SEQ ID NO: 186306 - DNA, 36 bp, Artificial Sequence
  Synthetic oligonucleotide
gtgtcctgcttcgttttttgttcgccccctccagga

SEQ ID NO: 186307 - DNA, 37 bp, Artificial Sequence
  Synthetic oligonucleotide
gaacccccccaccacgagtgataataccatgcccgga

SEQ ID NO: 186308 - DNA, 37 bp, Artificial Sequence
  Synthetic oligonucleotide
gggctagggtgggggtgagtgggcgggtggaacggga

SEQ ID NO: 186309 - DNA, 37 bp, Artificial Sequence
  Synthetic oligonucleotide
atactgacgtggagagcataggaagggggggacggga

SEQ ID NO: 186310 - DNA, 37 bp, Artificial Sequence
  Synthetic oligonucleotide
acatgggagcggggggggggaggtaggagcgagggga

SEQ ID NO: 186311 - DNA, 36 bp, Artificial Sequence
  Synthetic oligonucleotide
taaatccgcggtaagggaattgtgggagggcgggga

SEQ ID NO: 186312 - DNA, 35 bp, Artificial Sequence
  Synthetic oligonucleotide
taggagtgggagtattccatgaaggggaggtggga

SEQ ID NO: 186313 - DNA, 37 bp, Artificial Sequence
  Synthetic oligonucleotide
gtgtcggaggaaggggggggtccgcggaacggatgga

SEQ ID NO: 186314 - DNA, 35 bp, Artificial Sequence
  Synthetic oligonucleotide
ttgccgttctgcgttattcgtttcctccggctgga

SEQ ID NO: 186315 - DNA, 38 bp, Artificial Sequence
  Synthetic oligonucleotide
gttccgtcctctccgcgctccactttaccttgtaatga

SEQ ID NO: 186316 - DNA, 36 bp, Artificial Sequence
  Synthetic oligonucleotide
tttgagcgtgagagagggggggcacacaggagatga

SEQ ID NO: 186317 - DNA, 38 bp, Artificial Sequence
  Synthetic oligonucleotide
aaccctcctcctgcaccaacagactgtccaccggatga

SEQ ID NO: 186318 - DNA, 38 bp, Artificial Sequence
  Synthetic oligonucleotide
tcaggtccacatgagtacataccgccgccccaaactga

SEQ ID NO: 186319 - DNA, 35 bp, Artificial Sequence
  Synthetic oligonucleotide
gcgaacccccccggtagtgcttctcccgccactga

SEQ ID NO: 186320 - DNA, 37 bp, Artificial Sequence
  Synthetic oligonucleotide
actgcgccccccgtaggtatggacccctccccgctga

SEQ ID NO: 186321 - DNA, 38 bp, Artificial Sequence
  Synthetic oligonucleotide
ttcccagccccgatccgcctacccgagtcagcttctga

SEQ ID NO: 186322 - DNA, 38 bp, Artificial Sequence
  Synthetic oligonucleotide
acacactccctcctcttctttgtgcagacacttagtga

SEQ ID NO: 186323 - DNA, 38 bp, Artificial Sequence
  Synthetic oligonucleotide
aacagcaccctgtatcccccgcccttacactcccgtga

SEQ ID NO: 186324 - DNA, 38 bp, Artificial Sequence
  Synthetic oligonucleotide
tcatccgcacacgccgtgaaccactcctttgtccgtga

SEQ ID NO: 186325 - DNA, 38 bp, Artificial Sequence
  Synthetic oligonucleotide
ttcgccaccaccatcgaacgtattaccactgctcgtga

SEQ ID NO: 186326 - DNA, 38 bp, Artificial Sequence
  Synthetic oligonucleotide
gcgagcgaagagcggggagggggggagtttggatgtga

SEQ ID NO: 186327 - DNA, 38 bp, Artificial Sequence
  Synthetic oligonucleotide
acaccccggtcaactgcacggccactgttttcccttga

SEQ ID NO: 186328 - DNA, 38 bp, Artificial Sequence
  Synthetic oligonucleotide
gacaccacccaccctctactgaggaccagactccttga

SEQ ID NO: 186329 - DNA, 38 bp, Artificial Sequence
  Synthetic oligonucleotide
ttaccccgccccttgcttttgctagacttatgtcttga

SEQ ID NO: 186330 - DNA, 37 bp, Artificial Sequence
  Synthetic oligonucleotide
tgtcgccctataggttattgaccctcttctccgttga

SEQ ID NO: 186331 - DNA, 36 bp, Artificial Sequence
  Synthetic oligonucleotide
gggagggacacggagcagaggggacctaggggttga

SEQ ID NO: 186332 - DNA, 38 bp, Artificial Sequence
  Synthetic oligonucleotide
atggacacgcaccaattcgtcctttctgctacctttga

SEQ ID NO: 186333 - DNA, 38 bp, Artificial Sequence
  Synthetic oligonucleotide
ttgaccaccctaggttcgtattcattccctttctttga

SEQ ID NO: 186334 - DNA, 36 bp, Artificial Sequence
  Synthetic oligonucleotide
tcatcctcctgccagccgcctataactatcccaata

SEQ ID NO: 186335 - DNA, 35 bp, Artificial Sequence
  Synthetic oligonucleotide
acgctacaccgccatgcacgccgctagaacgccta

SEQ ID NO: 186336 - DNA, 35 bp, Artificial Sequence
  Synthetic oligonucleotide
tgcgttcagccgacccaccacgtaccccctgccta

SEQ ID NO: 186337 - DNA, 35 bp, Artificial Sequence
  Synthetic oligonucleotide
gccctcagtcctcgggcgctatacctatcatccta

SEQ ID NO: 186338 - DNA, 35 bp, Artificial Sequence
  Synthetic oligonucleotide
atccgccttgaccgcttctcattatggtaccgcta

SEQ ID NO: 186339 - DNA, 34 bp, Artificial Sequence
  Synthetic oligonucleotide
gatagtggaaggcggggtgtacggggaaaggcta

SEQ ID NO: 186340 - DNA, 35 bp, Artificial Sequence
  Synthetic oligonucleotide
gacaccttcatctggcccgtgttgttacccgtcta

SEQ ID NO: 186341 - DNA, 36 bp, Artificial Sequence
  Synthetic oligonucleotide
gcttaggggggataggtgggtgggcaacaaaaggta

SEQ ID NO: 186342 - DNA, 36 bp, Artificial Sequence
  Synthetic oligonucleotide
agacatggggtgagggggtttaaaacagggcgggta

SEQ ID NO: 186343 - DNA, 36 bp, Artificial Sequence
  Synthetic oligonucleotide
actgaaggtggcggggggagttgtctgggcggggta

SEQ ID NO: 186344 - DNA, 36 bp, Artificial Sequence
  Synthetic oligonucleotide
gatgactagctctcggcctttatttgtcctgcctta

SEQ ID NO: 186345 - DNA, 36 bp, Artificial Sequence
  Synthetic oligonucleotide
tatgctgaatcgggaggacgtgggtgggaacgctta

SEQ ID NO: 186346 - DNA, 35 bp, Artificial Sequence
  Synthetic oligonucleotide
gttgaccatctgctacgtgcgctaccgtacgctta

SEQ ID NO: 186347 - DNA, 36 bp, Artificial Sequence
  Synthetic oligonucleotide
tccaatgacgtgctgatggtccacgtcccccgctta

SEQ ID NO: 186348 - DNA, 35 bp, Artificial Sequence
  Synthetic oligonucleotide
tttgtgcgcgccaccacctctgccgaactctctta

SEQ ID NO: 186349 - DNA, 35 bp, Artificial Sequence
  Synthetic oligonucleotide
atgcactccagcttggaccgtcaagtccgccccac

SEQ ID NO: 186350 - DNA, 35 bp, Artificial Sequence
  Synthetic oligonucleotide
tacacgtcactgggccccatcaacgttgcctccac

SEQ ID NO: 186351 - DNA, 34 bp, Artificial Sequence
  Synthetic oligonucleotide
gcaggtactgcacgaccctgtgatcgaagtccac

SEQ ID NO: 186352 - DNA, 35 bp, Artificial Sequence
  Synthetic oligonucleotide
tttaccgaccatgacccttgctgctgtaactaacc

SEQ ID NO: 186353 - DNA, 35 bp, Artificial Sequence
  Synthetic oligonucleotide
gcagggcatccgcgtactaacggctcaattccacc

SEQ ID NO: 186354 - DNA, 35 bp, Artificial Sequence
  Synthetic oligonucleotide
gtactgtcgcccggatcttaccagccattgtcacc

SEQ ID NO: 186355 - DNA, 35 bp, Artificial Sequence
  Synthetic oligonucleotide
tgcacacctgcaggctctcccccctggaccctacc

SEQ ID NO: 186356 - DNA, 35 bp, Artificial Sequence
  Synthetic oligonucleotide
tccctgactcatcgcactttcacagaagctctacc

SEQ ID NO: 186357 - DNA, 35 bp, Artificial Sequence
  Synthetic oligonucleotide
gacggagggcgacctgcctgcatcatccagtaccc

SEQ ID NO: 186358 - DNA, 35 bp, Artificial Sequence
  Synthetic oligonucleotide
ggaacttaccctccgaattctgcaatgagcccccc

SEQ ID NO: 186359 - DNA, 35 bp, Artificial Sequence
  Synthetic oligonucleotide
tcccgtagagcctccaatgcagcccgacgatcccc

SEQ ID NO: 186360 - DNA, 35 bp, Artificial Sequence
  Synthetic oligonucleotide
gtctaccactcgttggccttaaaacttaccatccc

SEQ ID NO: 186361 - DNA, 34 bp, Artificial Sequence
  Synthetic oligonucleotide
gtgcccaacgagcgggagggagggatgggacgcc

SEQ ID NO: 186362 - DNA, 35 bp, Artificial Sequence
  Synthetic oligonucleotide
accgaccgccgccatccatcgactccgtagatgcc

SEQ ID NO: 186363 - DNA, 35 bp, Artificial Sequence
  Synthetic oligonucleotide
gtgctcctgtgcccggctttcacccagtgcgtgcc

SEQ ID NO: 186364 - DNA, 35 bp, Artificial Sequence
  Synthetic oligonucleotide
tctgtcccccagcggcaatctgacctttcatatcc

SEQ ID NO: 186365 - DNA, 35 bp, Artificial Sequence
  Synthetic oligonucleotide
aagcgatacctgtccctcgtgaaccaccgccctcc

SEQ ID NO: 186366 - DNA, 35 bp, Artificial Sequence
  Synthetic oligonucleotide
gacctgcgtgaatgttgcactctctcgtttggtcc

SEQ ID NO: 186367 - DNA, 35 bp, Artificial Sequence
  Synthetic oligonucleotide
ttgcccaatcgtgcatcttctttcctgggcattcc

SEQ ID NO: 186368 - DNA, 35 bp, Artificial Sequence
  Synthetic oligonucleotide
acttacctcccgccgttccgagtcagcccccttcc

SEQ ID NO: 186369 - DNA, 35 bp, Artificial Sequence
  Synthetic oligonucleotide
gacaggcgagcgagcttcctacacccgggccttcc

SEQ ID NO: 186370 - DNA, 35 bp, Artificial Sequence
  Synthetic oligonucleotide
gatcacacctcctcctctatccgtttgacacgagc

SEQ ID NO: 186371 - DNA, 35 bp, Artificial Sequence
  Synthetic oligonucleotide
acccgcccacttccaaggcactttagctgccgagc

SEQ ID NO: 186372 - DNA, 35 bp, Artificial Sequence
  Synthetic oligonucleotide
actcagctcacgcccgatccttcgttgacgcccgc

SEQ ID NO: 186373 - DNA, 35 bp, Artificial Sequence
  Synthetic oligonucleotide
ttgccctgcctcgccgtacgtccttcttctctggc

SEQ ID NO: 186374 - DNA, 35 bp, Artificial Sequence
  Synthetic oligonucleotide
tgtgtggtggtccccgttgattccgacatccttgc

SEQ ID NO: 186375 - DNA, 35 bp, Artificial Sequence
  Synthetic oligonucleotide
gcaccgtgatcgccgcgcctgcacaatcttgaatc

SEQ ID NO: 186376 - DNA, 35 bp, Artificial Sequence
  Synthetic oligonucleotide
gagcaccccctcgatctcatacggagtatttaatc

SEQ ID NO: 186377 - DNA, 35 bp, Artificial Sequence
  Synthetic oligonucleotide
atgcatccctctcatcgtgtctgtcgccttccatc

SEQ ID NO: 186378 - DNA, 35 bp, Artificial Sequence
  Synthetic oligonucleotide
aatccagccctgtttcccgcgccatagactcgatc

SEQ ID NO: 186379 - DNA, 35 bp, Artificial Sequence
  Synthetic oligonucleotide
gggtcgtcatccccctcgagcaccgccttccactc

SEQ ID NO: 186380 - DNA, 34 bp, Artificial Sequence
  Synthetic oligonucleotide
tcaacacaccgcgccgttacacgtgttccacctc

SEQ ID NO: 186381 - DNA, 35 bp, Artificial Sequence
  Synthetic oligonucleotide
tcagaaaacctgcacatgtccagtgcctacccctc

SEQ ID NO: 186382 - DNA, 35 bp, Artificial Sequence
  Synthetic oligonucleotide
attggagcagtacaattcggctctttgttcccctc

SEQ ID NO: 186383 - DNA, 35 bp, Artificial Sequence
  Synthetic oligonucleotide
agcgtaacatctgctgctaaatccggcccatgctc

SEQ ID NO: 186384 - DNA, 35 bp, Artificial Sequence
  Synthetic oligonucleotide
gcaatcagatgttatttcctcttctcctcctattc

SEQ ID NO: 186385 - DNA, 35 bp, Artificial Sequence
  Synthetic oligonucleotide
ttgtacagccatagccgtcgtccactgaatctttc

SEQ ID NO: 186386 - DNA, 35 bp, Artificial Sequence
  Synthetic oligonucleotide
tctgtcccctgtgttgtccccgctgccattgtttc

SEQ ID NO: 186387 - DNA, 35 bp, Artificial Sequence
  Synthetic oligonucleotide
gaaaggagaacagagggaagaggagagagccgaag

SEQ ID NO: 186388 - DNA, 35 bp, Artificial Sequence
  Synthetic oligonucleotide
tgtggatgggggggggtgtcatggagttgcgtaag

SEQ ID NO: 186389 - DNA, 35 bp, Artificial Sequence
  Synthetic oligonucleotide
tctcgcccatcttcctgtttcttcgttttcgtaag

SEQ ID NO: 186390 - DNA, 35 bp, Artificial Sequence
  Synthetic oligonucleotide
gctgaagcacgggggagcagggaaggactaccgag

SEQ ID NO: 186391 - DNA, 35 bp, Artificial Sequence
  Synthetic oligonucleotide
ggggtggagatggagtggtgggcatgaagtccgag

SEQ ID NO: 186392 - DNA, 35 bp, Artificial Sequence
  Synthetic oligonucleotide
ggttgagaggttggggtggaaatgggggagactag

SEQ ID NO: 186393 - DNA, 32 bp, Artificial Sequence
  Synthetic oligonucleotide
atttgccatcgccctgaccttgactttaaccg

SEQ ID NO: 186394 - DNA, 35 bp, Artificial Sequence
  Synthetic oligonucleotide
gatgtttccgcactgttcctcgactctagctaccg

SEQ ID NO: 186395 - DNA, 35 bp, Artificial Sequence
  Synthetic oligonucleotide
gtgtgggagggtgggatcaggggtttctaaatccg

SEQ ID NO: 186396 - DNA, 35 bp, Artificial Sequence
  Synthetic oligonucleotide
tccgaggcttctatctggcccatccagccccatcg

SEQ ID NO: 186397 - DNA, 35 bp, Artificial Sequence
  Synthetic oligonucleotide
ggagttagcgggcggacggggggagtgggttgagg

SEQ ID NO: 186398 - DNA, 35 bp, Artificial Sequence
  Synthetic oligonucleotide
gtccacagcccactatctgcttaaatctgcttagg

SEQ ID NO: 186399 - DNA, 35 bp, Artificial Sequence
  Synthetic oligonucleotide
gacccaccattgccacagtttccccctcctcaggg

SEQ ID NO: 186400 - DNA, 35 bp, Artificial Sequence
  Synthetic oligonucleotide
atcgggcaaatccggtatgggtggtgggaaggggg

SEQ ID NO: 186401 - DNA, 35 bp, Artificial Sequence
  Synthetic oligonucleotide
gctaacggacccttgttatatcccttcccttctgg

SEQ ID NO: 186402 - DNA, 35 bp, Artificial Sequence
  Synthetic oligonucleotide
gtgaatgacctaggtatgggaggggagttgggtgg

SEQ ID NO: 186403 - DNA, 35 bp, Artificial Sequence
  Synthetic oligonucleotide
acctaccgactgcacacccgccattatcccaactg

SEQ ID NO: 186404 - DNA, 35 bp, Artificial Sequence
  Synthetic oligonucleotide
acatggccgctacgccccgtcctaatgtttccctg

SEQ ID NO: 186405 - DNA, 35 bp, Artificial Sequence
  Synthetic oligonucleotide
gtaacaagagaggaggatgggaagaagtcagggtg

SEQ ID NO: 186406 - DNA, 35 bp, Artificial Sequence
  Synthetic oligonucleotide
gggggaggtaagtaggagggcaagagcaagtcaat

SEQ ID NO: 186407 - DNA, 35 bp, Artificial Sequence
  Synthetic oligonucleotide
gcgagttcgtggcaaggtaggggggcgggagtaat

SEQ ID NO: 186408 - DNA, 34 bp, Artificial Sequence
  Synthetic oligonucleotide
tatcgagcgcaacatctccttgtccgaagcccat

SEQ ID NO: 186409 - DNA, 36 bp, Artificial Sequence
  Synthetic oligonucleotide
gtactgcacaggcctggctcaggaactccactccat

SEQ ID NO: 186410 - DNA, 34 bp, Artificial Sequence
  Synthetic oligonucleotide
gaccccatgccctcagcggttacatccgggctat

SEQ ID NO: 186411 - DNA, 35 bp, Artificial Sequence
  Synthetic oligonucleotide
tcactcatctcggtttgccctcgtttggcctctat

SEQ ID NO: 186412 - DNA, 35 bp, Artificial Sequence
  Synthetic oligonucleotide
ttccgcaccccatagctcctcgtcatagccacact

SEQ ID NO: 186413 - DNA, 35 bp, Artificial Sequence
  Synthetic oligonucleotide
ttgctcctgcccgatcgcattacttgtggtttact

SEQ ID NO: 186414 - DNA, 35 bp, Artificial Sequence
  Synthetic oligonucleotide
agccagaccgcatttcgttcttagcctcttttact

SEQ ID NO: 186415 - DNA, 35 bp, Artificial Sequence
  Synthetic oligonucleotide
gtttccaggtcgtatgtcgccggccatatccccct

SEQ ID NO: 186416 - DNA, 35 bp, Artificial Sequence
  Synthetic oligonucleotide
gcaggttcatccttgttattgccgccgtgtctcct

SEQ ID NO: 186417 - DNA, 35 bp, Artificial Sequence
  Synthetic oligonucleotide
aaccccacgccagtaagcgcgctccaaactctgct

SEQ ID NO: 186418 - DNA, 35 bp, Artificial Sequence
  Synthetic oligonucleotide
tatgtgcgtagtgcctccccgcgtacaaaccatct

SEQ ID NO: 186419 - DNA, 35 bp, Artificial Sequence
  Synthetic oligonucleotide
atctaccgacccccacgacgtgttttaaaccatct

SEQ ID NO: 186420 - DNA, 35 bp, Artificial Sequence
  Synthetic oligonucleotide
agcacggtctccagtttcccctacatgatccttct

SEQ ID NO: 186421 - DNA, 35 bp, Artificial Sequence
  Synthetic oligonucleotide
gtagcatcagcacgcgcttctccggtctatcttct

SEQ ID NO: 186422 - DNA, 35 bp, Artificial Sequence
  Synthetic oligonucleotide
accataactgcccctgcccgactacggacgaccgt

SEQ ID NO: 186423 - DNA, 35 bp, Artificial Sequence
  Synthetic oligonucleotide
tcatcatcattcgctgtgcctcgcccgtaaacatt

SEQ ID NO: 186424 - DNA, 35 bp, Artificial Sequence
  Synthetic oligonucleotide
gtaccaccccccgtcacctcccacatctgagactt

SEQ ID NO: 186425 - DNA, 35 bp, Artificial Sequence
  Synthetic oligonucleotide
tgcttgcagtggtaggctccctcgctctccgcctt

SEQ ID NO: 186426 - DNA, 35 bp, Artificial Sequence
  Synthetic oligonucleotide
tgcggagggacaatgaaggggaggagcagggtaaa

SEQ ID NO: 186427 - DNA, 36 bp, Artificial Sequence
  Synthetic oligonucleotide
ttctgtccggtctcatcctatcttgctcccgtgcaa

SEQ ID NO: 186428 - DNA, 35 bp, Artificial Sequence
  Synthetic oligonucleotide
tccactctatgccctccgacgccacagttcgagaa

SEQ ID NO: 186429 - DNA, 36 bp, Artificial Sequence
  Synthetic oligonucleotide
atgcctcgccgcctgtccattccggaacgaaccaca

SEQ ID NO: 186430 - DNA, 36 bp, Artificial Sequence
  Synthetic oligonucleotide
gtcaacatcgatcctccccacagctgttggtctaca

SEQ ID NO: 186431 - DNA, 36 bp, Artificial Sequence
  Synthetic oligonucleotide
gctggcttctctgtatctcgcggctctaccccccca

SEQ ID NO: 186432 - DNA, 36 bp, Artificial Sequence
  Synthetic oligonucleotide
ggtgtcgctcagtcatccggtaccgcttccccccca

SEQ ID NO: 186433 - DNA, 36 bp, Artificial Sequence
  Synthetic oligonucleotide
tgagcctatcatcagcagtgcttgtactttccccca

SEQ ID NO: 186434 - DNA, 36 bp, Artificial Sequence
  Synthetic oligonucleotide
gcctccgtacttgccctgtttacttagcccgcccca

SEQ ID NO: 186435 - DNA, 35 bp, Artificial Sequence
  Synthetic oligonucleotide
ttggaactgatctgttaactcgccctcatctccca

SEQ ID NO: 186436 - DNA, 35 bp, Artificial Sequence
  Synthetic oligonucleotide
gagaaagggtagggtgggaagaaggctagaagcca

SEQ ID NO: 186437 - DNA, 36 bp, Artificial Sequence
  Synthetic oligonucleotide
ggactccacatcctaccctgccctgtatctaagcca

SEQ ID NO: 186438 - DNA, 35 bp, Artificial Sequence
  Synthetic oligonucleotide
tccacacttgtacgtgcccggactccaccatgcca

SEQ ID NO: 186439 - DNA, 35 bp, Artificial Sequence
  Synthetic oligonucleotide
tcttgcaccgctccccctagtctgctttgatgcca

SEQ ID NO: 186440 - DNA, 36 bp, Artificial Sequence
  Synthetic oligonucleotide
tgtgcgacgatccgttctttcccactattcgtgcca

SEQ ID NO: 186441 - DNA, 36 bp, Artificial Sequence
  Synthetic oligonucleotide
gtgtagacgcccatttgaaacgccactgtatctcca

SEQ ID NO: 186442 - DNA, 35 bp, Artificial Sequence
  Synthetic oligonucleotide
gcaaaccgtctagtcaacgggaggggggaagggca

SEQ ID NO: 186443 - DNA, 36 bp, Artificial Sequence
  Synthetic oligonucleotide
tcaatatgcagcggtctttcgtcacatcacctggca

SEQ ID NO: 186444 - DNA, 36 bp, Artificial Sequence
  Synthetic oligonucleotide
tcaccagcacctgacctgcatacaccgccgcctgca

SEQ ID NO: 186445 - DNA, 36 bp, Artificial Sequence
  Synthetic oligonucleotide
gcctaccactcgagctgcgtcccctttacttcctca

SEQ ID NO: 186446 - DNA, 36 bp, Artificial Sequence
  Synthetic oligonucleotide
tatgccctcttaccgttcgtgcatgcctatttttca

SEQ ID NO: 186447 - DNA, 37 bp, Artificial Sequence
  Synthetic oligonucleotide
atgcagaaacggggggataggactaaggaatggaaga

SEQ ID NO: 186448 - DNA, 36 bp, Artificial Sequence
  Synthetic oligonucleotide
acagtcgggacaagaatagggagcgtgggggcgaga

SEQ ID NO: 186449 - DNA, 37 bp, Artificial Sequence
  Synthetic oligonucleotide
gtcgcgatagctgttttttgctcacccctgccctaga

SEQ ID NO: 186450 - DNA, 35 bp, Artificial Sequence
  Synthetic oligonucleotide
gactcaccatcttcatcacgcacacgctgttacga

SEQ ID NO: 186451 - DNA, 37 bp, Artificial Sequence
  Synthetic oligonucleotide
gccgcaaacctactgccgttccaatcgcccgcaccga

SEQ ID NO: 186452 - DNA, 37 bp, Artificial Sequence
  Synthetic oligonucleotide
acctgcccaacatgattttcgtctccgcaacacccga

SEQ ID NO: 186453 - DNA, 37 bp, Artificial Sequence
  Synthetic oligonucleotide
acgctaggccctcctgctgaacgtacttaatacccga

SEQ ID NO: 186454 - DNA, 37 bp, Artificial Sequence
  Synthetic oligonucleotide
agtaccacaagtcggtcataaccgccacttcccccga

SEQ ID NO: 186455 - DNA, 35 bp, Artificial Sequence
  Synthetic oligonucleotide
acgctagcactcacgcccttgtaactctttcccga

SEQ ID NO: 186456 - DNA, 37 bp, Artificial Sequence
  Synthetic oligonucleotide
atgacacgtgggctgcgtttcctgttactcctgccga

SEQ ID NO: 186457 - DNA, 37 bp, Artificial Sequence
  Synthetic oligonucleotide
tatgtactgccacaccgacacctatacgaattgccga

SEQ ID NO: 186458 - DNA, 37 bp, Artificial Sequence
  Synthetic oligonucleotide
gatgggcgggcaaagggtgacgggatgtgtacagcga

SEQ ID NO: 186459 - DNA, 37 bp, Artificial Sequence
  Synthetic oligonucleotide
tcagggaagtgagggtatgagtggagaaggggagcga

SEQ ID NO: 186460 - DNA, 37 bp, Artificial Sequence
  Synthetic oligonucleotide
taatgtgtcagagcctcttaccctgtgcctgcctcga

SEQ ID NO: 186461 - DNA, 37 bp, Artificial Sequence
  Synthetic oligonucleotide
gattgcactcccgctctgtcatgggcccctgtctcga

SEQ ID NO: 186462 - DNA, 35 bp, Artificial Sequence
  Synthetic oligonucleotide
tgcaagcgacagctactgcttgttttctccttcga

SEQ ID NO: 186463 - DNA, 37 bp, Artificial Sequence
  Synthetic oligonucleotide
gagggaagccgatatcgggaggggagagggggccgga

SEQ ID NO: 186464 - DNA, 37 bp, Artificial Sequence
  Synthetic oligonucleotide
gtgttcgaggagggtaggggggcagcatcggggcgga

SEQ ID NO: 186465 - DNA, 36 bp, Artificial Sequence
  Synthetic oligonucleotide
gacaggtgcggggggaggcgaggtgcggaatcggga

SEQ ID NO: 186466 - DNA, 36 bp, Artificial Sequence
  Synthetic oligonucleotide
tagggaggggtcgaaatggggtattctaatagggga

SEQ ID NO: 186467 - DNA, 37 bp, Artificial Sequence
  Synthetic oligonucleotide
tcactagcacggtacaggtggcggggaggggtgggga

SEQ ID NO: 186468 - DNA, 36 bp, Artificial Sequence
  Synthetic oligonucleotide
taacgcagggttgggggggtacacggggttggtgga

SEQ ID NO: 186469 - DNA, 37 bp, Artificial Sequence
  Synthetic oligonucleotide
tgaactcccttctgatctgccgccatttcaaccatga

SEQ ID NO: 186470 - DNA, 38 bp, Artificial Sequence
  Synthetic oligonucleotide
tgagggcggagggaggggggtggattttgacggtatga

SEQ ID NO: 186471 - DNA, 37 bp, Artificial Sequence
  Synthetic oligonucleotide
acatcctgtgccgaaccgataagctcctctttactga

SEQ ID NO: 186472 - DNA, 37 bp, Artificial Sequence
  Synthetic oligonucleotide
tagacagccgaaaacgctgttctgaatcctaccctga

SEQ ID NO: 186473 - DNA, 38 bp, Artificial Sequence
  Synthetic oligonucleotide
atgtatccccgtggatgctcgtttatgcctttccctga

SEQ ID NO: 186474 - DNA, 37 bp, Artificial Sequence
  Synthetic oligonucleotide
gcgcgaggtagggaatggcaaaagggcgggcaagtga

SEQ ID NO: 186475 - DNA, 37 bp, Artificial Sequence
  Synthetic oligonucleotide
aaccagtgaagggcggggcttagggaaggatgggtga

SEQ ID NO: 186476 - DNA, 38 bp, Artificial Sequence
  Synthetic oligonucleotide
aactggtcagactacacctctcgctcccgtgcctgtga

SEQ ID NO: 186477 - DNA, 38 bp, Artificial Sequence
  Synthetic oligonucleotide
gaagcccgctcctgccttgctatatatttagttattga

SEQ ID NO: 186478 - DNA, 36 bp, Artificial Sequence
  Synthetic oligonucleotide
gtggcatcctgttcaatctgttgttcgttcccttga

SEQ ID NO: 186479 - DNA, 38 bp, Artificial Sequence
  Synthetic oligonucleotide
gaggcacaactgcctggttctacaccaccactccttga

SEQ ID NO: 186480 - DNA, 38 bp, Artificial Sequence
  Synthetic oligonucleotide
gtcgcatgccagtatagcctccagcccgtcctccttga

SEQ ID NO: 186481 - DNA, 38 bp, Artificial Sequence
  Synthetic oligonucleotide
acggaggggaggtgcaggggacggaatgatggtgttga

SEQ ID NO: 186482 - DNA, 37 bp, Artificial Sequence
  Synthetic oligonucleotide
tacaacaccccatccgtgttgtgctccacctctttga

SEQ ID NO: 186483 - DNA, 36 bp, Artificial Sequence
  Synthetic oligonucleotide
gggggagaaccattggaggagcagggacgggaacta

SEQ ID NO: 186484 - DNA, 36 bp, Artificial Sequence
  Synthetic oligonucleotide
taccccaacgccactcgtttgttatcccgtgtacta

SEQ ID NO: 186485 - DNA, 36 bp, Artificial Sequence
  Synthetic oligonucleotide
tgaccactgtgcctcggtttttacgctcttttacta

SEQ ID NO: 186486 - DNA, 35 bp, Artificial Sequence
  Synthetic oligonucleotide
accatgcacgcctttcttgtagttctcgggcccta

SEQ ID NO: 186487 - DNA, 34 bp, Artificial Sequence
  Synthetic oligonucleotide
tccgccactgtatctgctcggtgccccttcccta

SEQ ID NO: 186488 - DNA, 36 bp, Artificial Sequence
  Synthetic oligonucleotide
atccaccctgctgcctctattcgtttgaatttccta

SEQ ID NO: 186489 - DNA, 36 bp, Artificial Sequence
  Synthetic oligonucleotide
ggggctcccgttgttcgttctctgctcctcgttcta

SEQ ID NO: 186490 - DNA, 36 bp, Artificial Sequence
  Synthetic oligonucleotide
gaccccacttcatcgcttatcgaccgcctatccgta

SEQ ID NO: 186491 - DNA, 36 bp, Artificial Sequence
  Synthetic oligonucleotide
aaagtcaccgctggccctctgataacccccttggta

SEQ ID NO: 186492 - DNA, 36 bp, Artificial Sequence
  Synthetic oligonucleotide
gcacccgacccctggcttgacctccctctctttgta

SEQ ID NO: 186493 - DNA, 36 bp, Artificial Sequence
  Synthetic oligonucleotide
tgttgcaccatatgcatcccggcccttccccgttta

SEQ ID NO: 186494 - DNA, 29 bp, Artificial Sequence
  Synthetic oligonucleotide
gttcccgcctgccctgtaccaaccttaac

SEQ ID NO: 186495 - DNA, 35 bp, Artificial Sequence
  Synthetic oligonucleotide
acgtccatcctcacggtcccaagccggctcgccac

SEQ ID NO: 186496 - DNA, 35 bp, Artificial Sequence
  Synthetic oligonucleotide
tttcgctccatcctccagagcatgatccgactcac

SEQ ID NO: 186497 - DNA, 35 bp, Artificial Sequence
  Synthetic oligonucleotide
gttcgactaccacccgtatgcgtagggcctctcac

SEQ ID NO: 186498 - DNA, 35 bp, Artificial Sequence
  Synthetic oligonucleotide
gagccgttcaatgttccatgcaccatctgtacgac

SEQ ID NO: 186499 - DNA, 35 bp, Artificial Sequence
  Synthetic oligonucleotide
gaccccctcgatccgtttgcccacgtaccccggac

SEQ ID NO: 186500 - DNA, 34 bp, Artificial Sequence
  Synthetic oligonucleotide
tctgctcgtccctccctttctgtacaccgtctac

SEQ ID NO: 186501 - DNA, 35 bp, Artificial Sequence
  Synthetic oligonucleotide
aaacgtgcccccgttatcccgatcgcttgaagtac

SEQ ID NO: 186502 - DNA, 35 bp, Artificial Sequence
  Synthetic oligonucleotide
gccacacgcctgcctggtacttatctctcaccacc

SEQ ID NO: 186503 - DNA, 35 bp, Artificial Sequence
  Synthetic oligonucleotide
tgtgcccaccatgtctaaaatatcgttctacaccc

SEQ ID NO: 186504 - DNA, 35 bp, Artificial Sequence
  Synthetic oligonucleotide
atgacactgccatcaagcgtctattgccgccaccc

SEQ ID NO: 186505 - DNA, 35 bp, Artificial Sequence
  Synthetic oligonucleotide
gaaccgcgcatctaaacctgcatttacatccgccc

SEQ ID NO: 186506 - DNA, 35 bp, Artificial Sequence
  Synthetic oligonucleotide
gttgcctccgtttattacatgttcgctctaggccc

SEQ ID NO: 186507 - DNA, 35 bp, Artificial Sequence
  Synthetic oligonucleotide
atggagtcctcctacgcctcagcctgtttactccc

SEQ ID NO: 186508 - DNA, 35 bp, Artificial Sequence
  Synthetic oligonucleotide
tattgcgcctactcctgttgtccctcacccacgcc

SEQ ID NO: 186509 - DNA, 35 bp, Artificial Sequence
  Synthetic oligonucleotide
gtcccccgcctatgtgtcccgaaccctccagcgcc

SEQ ID NO: 186510 - DNA, 35 bp, Artificial Sequence
  Synthetic oligonucleotide
tgctcaatgccgttttgttgccttcgaccctggcc

SEQ ID NO: 186511 - DNA, 35 bp, Artificial Sequence
  Synthetic oligonucleotide
tgctttgcccacctcgccctccgccacatggtgcc

SEQ ID NO: 186512 - DNA, 35 bp, Artificial Sequence
  Synthetic oligonucleotide
gtccacctgtgcctgctaacgacccatcctttgcc

SEQ ID NO: 186513 - DNA, 35 bp, Artificial Sequence
  Synthetic oligonucleotide
tgtgcgacactacgattcacgcccatgtttactcc

SEQ ID NO: 186514 - DNA, 35 bp, Artificial Sequence
  Synthetic oligonucleotide
atgacgcctgttagacactcgtttttgaatcctcc

SEQ ID NO: 186515 - DNA, 35 bp, Artificial Sequence
  Synthetic oligonucleotide
gccacattcgggtttcctatcacacagcggtctcc

SEQ ID NO: 186516 - DNA, 35 bp, Artificial Sequence
  Synthetic oligonucleotide
gctgtcatccccgacgatcccccgctattgagtcc

SEQ ID NO: 186517 - DNA, 35 bp, Artificial Sequence
  Synthetic oligonucleotide
acacgacgcgtggttgagttcgcctgtcaccgtcc

SEQ ID NO: 186518 - DNA, 35 bp, Artificial Sequence
  Synthetic oligonucleotide
cacaagcgcccacctcgtcatcgctagcccggtcc

SEQ ID NO: 186519 - DNA, 35 bp, Artificial Sequence
  Synthetic oligonucleotide
gcaacggcatgttaccccgcgttctctattggtcc

SEQ ID NO: 186520 - DNA, 35 bp, Artificial Sequence
  Synthetic oligonucleotide
atgtcgcctacctcctgtctttgctgcacgattcc

SEQ ID NO: 186521 - DNA, 35 bp, Artificial Sequence
  Synthetic oligonucleotide
ttcatgcgccgttctcgcatcctttcctgtattcc

SEQ ID NO: 186522 - DNA, 35 bp, Artificial Sequence
  Synthetic oligonucleotide
tctcgcccatcaccttgtctttttgccctcaacgc

SEQ ID NO: 186523 - DNA, 35 bp, Artificial Sequence
  Synthetic oligonucleotide
tccgctgacgccgtcaaactctcgccttttctcgc

SEQ ID NO: 186524 - DNA, 35 bp, Artificial Sequence
  Synthetic oligonucleotide
accgccactccactgtaccaacagcggccactggc

SEQ ID NO: 186525 - DNA, 35 bp, Artificial Sequence
  Synthetic oligonucleotide
ttcggacaacactccagccgcaccacgctccctgc

SEQ ID NO: 186526 - DNA, 35 bp, Artificial Sequence
  Synthetic oligonucleotide
gaccaccccgagactcctgatcatttaacacttgc

SEQ ID NO: 186527 - DNA, 35 bp, Artificial Sequence
  Synthetic oligonucleotide
tgccaccatcgtgtaagaatcctacccgtccttgc

SEQ ID NO: 186528 - DNA, 35 bp, Artificial Sequence
  Synthetic oligonucleotide
tgtggcgtccagaagcctagatcctccgtcacatc

SEQ ID NO: 186529 - DNA, 35 bp, Artificial Sequence
  Synthetic oligonucleotide
tacgtcgcctccctaacttattcataacgcgcctc

SEQ ID NO: 186530 - DNA, 35 bp, Artificial Sequence
  Synthetic oligonucleotide
tcataccggtcatggtttcaactcccccaccgctc

SEQ ID NO: 186531 - DNA, 35 bp, Artificial Sequence
  Synthetic oligonucleotide
gaaatgcccgctgaaatgctccgttacactcgctc

SEQ ID NO: 186532 - DNA, 35 bp, Artificial Sequence
  Synthetic oligonucleotide
taatcgcgctgtcgtgtcaacacccgttacatctc

SEQ ID NO: 186533 - DNA, 35 bp, Artificial Sequence
  Synthetic oligonucleotide
atctaccatcgccaccgctgctctatgctccagtc

SEQ ID NO: 186534 - DNA, 35 bp, Artificial Sequence
  Synthetic oligonucleotide
gccacgtgcgtatccaccgtcctaatttgcacgtc

SEQ ID NO: 186535 - DNA, 35 bp, Artificial Sequence
  Synthetic oligonucleotide
attagcgtccgttctatccaccctcagtctgcgtc

SEQ ID NO: 186536 - DNA, 35 bp, Artificial Sequence
  Synthetic oligonucleotide
gccgtcctcggtaaaccatcctcaagtcgtacttc

SEQ ID NO: 186537 - DNA, 35 bp, Artificial Sequence
  Synthetic oligonucleotide
ttatacgtccgcacgtgcttgatgcacccgccttc

SEQ ID NO: 186538 - DNA, 35 bp, Artificial Sequence
  Synthetic oligonucleotide
gtctccccgcctttttcctaacgtgttcctggttc

SEQ ID NO: 186539 - DNA, 35 bp, Artificial Sequence
  Synthetic oligonucleotide
tgctacccgccccgggactgttgatttcccgtttc

SEQ ID NO: 186540 - DNA, 35 bp, Artificial Sequence
  Synthetic oligonucleotide
gtgctcgggtatgggggggagatgcgggggcccag

SEQ ID NO: 186541 - DNA, 35 bp, Artificial Sequence
  Synthetic oligonucleotide
tagcgagcaggtacgaaaaggggcggcgggtagag

SEQ ID NO: 186542 - DNA, 35 bp, Artificial Sequence
  Synthetic oligonucleotide
agaacagtaggacgggggggaggacaggccggacg

SEQ ID NO: 186543 - DNA, 35 bp, Artificial Sequence
  Synthetic oligonucleotide
gttgtcccgcacacctccttgcttacacatttacg

SEQ ID NO: 186544 - DNA, 35 bp, Artificial Sequence
  Synthetic oligonucleotide
tccacccagagtgcgccccctgtcatattcctgcg

SEQ ID NO: 186545 - DNA, 35 bp, Artificial Sequence
  Synthetic oligonucleotide
tagactacatccagcccttgacctcgggaccctcg

SEQ ID NO: 186546 - DNA, 35 bp, Artificial Sequence
  Synthetic oligonucleotide
gagcctacgccttgcttcaaaccgcatcctcctcg

SEQ ID NO: 186547 - DNA, 35 bp, Artificial Sequence
  Synthetic oligonucleotide
gagacagtactgttgggaggacggggggactgcgg

SEQ ID NO: 186548 - DNA, 34 bp, Artificial Sequence
  Synthetic oligonucleotide
tcttgtcgtcacacgcatcctctccaccgcctgg

SEQ ID NO: 186549 - DNA, 35 bp, Artificial Sequence
  Synthetic oligonucleotide
aactggtggagggggggatataatcagcgggctgg

SEQ ID NO: 186550 - DNA, 35 bp, Artificial Sequence
  Synthetic oligonucleotide
gaccaacggtggcatgggaaagtagggagtagatg

SEQ ID NO: 186551 - DNA, 35 bp, Artificial Sequence
  Synthetic oligonucleotide
gaaaggagtgcaggtaggaagggaagggcatgctg

SEQ ID NO: 186552 - DNA, 35 bp, Artificial Sequence
  Synthetic oligonucleotide
acaactctcccgctgccaatacctctcgtatagtg

SEQ ID NO: 186553 - DNA, 35 bp, Artificial Sequence
  Synthetic oligonucleotide
gtgtccggtaacgcaccccccccgcaaggatcttg

SEQ ID NO: 186554 - DNA, 35 bp, Artificial Sequence
  Synthetic oligonucleotide
tcccgcgccgctccacagcgcaactcgctcccaat

SEQ ID NO: 186555 - DNA, 35 bp, Artificial Sequence
  Synthetic oligonucleotide
gccatttcggtgctttcctcgtcttctggtaccat

SEQ ID NO: 186556 - DNA, 35 bp, Artificial Sequence
  Synthetic oligonucleotide
ggtggggggagatggatccgtggagtggggtggat

SEQ ID NO: 186557 - DNA, 35 bp, Artificial Sequence
  Synthetic oligonucleotide
tgcgcagtccctcgctcttttccggactactccct

SEQ ID NO: 186558 - DNA, 35 bp, Artificial Sequence
  Synthetic oligonucleotide
gacaaccgccataagccctcctccagctccccgct

SEQ ID NO: 186559 - DNA, 35 bp, Artificial Sequence
  Synthetic oligonucleotide
ttcgccgggacccgacttcttgctcgcctcgctct

SEQ ID NO: 186560 - DNA, 35 bp, Artificial Sequence
  Synthetic oligonucleotide
tgtcctaccactcctgggatgttgactctatctct

SEQ ID NO: 186561 - DNA, 35 bp, Artificial Sequence
  Synthetic oligonucleotide
gtgccatccgtctaattcggtctcccccaccaagt

SEQ ID NO: 186562 - DNA, 35 bp, Artificial Sequence
  Synthetic oligonucleotide
gccgggggagggggggagaaggagatgaacaaggt

SEQ ID NO: 186563 - DNA, 35 bp, Artificial Sequence
  Synthetic oligonucleotide
gacccccactatatgccttttaagcccccacaggt

SEQ ID NO: 186564 - DNA, 35 bp, Artificial Sequence
  Synthetic oligonucleotide
gcagaggacattaagggcataggggggcgacgggt

SEQ ID NO: 186565 - DNA, 35 bp, Artificial Sequence
  Synthetic oligonucleotide
gaatgcgcagctaccactttcaccttgctccgggt

SEQ ID NO: 186566 - DNA, 34 bp, Artificial Sequence
  Synthetic oligonucleotide
accgcccacactgctgcaatactcacgctcctgt

SEQ ID NO: 186567 - DNA, 35 bp, Artificial Sequence
  Synthetic oligonucleotide
gttgcctctctgtagctccccttgtccgttcctgt

SEQ ID NO: 186568 - DNA, 35 bp, Artificial Sequence
  Synthetic oligonucleotide
agtcgcccctccatctctccgtcggtctcatctgt

SEQ ID NO: 186569 - DNA, 36 bp, Artificial Sequence
  Synthetic oligonucleotide
ttcgtactcgtccatcgttcgtccgagttttacctt

SEQ ID NO: 186570 - DNA, 35 bp, Artificial Sequence
  Synthetic oligonucleotide
tgcgagcaatctcctttccggtctgcgcccccctt

SEQ ID NO: 186571 - DNA, 35 bp, Artificial Sequence
  Synthetic oligonucleotide
tccgttacactcgccgaagtgcattcgtgcctctt

SEQ ID NO: 186572 - DNA, 35 bp, Artificial Sequence
  Synthetic oligonucleotide
tatagctccacatggcatctgcttaccggtttctt

SEQ ID NO: 186573 - DNA, 35 bp, Artificial Sequence
  Synthetic oligonucleotide
tcaaatccaccatcgctgcacgtccttggcccgtt

SEQ ID NO: 186574 - DNA, 36 bp, Artificial Sequence
  Synthetic oligonucleotide
tcgcccctgcctttctagtttcaacctgttcccaaa

SEQ ID NO: 186575 - DNA, 36 bp, Artificial Sequence
  Synthetic oligonucleotide
agagagggagaagacgcaagaagcaaaacggagaaa

SEQ ID NO: 186576 - DNA, 34 bp, Artificial Sequence
  Synthetic oligonucleotide
ggtggggagggagggaggcatgctacagagacaa

SEQ ID NO: 186577 - DNA, 36 bp, Artificial Sequence
  Synthetic oligonucleotide
agtaccatccgaaggccttgccatattcccgctgaa

SEQ ID NO: 186578 - DNA, 36 bp, Artificial Sequence
  Synthetic oligonucleotide
gtctactcacatcgagttccgcccttgccctcgtaa

SEQ ID NO: 186579 - DNA, 35 bp, Artificial Sequence
  Synthetic oligonucleotide
gttgccatctatcttttcgttcccgccagtattaa

SEQ ID NO: 186580 - DNA, 36 bp, Artificial Sequence
  Synthetic oligonucleotide
gctcacgcacatattgcttgcctctcctcttgaaca

SEQ ID NO: 186581 - DNA, 35 bp, Artificial Sequence
  Synthetic oligonucleotide
gacaccgccgtatttctctctcccgagtgttaaca

SEQ ID NO: 186582 - DNA, 35 bp, Artificial Sequence
  Synthetic oligonucleotide
gatccccgaccaccatcattgcccgcgaggccaca

SEQ ID NO: 186583 - DNA, 36 bp, Artificial Sequence
  Synthetic oligonucleotide
agtcgccacgcctcacttccctctgcaacgagtaca

SEQ ID NO: 186584 - DNA, 36 bp, Artificial Sequence
  Synthetic oligonucleotide
gcgcactacacgaatttttagcgccttgaaccacca

SEQ ID NO: 186585 - DNA, 35 bp, Artificial Sequence
  Synthetic oligonucleotide
tgacaaggcctcaggaactctaatctgctccccca

SEQ ID NO: 186586 - DNA, 36 bp, Artificial Sequence
  Synthetic oligonucleotide
ctggtccacccgccactctcgctcacatgacatcca

SEQ ID NO: 186587 - DNA, 36 bp, Artificial Sequence
  Synthetic oligonucleotide
attcaagcaacacgcaccctctacgtactgtatcca

SEQ ID NO: 186588 - DNA, 36 bp, Artificial Sequence
  Synthetic oligonucleotide
ggacatttcgccgtgcgttccaccccggaccttcca

SEQ ID NO: 186589 - DNA, 36 bp, Artificial Sequence
  Synthetic oligonucleotide
gttatcatccgctgactatcgccactgcactccgca

SEQ ID NO: 186590 - DNA, 35 bp, Artificial Sequence
  Synthetic oligonucleotide
tgcgccgactctgcccacgccgttattgatctgca

SEQ ID NO: 186591 - DNA, 36 bp, Artificial Sequence
  Synthetic oligonucleotide
tgtgacgaccttcctaagcgatccccccgttttgca

SEQ ID NO: 186592 - DNA, 33 bp, Artificial Sequence
  Synthetic oligonucleotide
tctcgcaactccgacgcccctcaacctagatca

SEQ ID NO: 186593 - DNA, 35 bp, Artificial Sequence
  Synthetic oligonucleotide
gactacttccgctggtcttcatcattcatttatca

SEQ ID NO: 186594 - DNA, 36 bp, Artificial Sequence
  Synthetic oligonucleotide
gtttgcacgctgtgcaatcgtttcacgtacccctca

SEQ ID NO: 186595 - DNA, 35 bp, Artificial Sequence
  Synthetic oligonucleotide
atgcacggtggtgtgtcctgtatcccttcgcctca

SEQ ID NO: 186596 - DNA, 34 bp, Artificial Sequence
  Synthetic oligonucleotide
tgcccactctctaggctatatctgatcttgctca

SEQ ID NO: 186597 - DNA, 35 bp, Artificial Sequence
  Synthetic oligonucleotide
tataccgcgtagttatcccttgtgtcctcctctca

SEQ ID NO: 186598 - DNA, 36 bp, Artificial Sequence
  Synthetic oligonucleotide
aagacaagtccatagtctgcatatttcgtcctctca

SEQ ID NO: 186599 - DNA, 35 bp, Artificial Sequence
  Synthetic oligonucleotide
ttggtcgccacccatttatagtatgtccctgttca

SEQ ID NO: 186600 - DNA, 36 bp, Artificial Sequence
  Synthetic oligonucleotide
ttgccatccctcgggcattggtgcttattcctttca

SEQ ID NO: 186601 - DNA, 37 bp, Artificial Sequence
  Synthetic oligonucleotide
tcgagtaaaggaggaagggcatgggccgggaacgaga

SEQ ID NO: 186602 - DNA, 37 bp, Artificial Sequence
  Synthetic oligonucleotide
gtggcacggaggggagggctacaaggagggagataga

SEQ ID NO: 186603 - DNA, 37 bp, Artificial Sequence
  Synthetic oligonucleotide
ttacgcatctcgctgccttccccatgtcccacttaga

SEQ ID NO: 186604 - DNA, 35 bp, Artificial Sequence
  Synthetic oligonucleotide
gccaacagggtgatccgcgcgcctccttccttaga

SEQ ID NO: 186605 - DNA, 37 bp, Artificial Sequence
  Synthetic oligonucleotide
gagccgatcgccatcccgtccacaagcgcctccacga

SEQ ID NO: 186606 - DNA, 37 bp, Artificial Sequence
  Synthetic oligonucleotide
accgcacttgcctctttatccgccttacgttggacga

SEQ ID NO: 186607 - DNA, 37 bp, Artificial Sequence
  Synthetic oligonucleotide
gacactatcaccactgcgatcagcccacgccgcccga

SEQ ID NO: 186608 - DNA, 37 bp, Artificial Sequence
  Synthetic oligonucleotide
accacgtagcccaccgtgccatcctccatagacgcga

SEQ ID NO: 186609 - DNA, 37 bp, Artificial Sequence
  Synthetic oligonucleotide
agatgcgtaaaactggccttcacactctccttcgcga

SEQ ID NO: 186610 - DNA, 37 bp, Artificial Sequence
  Synthetic oligonucleotide
acctccccgcagacccaccctgtcgtttctcgtgcga

SEQ ID NO: 186611 - DNA, 37 bp, Artificial Sequence
  Synthetic oligonucleotide
agccgcattcctttggttatcctctcgtttccttcga

SEQ ID NO: 186612 - DNA, 35 bp, Artificial Sequence
  Synthetic oligonucleotide
ttccccgcccacctgttcttagcaccaccgttcga

SEQ ID NO: 186613 - DNA, 37 bp, Artificial Sequence
  Synthetic oligonucleotide
gcctcccctccacctctccattaagggacccacagga

SEQ ID NO: 186614 - DNA, 37 bp, Artificial Sequence
  Synthetic oligonucleotide
tagggaggggaaatattggtagaggctggggtgagga

SEQ ID NO: 186615 - DNA, 37 bp, Artificial Sequence
  Synthetic oligonucleotide
gggtgggggcgagatagagaggggaatgtgcgtagga

SEQ ID NO: 186616 - DNA, 37 bp, Artificial Sequence
  Synthetic oligonucleotide
gacatgggagtagtggtggggggggaagtcgaccgga

SEQ ID NO: 186617 - DNA, 37 bp, Artificial Sequence
  Synthetic oligonucleotide
gaagaacaggtggaaaggcgggcggggaagtgccgga

SEQ ID NO: 186618 - DNA, 37 bp, Artificial Sequence
  Synthetic oligonucleotide
gtgggcggccgggagatgggtgggggatactatcgga

SEQ ID NO: 186619 - DNA, 37 bp, Artificial Sequence
  Synthetic oligonucleotide
atgtgtagccgggactaagaggggggaggtaacggga

SEQ ID NO: 186620 - DNA, 37 bp, Artificial Sequence
  Synthetic oligonucleotide
gtgaccactaggccgggtgggataagggataagggga

SEQ ID NO: 186621 - DNA, 36 bp, Artificial Sequence
  Synthetic oligonucleotide
atgggtgggaacggagttgtgtactggcggggggga

SEQ ID NO: 186622 - DNA, 38 bp, Artificial Sequence
  Synthetic oligonucleotide
gacacgcacggtccccttaagcccctcttatttcatga

SEQ ID NO: 186623 - DNA, 37 bp, Artificial Sequence
  Synthetic oligonucleotide
tgtgtacactatgcctatccgatccgcctcatactga

SEQ ID NO: 186624 - DNA, 38 bp, Artificial Sequence
  Synthetic oligonucleotide
gccctgccacttgagctatacgtgcctcctaatcctga

SEQ ID NO: 186625 - DNA, 37 bp, Artificial Sequence
  Synthetic oligonucleotide
atccacacacgttagtgtcccgtccagtacctcctga

SEQ ID NO: 186626 - DNA, 38 bp, Artificial Sequence
  Synthetic oligonucleotide
ttgacataggcgaaaggggaagggggaaggcgtgctga

SEQ ID NO: 186627 - DNA, 38 bp, Artificial Sequence
  Synthetic oligonucleotide
gcctagcgcgctcgtgttgctctgatccctcttgctga

SEQ ID NO: 186628 - DNA, 38 bp, Artificial Sequence
  Synthetic oligonucleotide
tcatccatccatgctatatcgccatagtcaggctctga

SEQ ID NO: 186629 - DNA, 38 bp, Artificial Sequence
  Synthetic oligonucleotide
agtagtcgccctactggtacatcactacacctctctga

SEQ ID NO: 186630 - DNA, 38 bp, Artificial Sequence
  Synthetic oligonucleotide
agacacgttggccccccacttcccactccctcacgtga

SEQ ID NO: 186631 - DNA, 38 bp, Artificial Sequence
  Synthetic oligonucleotide
taacgtcgccccaccatcgtccatcacccctcgcgtga

SEQ ID NO: 186632 - DNA, 36 bp, Artificial Sequence
  Synthetic oligonucleotide
aagcatggagaaagtactaggagtgggcgggggtga

SEQ ID NO: 186633 - DNA, 35 bp, Artificial Sequence
  Synthetic oligonucleotide
tcactccgccgcattcctcccttcgccgaatgtga

SEQ ID NO: 186634 - DNA, 36 bp, Artificial Sequence
  Synthetic oligonucleotide
ttcagtcactacgatgtaacatccccctctgtgtga

SEQ ID NO: 186635 - DNA, 37 bp, Artificial Sequence
  Synthetic oligonucleotide
tcagcggagccacccgactctccgccattctcattga

SEQ ID NO: 186636 - DNA, 38 bp, Artificial Sequence
  Synthetic oligonucleotide
tcaacgagcccagatcgttgaccgcctaccatccttga

SEQ ID NO: 186637 - DNA, 37 bp, Artificial Sequence
  Synthetic oligonucleotide
tctcccgcgctccattcgcattcgttcccgttgttga

SEQ ID NO: 186638 - DNA, 37 bp, Artificial Sequence
  Synthetic oligonucleotide
gttacaccctcacctctagaccatacagctcttttga

SEQ ID NO: 186639 - DNA, 36 bp, Artificial Sequence
  Synthetic oligonucleotide
gcctgcctcgcgctgccttcgacactccccctcata

SEQ ID NO: 186640 - DNA, 35 bp, Artificial Sequence
  Synthetic oligonucleotide
ggacacatcgcacatagctcgctcgaatcttcata

SEQ ID NO: 186641 - DNA, 36 bp, Artificial Sequence
  Synthetic oligonucleotide
tgccaccattggacgtcatctacgctgcttatccta

SEQ ID NO: 186642 - DNA, 35 bp, Artificial Sequence
  Synthetic oligonucleotide
acatcccaccgccccgattaatttgcctcgatcta

SEQ ID NO: 186643 - DNA, 36 bp, Artificial Sequence
  Synthetic oligonucleotide
gatcccgcagtcgtctttccatgtcccatcttagta

SEQ ID NO: 186644 - DNA, 36 bp, Artificial Sequence
  Synthetic oligonucleotide
atctccgcctatgctggcaggtccccacttcccgta

SEQ ID NO: 186645 - DNA, 35 bp, Artificial Sequence
  Synthetic oligonucleotide
tgtaccatcaacgtagcgcaatttccttcgctgta

SEQ ID NO: 186646 - DNA, 35 bp, Artificial Sequence
  Synthetic oligonucleotide
gcgctgtgtcggccgcaccttctgttacttcctta

SEQ ID NO: 186647 - DNA, 35 bp, Artificial Sequence
  Synthetic oligonucleotide
accttgatccacctactgccctgacgcatgtctta

SEQ ID NO: 186648 - DNA, 35 bp, Artificial Sequence
  Synthetic oligonucleotide
gccactttccccagttgctttcctctaacctaaac

SEQ ID NO: 186649 - DNA, 35 bp, Artificial Sequence
  Synthetic oligonucleotide
gtctgcggcccttgtcaattcttgcgttctcccac

SEQ ID NO: 186650 - DNA, 35 bp, Artificial Sequence
  Synthetic oligonucleotide
gcacctcccagcacggtattgttgatctctgctac

SEQ ID NO: 186651 - DNA, 35 bp, Artificial Sequence
  Synthetic oligonucleotide
gttgcccccaccacctatcattagaatgcctgtac

SEQ ID NO: 186652 - DNA, 35 bp, Artificial Sequence
  Synthetic oligonucleotide
gccacgctctgtgctactccatcgctgttataacc

SEQ ID NO: 186653 - DNA, 35 bp, Artificial Sequence
  Synthetic oligonucleotide
ttcatggcccgtcgctccatccacacgtcctcacc

SEQ ID NO: 186654 - DNA, 34 bp, Artificial Sequence
  Synthetic oligonucleotide
gcgcccggcctattgcgcattcttccttaatacc

SEQ ID NO: 186655 - DNA, 35 bp, Artificial Sequence
  Synthetic oligonucleotide
gttcactcgcgcccaatcgaggcataccgataccc

SEQ ID NO: 186656 - DNA, 35 bp, Artificial Sequence
  Synthetic oligonucleotide
tagcaaagcgcacccgcctgtactaccgttcgccc

SEQ ID NO: 186657 - DNA, 35 bp, Artificial Sequence
  Synthetic oligonucleotide
gtgactgtttccgcgtctggccctgcaattctccc

SEQ ID NO: 186658 - DNA, 35 bp, Artificial Sequence
  Synthetic oligonucleotide
gtcctccgcacgaataactttccacgaccttagcc

SEQ ID NO: 186659 - DNA, 35 bp, Artificial Sequence
  Synthetic oligonucleotide
gttcaccccgcccggtcttagcacatctcacggcc

SEQ ID NO: 186660 - DNA, 35 bp, Artificial Sequence
  Synthetic oligonucleotide
tcccgcccccatctctatcttatgtcgctaatgcc

SEQ ID NO: 186661 - DNA, 35 bp, Artificial Sequence
  Synthetic oligonucleotide
tcactcgttcactgtggtcccgcgtgccttaatcc

SEQ ID NO: 186662 - DNA, 35 bp, Artificial Sequence
  Synthetic oligonucleotide
gctggacgatttttgcgaagctggcctccacctcc

SEQ ID NO: 186663 - DNA, 35 bp, Artificial Sequence
  Synthetic oligonucleotide
tcagcacgcctgccggccttgatactacaccctcc

SEQ ID NO: 186664 - DNA, 35 bp, Artificial Sequence
  Synthetic oligonucleotide
tcgaccgttgactgccttgatggtgccattcctcc

SEQ ID NO: 186665 - DNA, 35 bp, Artificial Sequence
  Synthetic oligonucleotide
gcatcctgtagcggtgattccagtccctcatgtcc

SEQ ID NO: 186666 - DNA, 35 bp, Artificial Sequence
  Synthetic oligonucleotide
gatgccgcccctacactgtatccatggattattcc

SEQ ID NO: 186667 - DNA, 35 bp, Artificial Sequence
  Synthetic oligonucleotide
ctgtgcctcacattcatcttgcgctggccctttcc

SEQ ID NO: 186668 - DNA, 35 bp, Artificial Sequence
  Synthetic oligonucleotide
tttgcatgtccacatccgccttctctgtaatcagc

SEQ ID NO: 186669 - DNA, 35 bp, Artificial Sequence
  Synthetic oligonucleotide
tcacacaccgattccgtgttcccttccatctacgc

SEQ ID NO: 186670 - DNA, 35 bp, Artificial Sequence
  Synthetic oligonucleotide
ttaacgtgcgcatcccccggctcaacttcatctgc

SEQ ID NO: 186671 - DNA, 35 bp, Artificial Sequence
  Synthetic oligonucleotide
tcgcccctgatgacggccttctttctcacaccatc

SEQ ID NO: 186672 - DNA, 35 bp, Artificial Sequence
  Synthetic oligonucleotide
tgactgcccgggtcgccaccctccttgcctgcatc

SEQ ID NO: 186673 - DNA, 35 bp, Artificial Sequence
  Synthetic oligonucleotide
tccacggcttggtatccttgcagtttcaccacctc

SEQ ID NO: 186674 - DNA, 35 bp, Artificial Sequence
  Synthetic oligonucleotide
tcccgcattgtccggtgactcccttactttgcctc

SEQ ID NO: 186675 - DNA, 35 bp, Artificial Sequence
  Synthetic oligonucleotide
tccgttatcccgccaagactttatgcctcatcctc

SEQ ID NO: 186676 - DNA, 35 bp, Artificial Sequence
  Synthetic oligonucleotide
tctactcgccgaatgcccgtgaccgctgatcgctc

SEQ ID NO: 186677 - DNA, 35 bp, Artificial Sequence
  Synthetic oligonucleotide
actctcgctcattccctgcctagccgttttatctc

SEQ ID NO: 186678 - DNA, 35 bp, Artificial Sequence
  Synthetic oligonucleotide
agtgctaactccgacatctctgctccacggctctc

SEQ ID NO: 186679 - DNA, 35 bp, Artificial Sequence
  Synthetic oligonucleotide
agctgtcctcctgccctttgtgatcttgcatcgtc

SEQ ID NO: 186680 - DNA, 35 bp, Artificial Sequence
  Synthetic oligonucleotide
tcccccctcgccgctgagcctctttgtgcctggtc

SEQ ID NO: 186681 - DNA, 34 bp, Artificial Sequence
  Synthetic oligonucleotide
tcaaaaggcccgaaccgcagtccattccgccttc

SEQ ID NO: 186682 - DNA, 35 bp, Artificial Sequence
  Synthetic oligonucleotide
tccactcctcctcatctctgtcctgggtgcctttc

SEQ ID NO: 186683 - DNA, 35 bp, Artificial Sequence
  Synthetic oligonucleotide
acgaacgatcggcctgactacccccttctcctttc

SEQ ID NO: 186684 - DNA, 35 bp, Artificial Sequence
  Synthetic oligonucleotide
gtattccgccgctctctcttcccaccgaccgtttc

SEQ ID NO: 186685 - DNA, 35 bp, Artificial Sequence
  Synthetic oligonucleotide
tagtcgacaccctctctgcgcagtggtcctttttc

SEQ ID NO: 186686 - DNA, 35 bp, Artificial Sequence
  Synthetic oligonucleotide
tagaggaccggcaagaggagaacaggggcatacag

SEQ ID NO: 186687 - DNA, 35 bp, Artificial Sequence
  Synthetic oligonucleotide
gggacgcaggtagggaaaggggaaggaaactccag

SEQ ID NO: 186688 - DNA, 35 bp, Artificial Sequence
  Synthetic oligonucleotide
tctagcccactactcgccctgcactgcacttgtag

SEQ ID NO: 186689 - DNA, 35 bp, Artificial Sequence
  Synthetic oligonucleotide
tccgggacgaagacggaaggagagggggttcaacg

SEQ ID NO: 186690 - DNA, 34 bp, Artificial Sequence
  Synthetic oligonucleotide
tcgactcagcttgcccctgtaacgatatctcccg

SEQ ID NO: 186691 - DNA, 35 bp, Artificial Sequence
  Synthetic oligonucleotide
gctgactcgcgtaaccgatccccttgtccctagcg

SEQ ID NO: 186692 - DNA, 35 bp, Artificial Sequence
  Synthetic oligonucleotide
accacccgccctcttcgactcaaagcacttgcgcg

SEQ ID NO: 186693 - DNA, 35 bp, Artificial Sequence
  Synthetic oligonucleotide
gattggccgccccgacccctaaacacaccgtttcg

SEQ ID NO: 186694 - DNA, 35 bp, Artificial Sequence
  Synthetic oligonucleotide
taaggatgaggcggttggaaatagaaggatggagg

SEQ ID NO: 186695 - DNA, 35 bp, Artificial Sequence
  Synthetic oligonucleotide
aagaacgtggaagtgaataatggaacgggggaggg

SEQ ID NO: 186696 - DNA, 35 bp, Artificial Sequence
  Synthetic oligonucleotide
gcacacgtcctcgccagaagcacctctcaccttgg

SEQ ID NO: 186697 - DNA, 35 bp, Artificial Sequence
  Synthetic oligonucleotide
ttgaaccgccggaatattcgcgctcaccactactg

SEQ ID NO: 186698 - DNA, 35 bp, Artificial Sequence
  Synthetic oligonucleotide
tccgtgcgcgccatttcttcacgcctcttgccctg

SEQ ID NO: 186699 - DNA, 35 bp, Artificial Sequence
  Synthetic oligonucleotide
gtcgtcccgttggcctactacccacatacatcctg

SEQ ID NO: 186700 - DNA, 35 bp, Artificial Sequence
  Synthetic oligonucleotide
tcccgccgcaccctaaccataacccgtttgtcctg

SEQ ID NO: 186701 - DNA, 35 bp, Artificial Sequence
  Synthetic oligonucleotide
tgctccatgcccgattataccacgttcctgtgctg

SEQ ID NO: 186702 - DNA, 35 bp, Artificial Sequence
  Synthetic oligonucleotide
tatgctgttccgactatgcgccccctatgcctctg

SEQ ID NO: 186703 - DNA, 35 bp, Artificial Sequence; identical to SEQ ID NO: 1425
  Synthetic oligonucleotide

SEQ ID NO: 186704 - DNA, 35 bp, Artificial Sequence
  Synthetic oligonucleotide
tcagcaggagggcgttggacgggacgggtgggttg

SEQ ID NO: 186705 - DNA, 35 bp, Artificial Sequence
  Synthetic oligonucleotide
tcctccccgtgctgttcgatctcttcgagcctcat

SEQ ID NO: 186706 - DNA, 35 bp, Artificial Sequence
  Synthetic oligonucleotide
tggacgccttccccgttttgaggaacaccgaacct

SEQ ID NO: 186707 - DNA, 35 bp, Artificial Sequence
  Synthetic oligonucleotide
agaccctcacacggtacaaggtttttcaattccct

SEQ ID NO: 186708 - DNA, 35 bp, Artificial Sequence
  Synthetic oligonucleotide
gacacgacatctccctctgtccttcaattgcatct

SEQ ID NO: 186709 - DNA, 35 bp, Artificial Sequence
  Synthetic oligonucleotide
tgccaccgcactgtctatgctccgcccttcagtct

SEQ ID NO: 186710 - DNA, 35 bp, Artificial Sequence
  Synthetic oligonucleotide
tgtactccctcgtgttctttcctatccccggtagt

SEQ ID NO: 186711 - DNA, 35 bp, Artificial Sequence
  Synthetic oligonucleotide
gacttgccgcccgaccttgcgatcttttatttagt

SEQ ID NO: 186712 - DNA, 35 bp, Artificial Sequence
  Synthetic oligonucleotide
agggccccgccagtgtcacgttatatccgttccgt

SEQ ID NO: 186713 - DNA, 35 bp, Artificial Sequence
  Synthetic oligonucleotide
ccggccgttttagctactaccaccaccacccgggt

SEQ ID NO: 186714 - DNA, 35 bp, Artificial Sequence
  Synthetic oligonucleotide
ggacgctcaagactgtctttactccccgcatcgtt

SEQ ID NO: 186715 - DNA, 35 bp, Artificial Sequence
  Synthetic oligonucleotide
gcgctccttcccgtgtcacaccgttttgcatcttt

SEQ ID NO: 186716 - DNA, 35 bp, Artificial Sequence
  Synthetic oligonucleotide
gatggaaaggagagggacgggatggggcctgaaaa

SEQ ID NO: 186717 - DNA, 36 bp, Artificial Sequence
  Synthetic oligonucleotide
agccggtggaagtaggctcgaaggcggggaaggaaa

SEQ ID NO: 186718 - DNA, 35 bp, Artificial Sequence
  Synthetic oligonucleotide
gtcccaagtacactgctccacgtgcccagtcccaa

SEQ ID NO: 186719 - DNA, 36 bp, Artificial Sequence
  Synthetic oligonucleotide
gccgggccgccgcactggtattcgccgctttcccaa

SEQ ID NO: 186720 - DNA, 36 bp, Artificial Sequence
  Synthetic oligonucleotide
ttctcagtcagctttttgtcccaccccccagtccaa

SEQ ID NO: 186721 - DNA, 36 bp, Artificial Sequence
  Synthetic oligonucleotide
gttgcgcctcctgctctctgtgatcatctttgtcaa

SEQ ID NO: 186722 - DNA, 35 bp, Artificial Sequence
  Synthetic oligonucleotide
gaagctcgctcaccgatatatagccctcctcctaa

SEQ ID NO: 186723 - DNA, 36 bp, Artificial Sequence
  Synthetic oligonucleotide
tccccgcatatccattgtctctcgcgacttccaaca

SEQ ID NO: 186724 - DNA, 36 bp, Artificial Sequence
  Synthetic oligonucleotide
tgcctcctgcagtccattagccgtctctctgccaca

SEQ ID NO: 186725 - DNA, 36 bp, Artificial Sequence
  Synthetic oligonucleotide
tgatgcagtacatcagccgtcgcccgacccttcaca

SEQ ID NO: 186726 - DNA, 36 bp, Artificial Sequence
  Synthetic oligonucleotide
acccatgctcccgacgggttctctacatattctaca

SEQ ID NO: 186727 - DNA, 36 bp, Artificial Sequence
  Synthetic oligonucleotide
atgcatctaccgtgattattcaccaccccctgtaca

SEQ ID NO: 186728 - DNA, 36 bp, Artificial Sequence
  Synthetic oligonucleotide
aagtatgctgcatctccccgtctcatttccgtgcca

SEQ ID NO: 186729 - DNA, 35 bp, Artificial Sequence
  Synthetic oligonucleotide
acccacatagtttgtagctgcattctctcgttcca

SEQ ID NO: 186730 - DNA, 35 bp, Artificial Sequence
  Synthetic oligonucleotide
gtccaccctcaaaaagttcaagccgatatgccgca

SEQ ID NO: 186731 - DNA, 35 bp, Artificial Sequence
  Synthetic oligonucleotide
agagaggggggctaactggaggcaagtgaaaggca

SEQ ID NO: 186732 - DNA, 36 bp, Artificial Sequence
  Synthetic oligonucleotide
gagaaagggcggaggaaataaaagagatgcggggca

SEQ ID NO: 186733 - DNA, 35 bp, Artificial Sequence
  Synthetic oligonucleotide
tttacatgacggaagggcgcggacgacggggggca

SEQ ID NO: 186734 - DNA, 35 bp, Artificial Sequence
  Synthetic oligonucleotide
gtctacatcactcgtacgttgcgccttaccttgca

SEQ ID NO: 186735 - DNA, 35 bp, Artificial Sequence
  Synthetic oligonucleotide
gccccccctctctgctttgtctggggctgtactca

SEQ ID NO: 186736 - DNA, 36 bp, Artificial Sequence
  Synthetic oligonucleotide
tgcactgcttagtcttccgagccactcgccccctca

SEQ ID NO: 186737 - DNA, 36 bp, Artificial Sequence
  Synthetic oligonucleotide
atccgctggatcggtccctgttttgtctatgcctca

SEQ ID NO: 186738 - DNA, 36 bp, Artificial Sequence
  Synthetic oligonucleotide
actccgaccaagtgctaccttacggccctattctca

SEQ ID NO: 186739 - DNA, 36 bp, Artificial Sequence
  Synthetic oligonucleotide
tacgctcgactctagcaattgtcttcctgcccttca

SEQ ID NO: 186740 - DNA, 35 bp, Artificial Sequence
  Synthetic oligonucleotide
gccttctgccccatccgcattcccgacctgtttca

SEQ ID NO: 186741 - DNA, 37 bp, Artificial Sequence
  Synthetic oligonucleotide
gaggaacgaggggaagaagggtgaggaacgggaaaga

SEQ ID NO: 186742 - DNA, 37 bp, Artificial Sequence
  Synthetic oligonucleotide
ggagggggggtgggaaagcggggtggcgtaatcaaga

SEQ ID NO: 186743 - DNA, 37 bp, Artificial Sequence
  Synthetic oligonucleotide
tgtgacaggggggcgagggcgggagaaactctagaga

SEQ ID NO: 186744 - DNA, 37 bp, Artificial Sequence
  Synthetic oligonucleotide
aaagggggggagggtagggtgtcccgagcgatttaga

SEQ ID NO: 186745 - DNA, 37 bp, Artificial Sequence
  Synthetic oligonucleotide
accactcctccgccgtttgtcccctccttagaaacga

SEQ ID NO: 186746 - DNA, 35 bp, Artificial Sequence
  Synthetic oligonucleotide
tccaccttgcctcacacttcctcagatttcgacga

SEQ ID NO: 186747 - DNA, 36 bp, Artificial Sequence
  Synthetic oligonucleotide
gcacgctccacgatctgatctaccatctcattacga

SEQ ID NO: 186748 - DNA, 37 bp, Artificial Sequence
  Synthetic oligonucleotide
gcacccgtgaactgattgatcgcgccaccccacccga

SEQ ID NO: 186749 - DNA, 37 bp, Artificial Sequence
  Synthetic oligonucleotide
ttctgcgcaaaccgaactgctccgtactagcccccga

SEQ ID NO: 186750 - DNA, 37 bp, Artificial Sequence
  Synthetic oligonucleotide
tcatgaccgtcatcccgctaccccgctgttgccccga

SEQ ID NO: 186751 - DNA, 37 bp, Artificial Sequence
  Synthetic oligonucleotide
acacctcgcataatctgttttttgaacgcccgcccga

SEQ ID NO: 186752 - DNA, 37 bp, Artificial Sequence
  Synthetic oligonucleotide
aaccagaccccgcgattcgttttctcgtctcttccga

SEQ ID NO: 186753 - DNA, 37 bp, Artificial Sequence
  Synthetic oligonucleotide
gacgtcacagttaaagctcccaccctcgtttttccga

SEQ ID NO: 186754 - DNA, 37 bp, Artificial Sequence
  Synthetic oligonucleotide
agagaagggggggaggtgatacggaaaggggtatcga

SEQ ID NO: 186755 - DNA, 36 bp, Artificial Sequence
  Synthetic oligonucleotide
acgtcctgctccgatacacgctgtccatactctcga

SEQ ID NO: 186756 - DNA, 37 bp, Artificial Sequence
  Synthetic oligonucleotide
acgagcccatgtctgccattgaaaacgcctctctcga

SEQ ID NO: 186757 - DNA, 37 bp, Artificial Sequence
  Synthetic oligonucleotide
gtgacaggtcctgggctcccgaaactccccttctcga

SEQ ID NO: 186758 - DNA, 37 bp, Artificial Sequence
  Synthetic oligonucleotide
acttgcatcccccgccaccatctacaggccgtaagga

SEQ ID NO: 186759 - DNA, 37 bp, Artificial Sequence
  Synthetic oligonucleotide
gagcggtcaggtgggaaagacgggaagggcgggagga

SEQ ID NO: 186760 - DNA, 36 bp, Artificial Sequence
  Synthetic oligonucleotide
acatcaccggtcatatctttcggtgccttccccgga

SEQ ID NO: 186761 - DNA, 37 bp, Artificial Sequence
  Synthetic oligonucleotide
ttcccacctcatgttcagtttgaacgcccccccggga

SEQ ID NO: 186762 - DNA, 37 bp, Artificial Sequence
  Synthetic oligonucleotide
gcaaaaatcagatcggtggggctagggtgagggggga

SEQ ID NO: 186763 - DNA, 36 bp, Artificial Sequence
  Synthetic oligonucleotide
tcacggcaaaggaatcgaaaggaaagggtgggggga

SEQ ID NO: 186764 - DNA, 35 bp, Artificial Sequence
  Synthetic oligonucleotide
gatggggcttcgggaagcaggacgggtggtgggga

SEQ ID NO: 186765 - DNA, 37 bp, Artificial Sequence
  Synthetic oligonucleotide
tcaacttaccgccgccctatcttgtttcatccatgga

SEQ ID NO: 186766 - DNA, 37 bp, Artificial Sequence
  Synthetic oligonucleotide
tcagcgccttgttggttcgtcccctctctcttgctga

SEQ ID NO: 186767 - DNA, 36 bp, Artificial Sequence
  Synthetic oligonucleotide
gacctcccctcgtatcgccaacagacaaatgtctga

SEQ ID NO: 186768 - DNA, 35 bp, Artificial Sequence
  Synthetic oligonucleotide
tgacctatgtccctgcgaccgccgttcccttctga

SEQ ID NO: 186769 - DNA, 37 bp, Artificial Sequence
  Synthetic oligonucleotide
tcaaaagcgtgggaggacaagtggaggggcgaagtga

SEQ ID NO: 186770 - DNA, 37 bp, Artificial Sequence
  Synthetic oligonucleotide
gactgccctgccgctgttaaccccctataacccgtga

SEQ ID NO: 186771 - DNA, 38 bp, Artificial Sequence
  Synthetic oligonucleotide
ggtcgccatcgagtcatccagcccgtcccctcctgtga

SEQ ID NO: 186772 - DNA, 37 bp, Artificial Sequence
  Synthetic oligonucleotide
aaccccgccttttgttaactcaccttcgactctgtga

SEQ ID NO: 186773 - DNA, 38 bp, Artificial Sequence
  Synthetic oligonucleotide
gcgggacggggaggggatgggaagtaaacctggattga

SEQ ID NO: 186774 - DNA, 38 bp, Artificial Sequence
  Synthetic oligonucleotide
tccatccagcgctttgctactagccgccccttacttga

SEQ ID NO: 186775 - DNA, 38 bp, Artificial Sequence
  Synthetic oligonucleotide
tcacgaagcagggatcgaccccgtcccaacacccttga

SEQ ID NO: 186776 - DNA, 38 bp, Artificial Sequence
  Synthetic oligonucleotide
gtccacctcctatctgtcattcacgcggcagtccttga

SEQ ID NO: 186777 - DNA, 37 bp, Artificial Sequence
  Synthetic oligonucleotide
gatgggcgggtaagggaggagcaggacagtgagttga

SEQ ID NO: 186778 - DNA, 38 bp, Artificial Sequence
  Synthetic oligonucleotide
gtaccgccctcccccgcttgagggacagtcgtagttga

SEQ ID NO: 186779 - DNA, 38 bp, Artificial Sequence
  Synthetic oligonucleotide
tcccatgccccgatccttcatacgacacctgaatttga

SEQ ID NO: 186780 - DNA, 36 bp, Artificial Sequence
  Synthetic oligonucleotide
gtcgtgcatccgcccggcgttttattcaccacacta

SEQ ID NO: 186781 - DNA, 35 bp, Artificial Sequence
  Synthetic oligonucleotide
gcatgcctctagtcatttctgtccgtctgctacta

SEQ ID NO: 186782 - DNA, 36 bp, Artificial Sequence
  Synthetic oligonucleotide
tgcaccgactgccgccccgtgccatttatcaatcta

SEQ ID NO: 186783 - DNA, 35 bp, Artificial Sequence
  Synthetic oligonucleotide
gtatcaccacgcatggccggaccttcatttatcta

SEQ ID NO: 186784 - DNA, 36 bp, Artificial Sequence
  Synthetic oligonucleotide
gcctcccgccatgctcgaggaccgtttcctactcta

SEQ ID NO: 186785 - DNA, 35 bp, Artificial Sequence
  Synthetic oligonucleotide
gaaacctgacctgcgcaggaccctactcccccgta

SEQ ID NO: 186786 - DNA, 36 bp, Artificial Sequence
  Synthetic oligonucleotide
tccttcaccctgccttgtgaaccatccctatccgta

SEQ ID NO: 186787 - DNA, 36 bp, Artificial Sequence
  Synthetic oligonucleotide
gtagccctccgccacttgtgtcacgttctactcgta

SEQ ID NO: 186788 - DNA, 36 bp, Artificial Sequence
  Synthetic oligonucleotide
taccacaccttccgtagccgtaacagactctcatta

SEQ ID NO: 186789 - DNA, 35 bp, Artificial Sequence
  Synthetic oligonucleotide
ggtcatgtcgccgatcctcccgttacaagccctta

SEQ ID NO: 186790 - DNA, 36 bp, Artificial Sequence
  Synthetic oligonucleotide
tcaatcccacacaagcgtatcgtcgctaccggttta

SEQ ID NO: 186791 - DNA, 36 bp, Artificial Sequence
  Synthetic oligonucleotide
gtcccctgcctccgcttcgatcctttagaagtttta

SEQ ID NO: 186792 - DNA, 35 bp, Artificial Sequence
  Synthetic oligonucleotide
tatgcacctccgaccccccccaagcacggcccaac

SEQ ID NO: 186793 - DNA, 34 bp, Artificial Sequence
  Synthetic oligonucleotide
gtgtgtcgtgtcgccttcgataaatccgctccac

SEQ ID NO: 186794 - DNA, 35 bp, Artificial Sequence
  Synthetic oligonucleotide
gcaatgccctgcgctccgatttatcattccctcac

SEQ ID NO: 186795 - DNA, 35 bp, Artificial Sequence
  Synthetic oligonucleotide
tcacagtgtccgagtctcgccgctgtcctcttcac

SEQ ID NO: 186796 - DNA, 35 bp, Artificial Sequence
  Synthetic oligonucleotide
agggcgggcggacggggctcgtggataggcccgac

SEQ ID NO: 186797 - DNA, 35 bp, Artificial Sequence
  Synthetic oligonucleotide
gcccgcatccgccccgagcctagtcctgtaaatac

SEQ ID NO: 186798 - DNA, 35 bp, Artificial Sequence
  Synthetic oligonucleotide
gtggtcacttactgccatatgattcaccgcatacc

SEQ ID NO: 186799 - DNA, 35 bp, Artificial Sequence
  Synthetic oligonucleotide
gttgccagaagctcctcggaagccagccctttacc

SEQ ID NO: 186800 - DNA, 35 bp, Artificial Sequence
  Synthetic oligonucleotide
ttctaacaccgcatgtctacatcgtacacccaccc

SEQ ID NO: 186801 - DNA, 35 bp, Artificial Sequence
  Synthetic oligonucleotide
gcaccacttacctcagtcaaatttggactcgcccc

SEQ ID NO: 186802 - DNA, 33 bp, Artificial Sequence
  Synthetic oligonucleotide
tctacctgcctctttacatagctcattcggccc

SEQ ID NO: 186803 - DNA, 35 bp, Artificial Sequence
  Synthetic oligonucleotide
gcttacacaccgcgcgtgcctaccttgttctggcc

SEQ ID NO: 186804 - DNA, 35 bp, Artificial Sequence
  Synthetic oligonucleotide
gacgccccaccagttctataggtccacacattgcc

SEQ ID NO: 186805 - DNA, 35 bp, Artificial Sequence
  Synthetic oligonucleotide
gaaaccatcggtaccttctgtaacatctccttgcc

SEQ ID NO: 186806 - DNA, 35 bp, Artificial Sequence
  Synthetic oligonucleotide
gctgccaccatcaccgtcctcaatctcgagcatcc

SEQ ID NO: 186807 - DNA, 35 bp, Artificial Sequence
  Synthetic oligonucleotide
gtgaacgtcgatcgtttgtcttatgccctctatcc

SEQ ID NO: 186808 - DNA, 35 bp, Artificial Sequence
  Synthetic oligonucleotide
ttagacgcgccacatacacatttcgtcacccgtcc

SEQ ID NO: 186809 - DNA, 35 bp, Artificial Sequence
  Synthetic oligonucleotide
acatccgctcatcccggcgaaccatggcttttagc

SEQ ID NO: 186810 - DNA, 35 bp, Artificial Sequence
  Synthetic oligonucleotide
tagcactgggcatatatcgccgcccgactccttgc

SEQ ID NO: 186811 - DNA, 35 bp, Artificial Sequence
  Synthetic oligonucleotide
gtgcgtcgccgttctcgccctatctggttgaaatc

SEQ ID NO: 186812 - DNA, 35 bp, Artificial Sequence
  Synthetic oligonucleotide
atgtcagctttagcctctgtcctcgtttgtacctc

SEQ ID NO: 186813 - DNA, 35 bp, Artificial Sequence
  Synthetic oligonucleotide
gatccgctcacttcatcgtcacattatcgttcctc

SEQ ID NO: 186814 - DNA, 35 bp, Artificial Sequence
  Synthetic oligonucleotide
gagactggccacaccgctatgcatgagctaccttc

SEQ ID NO: 186815 - DNA, 35 bp, Artificial Sequence
  Synthetic oligonucleotide
gcctgcgcggtcttttagctactcccacgttcttc

SEQ ID NO: 186816 - DNA, 35 bp, Artificial Sequence
  Synthetic oligonucleotide
tccatccatcccataggcgcgaacccacgaagttc

SEQ ID NO: 186817 - DNA, 35 bp, Artificial Sequence
  Synthetic oligonucleotide
actacagggtcgatcctaccgcttcgtgccctttc

SEQ ID NO: 186818 - DNA, 35 bp, Artificial Sequence
  Synthetic oligonucleotide
tatcgcatgtctgccccccacaccagccgcctttc

SEQ ID NO: 186819 - DNA, 35 bp, Artificial Sequence
  Synthetic oligonucleotide
agtgtggctaccagacggtcgcctctccatctttc

SEQ ID NO: 186820 - DNA, 35 bp, Artificial Sequence
  Synthetic oligonucleotide
atcgctcaccgatcattccttccctcctcggtacg

SEQ ID NO: 186821 - DNA, 34 bp, Artificial Sequence
  Synthetic oligonucleotide
acgcgatggccacacagcgccccccccgctcccg

SEQ ID NO: 186822 - DNA, 35 bp, Artificial Sequence
  Synthetic oligonucleotide
aacgcacccccactgttgataccgttcttctctcg

SEQ ID NO: 186823 - DNA, 35 bp, Artificial Sequence
  Synthetic oligonucleotide
attcctcgaccccatgcctttttcctcgtgagagg

SEQ ID NO: 186824 - DNA, 35 bp, Artificial Sequence
  Synthetic oligonucleotide
tatcacgtacaggattgaagatagcgggggggagg

SEQ ID NO: 186825 - DNA, 35 bp, Artificial Sequence
  Synthetic oligonucleotide
gatctcggtcaactgcttatccccccgcacttagg

SEQ ID NO: 186826 - DNA, 35 bp, Artificial Sequence
  Synthetic oligonucleotide
gagccccatcgcacatttccgcaaacagctagtgg

SEQ ID NO: 186827 - DNA, 35 bp, Artificial Sequence
  Synthetic oligonucleotide
gggtgaacacgaagtatggagggaggtagaggtgg

SEQ ID NO: 186828 - DNA, 35 bp, Artificial Sequence
  Synthetic oligonucleotide
gccaccgtttcgggcttctgcacacttccccttgg

SEQ ID NO: 186829 - DNA, 35 bp, Artificial Sequence
  Synthetic oligonucleotide
tcccctgtcgctatctcggttcgtacctctcttgg

SEQ ID NO: 186830 - DNA, 35 bp, Artificial Sequence
  Synthetic oligonucleotide
gtacggtcacgaggagaagcgggaggtaagggatg

SEQ ID NO: 186831 - DNA, 35 bp, Artificial Sequence
  Synthetic oligonucleotide
acacacggtcccctgatacattcccgttcagcctg

SEQ ID NO: 186832 - DNA, 35 bp, Artificial Sequence
  Synthetic oligonucleotide
tgcaccaccgtatttccagcccatctcccgtagtg

SEQ ID NO: 186833 - DNA, 35 bp, Artificial Sequence
  Synthetic oligonucleotide
tccgcgttgatctgatccctgcctttccttgcgtg

SEQ ID NO: 186834 - DNA, 35 bp, Artificial Sequence
  Synthetic oligonucleotide
tcatcatctactgccccttattccatccattggtg

SEQ ID NO: 186835 - DNA, 35 bp, Artificial Sequence
  Synthetic oligonucleotide
tacacgggcacaccccattacacctggctctattg

SEQ ID NO: 186836 - DNA, 35 bp, Artificial Sequence
  Synthetic oligonucleotide
agatgcaccttaggtctgccttcgctcctgccttg

SEQ ID NO: 186837 - DNA, 35 bp, Artificial Sequence
  Synthetic oligonucleotide
acacaccacccaacatgttcgccgttccgctcttg

SEQ ID NO: 186838 - DNA, 35 bp, Artificial Sequence
  Synthetic oligonucleotide
atttgcgtatgtgctgatccccgatgtcccctttg

SEQ ID NO: 186839 - DNA, 35 bp, Artificial Sequence
  Synthetic oligonucleotide
acgttacccatcctgctcccacacgactactgaat

SEQ ID NO: 186840 - DNA, 35 bp, Artificial Sequence
  Synthetic oligonucleotide
tgtcgtgtgtccccgctttgtccctagtctaccat

SEQ ID NO: 186841 - DNA, 35 bp, Artificial Sequence
  Synthetic oligonucleotide
tcacggaactgcctgcctgccatcgccccatccat

SEQ ID NO: 186842 - DNA, 35 bp, Artificial Sequence
  Synthetic oligonucleotide
tggtcatggcgggggggggggcggaggtaacctat

SEQ ID NO: 186843 - DNA, 35 bp, Artificial Sequence
  Synthetic oligonucleotide
ctgtctaccgccgttccttgcacaacataatttat

SEQ ID NO: 186844 - DNA, 35 bp, Artificial Sequence
  Synthetic oligonucleotide
ttctgctggctcccttttgctgatctgccatacct

SEQ ID NO: 186845 - DNA, 35 bp, Artificial Sequence
  Synthetic oligonucleotide
actccgggctctcgggcaccatcggacttctacct

SEQ ID NO: 186846 - DNA, 35 bp, Artificial Sequence
  Synthetic oligonucleotide
atctcccccgggtatgcgtccatcgtggcgtccct

SEQ ID NO: 186847 - DNA, 35 bp, Artificial Sequence
  Synthetic oligonucleotide
gaagactgtcccggcctatgttatctgcccttcct

SEQ ID NO: 186848 - DNA, 35 bp, Artificial Sequence
  Synthetic oligonucleotide
taacagcacgcgcaagcggcgcccacatcccatct

SEQ ID NO: 186849 - DNA, 35 bp, Artificial Sequence
  Synthetic oligonucleotide
acaccctcgccacttacgcttcttgagaccattct

SEQ ID NO: 186850 - DNA, 35 bp, Artificial Sequence
  Synthetic oligonucleotide
gagagcaatgagaggggtgagcggtgcaagcgcgt

SEQ ID NO: 186851 - DNA, 35 bp, Artificial Sequence
  Synthetic oligonucleotide
acacctccgaacagccgctccgttaaccaatgctt

SEQ ID NO: 186852 - DNA, 35 bp, Artificial Sequence
  Synthetic oligonucleotide
tcagtgaaacgggggggtgggaatgaacggcagtt

SEQ ID NO: 186853 - DNA, 35 bp, Artificial Sequence
  Synthetic oligonucleotide
agtctccccacctgagtttcccgccacacatggtt

SEQ ID NO: 186854 - DNA, 35 bp, Artificial Sequence
  Synthetic oligonucleotide
tcaccatgcccccttcggttctcgccctacatgtt

SEQ ID NO: 186855 - DNA, 36 bp, Artificial Sequence
  Synthetic oligonucleotide
agttactgcagcacgtctcgctccgtcattctacaa

SEQ ID NO: 186856 - DNA, 35 bp, Artificial Sequence
  Synthetic oligonucleotide
ggggacaagtggaatcgggggaaaagcgggcgcaa

SEQ ID NO: 186857 - DNA, 37 bp, Artificial Sequence
  Synthetic oligonucleotide
ggtggaatgccgggaaggagaatgggggttgggcgaa

SEQ ID NO: 186858 - DNA, 36 bp, Artificial Sequence
  Synthetic oligonucleotide
aacgagagggggatagggaagagggaggggagaaca

SEQ ID NO: 186859 - DNA, 35 bp, Artificial Sequence
  Synthetic oligonucleotide
gtgaggggggggaggtgtcaccaggcaaatgcaca

SEQ ID NO: 186860 - DNA, 36 bp, Artificial Sequence
  Synthetic oligonucleotide
ggataagggggggggcatatggaagtggggtctaca

SEQ ID NO: 186861 - DNA, 36 bp, Artificial Sequence
  Synthetic oligonucleotide
gaccgattccccccctgtcctagttgtagtggtaca

SEQ ID NO: 186862 - DNA, 35 bp, Artificial Sequence
  Synthetic oligonucleotide
atgctgtcacaccctgcctccgatcacgaatacca

SEQ ID NO: 186863 - DNA, 36 bp, Artificial Sequence
  Synthetic oligonucleotide
ggacacgtcgaggccctcgtctcatccttaccccca

SEQ ID NO: 186864 - DNA, 36 bp, Artificial Sequence
  Synthetic oligonucleotide
ccccgaccgccgcagccatctgtactgcgccctcca

SEQ ID NO: 186865 - DNA, 36 bp, Artificial Sequence
  Synthetic oligonucleotide
ttcatcccatccgatcactcgtctttctgccctgca

SEQ ID NO: 186866 - DNA, 36 bp, Artificial Sequence
  Synthetic oligonucleotide
atcatcgccctccgctcctacgcaattacccgtgca

SEQ ID NO: 186867 - DNA, 36 bp, Artificial Sequence
  Synthetic oligonucleotide
tccgcccattgtactttcgattcgtctctacttgca

SEQ ID NO: 186868 - DNA, 35 bp, Artificial Sequence
  Synthetic oligonucleotide
acaccccaggttatcgaagaccatcccgctcatca

SEQ ID NO: 186869 - DNA, 36 bp, Artificial Sequence
  Synthetic oligonucleotide
acttcccgtcagcacctaacgccctgtaatacctca

SEQ ID NO: 186870 - DNA, 37 bp, Artificial Sequence
  Synthetic oligonucleotide
tcgaggggggggtggggtgtaacgtacgcaagggtca

SEQ ID NO: 186871 - DNA, 36 bp, Artificial Sequence
  Synthetic oligonucleotide
ttcacgctcacgatctgcgcgctcccttctgtttca

SEQ ID NO: 186872 - DNA, 35 bp, Artificial Sequence
  Synthetic oligonucleotide
gagggcccaggggtggaaaggggaggctgatcaga

SEQ ID NO: 186873 - DNA, 37 bp, Artificial Sequence
  Synthetic oligonucleotide
tcagagggagggcgggcgagggggagtggtgcagaga

SEQ ID NO: 186874 - DNA, 37 bp, Artificial Sequence
  Synthetic oligonucleotide
ggggggggagggaagaagttcgccggagagagagaga

SEQ ID NO: 186875 - DNA, 36 bp, Artificial Sequence
  Synthetic oligonucleotide
acatccgcccccttgtgccctggaacgtctctgaga

SEQ ID NO: 186876 - DNA, 37 bp, Artificial Sequence
  Synthetic oligonucleotide
agacaggagtgtggaggcggggaggtggcacgttaga

SEQ ID NO: 186877 - DNA, 37 bp, Artificial Sequence
  Synthetic oligonucleotide
agttcccactgcctccgacccctcgtgatccccacga

SEQ ID NO: 186878 - DNA, 37 bp, Artificial Sequence
  Synthetic oligonucleotide
gctgccccccgaatcttgtctccgccatctctgacga

SEQ ID NO: 186879 - DNA, 37 bp, Artificial Sequence
  Synthetic oligonucleotide
acccgcatccaacatgctgccctatattctgctacga

SEQ ID NO: 186880 - DNA, 37 bp, Artificial Sequence
  Synthetic oligonucleotide
tggaccacccgcctcatgctccaaagataattcccga

SEQ ID NO: 186881 - DNA, 36 bp, Artificial Sequence
  Synthetic oligonucleotide
gttgcccacctgcttcgctacagagctcctacgcga

SEQ ID NO: 186882 - DNA, 37 bp, Artificial Sequence
  Synthetic oligonucleotide
acggggaaagaggagggaattaaggggaagaaggcga

SEQ ID NO: 186883 - DNA, 35 bp, Artificial Sequence
  Synthetic oligonucleotide
tccaacctcgctattctcgcccctccctgaatcga

SEQ ID NO: 186884 - DNA, 37 bp, Artificial Sequence
  Synthetic oligonucleotide
tctatcagccccccgtgctatcaatctgccacatcga

SEQ ID NO: 186885 - DNA, 37 bp, Artificial Sequence
  Synthetic oligonucleotide
gtggtgagatacctaaggaggggggggagggcaagga

SEQ ID NO: 186886 - DNA, 37 bp, Artificial Sequence
  Synthetic oligonucleotide
gtgaggacaacaaaagggcacaggaggtagtgaagga

SEQ ID NO: 186887 - DNA, 37 bp, Artificial Sequence
  Synthetic oligonucleotide
gtccgcaaatccgggggtggagagggatggaacagga

SEQ ID NO: 186888 - DNA, 37 bp, Artificial Sequence
  Synthetic oligonucleotide
aacagtggggcggaaactgggtgggaaccatggagga

SEQ ID NO: 186889 - DNA, 37 bp, Artificial Sequence
  Synthetic oligonucleotide
ttgcgcccagcttctcgacctcgtatctcccgccgga

SEQ ID NO: 186890 - DNA, 36 bp, Artificial Sequence
  Synthetic oligonucleotide
tcgaggtggagggaattatggggtcgggaataggga

SEQ ID NO: 186891 - DNA, 35 bp, Artificial Sequence
  Synthetic oligonucleotide
gcacgtgcctgcagaaaggtgggaaggggtaggga

SEQ ID NO: 186892 - DNA, 37 bp, Artificial Sequence
  Synthetic oligonucleotide
gaagtggggtgtgggggagttggacctggtcacggga

SEQ ID NO: 186893 - DNA, 36 bp, Artificial Sequence
  Synthetic oligonucleotide
gttccaccgcccggttttcgtttgtcccatagggga

SEQ ID NO: 186894 - DNA, 37 bp, Artificial Sequence
  Synthetic oligonucleotide
agtgaggtaacgtaggtaggggccggaaaggggtgga

SEQ ID NO: 186895 - DNA, 37 bp, Artificial Sequence
  Synthetic oligonucleotide
tcgaagggtcgtacggtgagggggtgggaacgttgga

SEQ ID NO: 186896 - DNA, 38 bp, Artificial Sequence
  Synthetic oligonucleotide
tagaaagggggagatgggaaacgcgtgaagtgacatga

SEQ ID NO: 186897 - DNA, 38 bp, Artificial Sequence
  Synthetic oligonucleotide
gcacgctgcggggggagggaagtgaacggaggggatga

SEQ ID NO: 186898 - DNA, 38 bp, Artificial Sequence
  Synthetic oligonucleotide
gcacgtgaaggcgggagggagaaaactcggtgggatga

SEQ ID NO: 186899 - DNA, 35 bp, Artificial Sequence
  Synthetic oligonucleotide
ttcagacctcgcctcccacttagtttaccgactga

SEQ ID NO: 186900 - DNA, 37 bp, Artificial Sequence
  Synthetic oligonucleotide
gctatacgcctttgttctaccacgtactctcccctga

SEQ ID NO: 186901 - DNA, 37 bp, Artificial Sequence
  Synthetic oligonucleotide
taaggtgggggggggagatttaggccggacggcctga

SEQ ID NO: 186902 - DNA, 38 bp, Artificial Sequence
  Synthetic oligonucleotide
tgtgcacaccaacttggtaacccgcctcactttcctga

SEQ ID NO: 186903 - DNA, 38 bp, Artificial Sequence
  Synthetic oligonucleotide
gggggcagaaacggcgggggacaaaaagggtaggctga

SEQ ID NO: 186904 - DNA, 38 bp, Artificial Sequence
  Synthetic oligonucleotide
tcaagagaagtgtaggggagggagggactaagggctga

SEQ ID NO: 186905 - DNA, 37 bp, Artificial Sequence
  Synthetic oligonucleotide
gttgttgtccccgccgttacgccctgtcggtttctga

SEQ ID NO: 186906 - DNA, 36 bp, Artificial Sequence
  Synthetic oligonucleotide
tcttgcctctagctattccgccttcctactccgtga

SEQ ID NO: 186907 - DNA, 38 bp, Artificial Sequence
  Synthetic oligonucleotide
tgacgccacatgatttcaccgtatcacccttccgttga

SEQ ID NO: 186908 - DNA, 36 bp, Artificial Sequence
  Synthetic oligonucleotide
tccgagcgggaggaccaagagaagggctacagtata

SEQ ID NO: 186909 - DNA, 36 bp, Artificial Sequence
  Synthetic oligonucleotide
tccgaccgaccacaatgataatgtctgccttcccta

SEQ ID NO: 186910 - DNA, 35 bp, Artificial Sequence
  Synthetic oligonucleotide
acgcgcgcatcgcgaattgctctatttcccctcta

SEQ ID NO: 186911 - DNA, 36 bp, Artificial Sequence
  Synthetic oligonucleotide
gcacgggaaggtagggaggggcacaaaatgacggta

SEQ ID NO: 186912 - DNA, 34 bp, Artificial Sequence
  Synthetic oligonucleotide
tatgctcgcaccatgcttttcccccgttcgggta

SEQ ID NO: 186913 - DNA, 36 bp, Artificial Sequence
  Synthetic oligonucleotide
gtcactcgccattctgcaccgcagccacttctggta

SEQ ID NO: 186914 - DNA, 36 bp, Artificial Sequence
  Synthetic oligonucleotide
ttccctcgcccggtgctcctaacgctcgaatcatta

SEQ ID NO: 186915 - DNA, 36 bp, Artificial Sequence
  Synthetic oligonucleotide
aaggggatgacggcacgaggggcggggagaggatta

SEQ ID NO: 186916 - DNA, 35 bp, Artificial Sequence
  Synthetic oligonucleotide
acatccgccagacagggcgctccacgttttcttta

SEQ ID NO: 186917 - DNA, 35 bp, Artificial Sequence
  Synthetic oligonucleotide
acgccacgctgcccaatgtgcgtccatcttcacac

SEQ ID NO: 186918 - DNA, 35 bp, Artificial Sequence
  Synthetic oligonucleotide
atgtcactccctgcccttatattgcaccaagccac

SEQ ID NO: 186919 - DNA, 35 bp, Artificial Sequence
  Synthetic oligonucleotide
agcaagcctcaattattaacccagtttcgctccac

SEQ ID NO: 186920 - DNA, 35 bp, Artificial Sequence
  Synthetic oligonucleotide
gcctgcacgcccgccctgatattaaccgatcgcac

SEQ ID NO: 186921 - DNA, 35 bp, Artificial Sequence
  Synthetic oligonucleotide
tctccccgttccgtcgcatccgccatgatttgcac

SEQ ID NO: 186922 - DNA, 35 bp, Artificial Sequence
  Synthetic oligonucleotide
tcccgcacgtgattattaccgttccacccagtcac

SEQ ID NO: 186923 - DNA, 35 bp, Artificial Sequence
  Synthetic oligonucleotide
gtgcgcatggttgtggttaatttcgctcccttcac

SEQ ID NO: 186924 - DNA, 35 bp, Artificial Sequence
  Synthetic oligonucleotide
tacacctactgtcgctgaaagtgacacctctggac

SEQ ID NO: 186925 - DNA, 35 bp, Artificial Sequence
  Synthetic oligonucleotide
gccaactgcaatttcggttccactgggccacctac

SEQ ID NO: 186926 - DNA, 35 bp, Artificial Sequence
  Synthetic oligonucleotide
aatctgcggcccccgacttcccgttatagtcctac

SEQ ID NO: 186927 - DNA, 35 bp, Artificial Sequence
  Synthetic oligonucleotide
gagggaggaacggggcaatcggaagaaggcgttac

SEQ ID NO: 186928 - DNA, 35 bp, Artificial Sequence
  Synthetic oligonucleotide
taacgcaccgactaccctattaccagcgctccacc

SEQ ID NO: 186929 - DNA, 35 bp, Artificial Sequence
  Synthetic oligonucleotide
gtggggcctcgcatcaacaccctccttatcgcacc

SEQ ID NO: 186930 - DNA, 35 bp, Artificial Sequence
  Synthetic oligonucleotide
atcgccacggcccgctatttgcgacctttttcacc

SEQ ID NO: 186931 - DNA, 35 bp, Artificial Sequence
  Synthetic oligonucleotide
tgtgcggccgccgccacttttgacgtcttgttacc

SEQ ID NO: 186932 - DNA, 35 bp, Artificial Sequence
  Synthetic oligonucleotide
atcgaaggcgatgaccagttgccctacacctcccc

SEQ ID NO: 186933 - DNA, 35 bp, Artificial Sequence
  Synthetic oligonucleotide
aacatccgcttcatatttcctcttcgtgcctgccc

SEQ ID NO: 186934 - DNA, 35 bp, Artificial Sequence
  Synthetic oligonucleotide
gccgccgtggttcaccagccccttgacccttgccc

SEQ ID NO: 186935 - DNA, 35 bp, Artificial Sequence
  Synthetic oligonucleotide
agggagtgcacggtaatttagtcgttcctgctccc

SEQ ID NO: 186936 - DNA, 35 bp, Artificial Sequence
  Synthetic oligonucleotide
tacataagtcgcgaccgccttgttcacgttctccc

SEQ ID NO: 186937 - DNA, 36 bp, Artificial Sequence
  Synthetic oligonucleotide
tgcacattcctcgtctgcacagtcgtcactctcgcc

SEQ ID NO: 186938 - DNA, 35 bp, Artificial Sequence
  Synthetic oligonucleotide
tgatttcctcacgctcccgtttccggctccaggcc

SEQ ID NO: 186939 - DNA, 34 bp, Artificial Sequence
  Synthetic oligonucleotide
actcgtgcaccgatttttacctgtcccctctgcc

SEQ ID NO: 186940 - DNA, 35 bp, Artificial Sequence
  Synthetic oligonucleotide
ggtaccgcccagctcctttgccgtgcttataatcc

SEQ ID NO: 186941 - DNA, 35 bp, Artificial Sequence
  Synthetic oligonucleotide
gcgtgtaggtccgtggtgcgcgtacatctccctcc

SEQ ID NO: 186942 - DNA, 35 bp, Artificial Sequence
  Synthetic oligonucleotide
tcagtccgcccagaatccagttcgtttattcctcc

SEQ ID NO: 186943 - DNA, 35 bp, Artificial Sequence
  Synthetic oligonucleotide
acgctcatccgcctcctaaaccagaacactgctcc

SEQ ID NO: 186944 - DNA, 35 bp, Artificial Sequence
  Synthetic oligonucleotide
gatgtccggtcccctgagctttaatgttccattcc

SEQ ID NO: 186945 - DNA, 35 bp, Artificial Sequence
  Synthetic oligonucleotide
tactcccccctcctggtgactaatgctagctttcc

SEQ ID NO: 186946 - DNA, 35 bp, Artificial Sequence
  Synthetic oligonucleotide
tacgttcatcgctccccagccctagtctttcaagc

SEQ ID NO: 186947 - DNA, 35 bp, Artificial Sequence
  Synthetic oligonucleotide
tgacgaatcctccgacttacttgtgaccttcacgc

SEQ ID NO: 186948 - DNA, 35 bp, Artificial Sequence
  Synthetic oligonucleotide
ttccgtcgtcaaccacccgcggtcactgcccccgc

SEQ ID NO: 186949 - DNA, 35 bp, Artificial Sequence
  Synthetic oligonucleotide
tcggacgagcctccgatatcttcacctctcctcgc

SEQ ID NO: 186950 - DNA, 34 bp, Artificial Sequence
  Synthetic oligonucleotide
gtagtagtcacgtccatcgattatctgtcctcgc

SEQ ID NO: 186951 - DNA, 35 bp, Artificial Sequence
  Synthetic oligonucleotide
gtcaatcaccagcctgcggtttaggtccacactgc

SEQ ID NO: 186952 - DNA, 36 bp, Artificial Sequence
  Synthetic oligonucleotide
agttccgatcggatccattatgttcctgtctcgtgc

SEQ ID NO: 186953 - DNA, 35 bp, Artificial Sequence
  Synthetic oligonucleotide
gcctggttccgccggttccttgttttacttattgc

SEQ ID NO: 186954 - DNA, 35 bp, Artificial Sequence
  Synthetic oligonucleotide
gtggacggcgctaatggtcctactttactcccatc

SEQ ID NO: 186955 - DNA, 35 bp, Artificial Sequence
  Synthetic oligonucleotide
acgccctccgcattatggcgttcgacctccctatc

SEQ ID NO: 186956 - DNA, 35 bp, Artificial Sequence
  Synthetic oligonucleotide
atgttgccggccgttgcgccagtcccctctaactc

SEQ ID NO: 186957 - DNA, 35 bp, Artificial Sequence
  Synthetic oligonucleotide
gccaccgcccgacggattgctcacctacttacctc

SEQ ID NO: 186958 - DNA, 36 bp, Artificial Sequence
  Synthetic oligonucleotide
accgtattgcccctcgtctgttcaagacttaccctc

SEQ ID NO: 186959 - DNA, 35 bp, Artificial Sequence
  Synthetic oligonucleotide
gcgcgggtacgcgggcgccctttcgactacatctc

SEQ ID NO: 186960 - DNA, 35 bp, Artificial Sequence
  Synthetic oligonucleotide
acccattactccgcgtgcacacagccctgtttctc

SEQ ID NO: 186961 - DNA, 35 bp, Artificial Sequence
  Synthetic oligonucleotide
gccaggccgaagccatgtctactttaccccacgtc

SEQ ID NO: 186962 - DNA, 34 bp, Artificial Sequence
  Synthetic oligonucleotide
gaagccaacacgtctcacttgcccgccggacttc

SEQ ID NO: 186963 - DNA, 35 bp, Artificial Sequence
  Synthetic oligonucleotide
atgtgcccgaactcgtttcgtctgttaccgccttc

SEQ ID NO: 186964 - DNA, 35 bp, Artificial Sequence
  Synthetic oligonucleotide
gtgagcccgtttctttacaacagcgttgctccttc

SEQ ID NO: 186965 - DNA, 35 bp, Artificial Sequence
  Synthetic oligonucleotide
gggcgtccctccccgcatcgtagcctggctctttc

SEQ ID NO: 186966 - DNA, 35 bp, Artificial Sequence
  Synthetic oligonucleotide
aaatccatcacgcccgcatgccaggtctacttttc

SEQ ID NO: 186967 - DNA, 35 bp, Artificial Sequence
  Synthetic oligonucleotide
gttaatggggggggcattagagacaggggcaggag

SEQ ID NO: 186968 - DNA, 35 bp, Artificial Sequence
  Synthetic oligonucleotide
agatgcgtaagtggacaacggagcagggggggtag

SEQ ID NO: 186969 - DNA, 35 bp, Artificial Sequence
  Synthetic oligonucleotide
agtacccgtccctccgaatgtgtcctgctaccgcg

SEQ ID NO: 186970 - DNA, 34 bp, Artificial Sequence
  Synthetic oligonucleotide
gtagggaaggggggggtcgacgcggaatcgaagg

SEQ ID NO: 186971 - DNA, 35 bp, Artificial Sequence
  Synthetic oligonucleotide
tacgtaagcaaggcaggagggtggtgaagggaggg

SEQ ID NO: 186972 - DNA, 35 bp, Artificial Sequence
  Synthetic oligonucleotide
tcaccctcctgattttcgctcctgacttattttgg

SEQ ID NO: 186973 - DNA, 35 bp, Artificial Sequence
  Synthetic oligonucleotide
tccgcccgcgtgctccttctgtcatattccccctg

SEQ ID NO: 186974 - DNA, 35 bp, Artificial Sequence
  Synthetic oligonucleotide
gcactcacatcaccatccaactttttatttgcctg

SEQ ID NO: 186975 - DNA, 35 bp, Artificial Sequence
  Synthetic oligonucleotide
gttaccctcagcttggccttttcgttcaactgctg

SEQ ID NO: 186976 - DNA, 35 bp, Artificial Sequence
  Synthetic oligonucleotide
ttcgatctctcgctcctgtcgcactctaactattg

SEQ ID NO: 186977 - DNA, 35 bp, Artificial Sequence
  Synthetic oligonucleotide
tttcgtcgatcgtgctctcaccttcacccgtattg

SEQ ID NO: 186978 - DNA, 35 bp, Artificial Sequence
  Synthetic oligonucleotide
ttagcccctcacatatcctgtttctgttctctttg

SEQ ID NO: 186979 - DNA, 35 bp, Artificial Sequence
  Synthetic oligonucleotide
gtccaggcgcatctgtatcagcccgccactaccat

SEQ ID NO: 186980 - DNA, 35 bp, Artificial Sequence
  Synthetic oligonucleotide
gcccatacgcctccttcgtctcgtgcccgttccat

SEQ ID NO: 186981 - DNA, 33 bp, Artificial Sequence
  Synthetic oligonucleotide
tccgcttgccccaaatttccttctcgttcttat

SEQ ID NO: 186982 - DNA, 35 bp, Artificial Sequence
  Synthetic oligonucleotide
aaagacaagcggaaggtggttcgggaagggcaact

SEQ ID NO: 186983 - DNA, 35 bp, Artificial Sequence
  Synthetic oligonucleotide
agccctacccccgagttcttgctgactattgcact

SEQ ID NO: 186984 - DNA, 35 bp, Artificial Sequence
  Synthetic oligonucleotide
ttacacgcacgtttcggcatcactctccgggccct

SEQ ID NO: 186985 - DNA, 35 bp, Artificial Sequence
  Synthetic oligonucleotide
tgccctgtgggaggtaccttctattgtcatgccct

SEQ ID NO: 186986 - DNA, 35 bp, Artificial Sequence
  Synthetic oligonucleotide
taactgagctatgtcacctgcctttcaccttccct

SEQ ID NO: 186987 - DNA, 35 bp, Artificial Sequence
  Synthetic oligonucleotide
tacatcgtaacggcgcccctgtaacgtaaactcct

SEQ ID NO: 186988 - DNA, 35 bp, Artificial Sequence
  Synthetic oligonucleotide
actacacgctcccatctgttgcgctatttcctcct

SEQ ID NO: 186989 - DNA, 34 bp, Artificial Sequence
  Synthetic oligonucleotide
ttgggcccccggttggacaacgctttcatcatct

SEQ ID NO: 186990 - DNA, 35 bp, Artificial Sequence
  Synthetic oligonucleotide
acctaccgtgcccgtgcatcaaatgcttcatctct

SEQ ID NO: 186991 - DNA, 35 bp, Artificial Sequence
  Synthetic oligonucleotide
ttgagctaagctcggacctgttttgctcgttctct

SEQ ID NO: 186992 - DNA, 35 bp, Artificial Sequence
  Synthetic oligonucleotide
tttgccctctcacgttctccctcgtcagatcgtct

SEQ ID NO: 186993 - DNA, 35 bp, Artificial Sequence
  Synthetic oligonucleotide
actccgtcagccgccctctctagattctgttgtct

SEQ ID NO: 186994 - DNA, 35 bp, Artificial Sequence
  Synthetic oligonucleotide
atcgacatcctcacgtctgccattcactgtccagt

SEQ ID NO: 186995 - DNA, 35 bp, Artificial Sequence
  Synthetic oligonucleotide
gtccacgtccttttggcgccacctgtttcgaccgt

SEQ ID NO: 186996 - DNA, 35 bp, Artificial Sequence
  Synthetic oligonucleotide
tccaccacgcccccctttgttctccgttacacggt

SEQ ID NO: 186997 - DNA, 35 bp, Artificial Sequence
  Synthetic oligonucleotide
actccgtggcctcctttgattccagcttttcttgt

SEQ ID NO: 186998 - DNA, 35 bp, Artificial Sequence
  Synthetic oligonucleotide
ggaaccccattgtcatatctgctctaccacgttgt

SEQ ID NO: 186999 - DNA, 35 bp, Artificial Sequence
  Synthetic oligonucleotide
tatgttgctgcccttctgcactgttttgtaccatt

SEQ ID NO: 187000 - DNA, 34 bp, Artificial Sequence
  Synthetic oligonucleotide
gaacccgatccgtatctatagtcaccctatcatt

SEQ ID NO: 187001 - DNA, 35 bp, Artificial Sequence
  Synthetic oligonucleotide
tctgcccagttagctgttgcttcgttttcgccctt

SEQ ID NO: 187002 - DNA, 35 bp, Artificial Sequence
  Synthetic oligonucleotide
gctccccgagcgacctccgtattgttacctctctt

SEQ ID NO: 187003 - DNA, 35 bp, Artificial Sequence
  Synthetic oligonucleotide
aatgtgcccgcttggcgcccattgccctccatgtt

SEQ ID NO: 187004 - DNA, 35 bp, Artificial Sequence
  Synthetic oligonucleotide
gccttcaccaccgcggatctttttcccattttgtt

SEQ ID NO: 187005 - DNA, 35 bp, Artificial Sequence
  Synthetic oligonucleotide
ataccgtactgtcgctggtagcaccctacaccttt

SEQ ID NO: 187006 - DNA, 35 bp, Artificial Sequence
  Synthetic oligonucleotide
ggtcgagtccacagggtgtcctgggggggtgggaa

SEQ ID NO: 187007 - DNA, 35 bp, Artificial Sequence
  Synthetic oligonucleotide
gagtcgctgccacatcaccctgctcctatgtctaa

SEQ ID NO: 187008 - DNA, 36 bp, Artificial Sequence
  Synthetic oligonucleotide
gtaagaagcaggatggcatgtaagggaggggagtaa

SEQ ID NO: 187009 - DNA, 35 bp, Artificial Sequence
  Synthetic oligonucleotide
tcatcccccccccgttgtctgtctacctaagttaa

SEQ ID NO: 187010 - DNA, 36 bp, Artificial Sequence
  Synthetic oligonucleotide
gctgtcccccgcgggtatcgccccttctttacaaca

SEQ ID NO: 187011 - DNA, 35 bp, Artificial Sequence
  Synthetic oligonucleotide
gataatgcgtgagataagggcgggagggggtaaca

SEQ ID NO: 187012 - DNA, 36 bp, Artificial Sequence
  Synthetic oligonucleotide
ccactcgccgatgttgtttttggccctcgctcccca

SEQ ID NO: 187013 - DNA, 35 bp, Artificial Sequence
  Synthetic oligonucleotide
tgcctatctgtatgtggctctttgcgccttctcca

SEQ ID NO: 187014 - DNA, 36 bp, Artificial Sequence
  Synthetic oligonucleotide
gcctgccctctctctcgttaccacagcctcgaagca

SEQ ID NO: 187015 - DNA, 35 bp, Artificial Sequence
  Synthetic oligonucleotide
atagatgccaccgacttacctgcgtatcacacgca

SEQ ID NO: 187016 - DNA, 36 bp, Artificial Sequence
  Synthetic oligonucleotide
acgcgcccccaggttctgtattcgcctactaccgca

SEQ ID NO: 187017 - DNA, 35 bp, Artificial Sequence
  Synthetic oligonucleotide
atcaccgctatacaaggcctgctatccctggcgca

SEQ ID NO: 187018 - DNA, 35 bp, Artificial Sequence
  Synthetic oligonucleotide
ttcaagcacacgatcctcccgttacgctcacctca

SEQ ID NO: 187019 - DNA, 35 bp, Artificial Sequence
  Synthetic oligonucleotide
ttgcgcatctgccctgcgttttttctcctttgtca

SEQ ID NO: 187020 - DNA, 35 bp, Artificial Sequence
  Synthetic oligonucleotide
tcccgatccgttactatagtacctgcatttattca

SEQ ID NO: 187021 - DNA, 36 bp, Artificial Sequence
  Synthetic oligonucleotide
gatgctcgcctctttccccctttcgtgcaggcttca

SEQ ID NO: 187022 - DNA, 36 bp, Artificial Sequence
  Synthetic oligonucleotide
gccgtgctgaacagccacgtttcttttacccgttca

SEQ ID NO: 187023 - DNA, 37 bp, Artificial Sequence
  Synthetic oligonucleotide
tgtgaggaggacaaggaaacaagaggcagaggagaga

SEQ ID NO: 187024 - DNA, 37 bp, Artificial Sequence
  Synthetic oligonucleotide
ttatcgcagggggaccagggaagggcgggaaaggaga

SEQ ID NO: 187025 - DNA, 37 bp, Artificial Sequence
  Synthetic oligonucleotide
atcacgatcagagcgttatgtccccccgcccccacga

SEQ ID NO: 187026 - DNA, 37 bp, Artificial Sequence
  Synthetic oligonucleotide
gtactacccaaatcactgtatgtcctgtcctccacga

SEQ ID NO: 187027 - DNA, 35 bp, Artificial Sequence
  Synthetic oligonucleotide
gaaggtggggaggggttaacggggaggatagacga

SEQ ID NO: 187028 - DNA, 35 bp, Artificial Sequence
  Synthetic oligonucleotide
ccattgccggtccatgtccctgtaccctccgccga

SEQ ID NO: 187029 - DNA, 36 bp, Artificial Sequence
  Synthetic oligonucleotide
tccgcacaagacgaggggggaaaggagtgggtccga

SEQ ID NO: 187030 - DNA, 37 bp, Artificial Sequence
  Synthetic oligonucleotide
tgctacggtcctgcttgataactctccattacctcga

SEQ ID NO: 187031 - DNA, 35 bp, Artificial Sequence
  Synthetic oligonucleotide
gccggggaggtgagggggaggggtgcaactaagga

SEQ ID NO: 187032 - DNA, 37 bp, Artificial Sequence
  Synthetic oligonucleotide
ggactagccctctctgcctgcgccttacctatgcgga

SEQ ID NO: 187033 - DNA, 37 bp, Artificial Sequence
  Synthetic oligonucleotide
tcgtaccccgccctgcctggcacgtcccgaagaggga

SEQ ID NO: 187034 - DNA, 37 bp, Artificial Sequence
  Synthetic oligonucleotide
gagtatgagcgggggaaccgtggtaaaggggcgggga

SEQ ID NO: 187035 - DNA, 37 bp, Artificial Sequence
  Synthetic oligonucleotide
acgaacggaacagtggcatgggcggaagggtggggga

SEQ ID NO: 187036 - DNA, 35 bp, Artificial Sequence
  Synthetic oligonucleotide
ggtcccccgctttcgttcttccgggccgccctgga

SEQ ID NO: 187037 - DNA, 37 bp, Artificial Sequence
  Synthetic oligonucleotide
tgagcatggcggacggtgggggattgggtagggtgga

SEQ ID NO: 187038 - DNA, 37 bp, Artificial Sequence
  Synthetic oligonucleotide
aaaggtggtccgaagttggggcccagggggtggtgga

SEQ ID NO: 187039 - DNA, 37 bp, Artificial Sequence
  Synthetic oligonucleotide
tcattcaccggcgttgcctccggacctcccctttgga

SEQ ID NO: 187040 - DNA, 37 bp, Artificial Sequence
  Synthetic oligonucleotide
gcccacgctggccctcccatgcgagctatcctttgga

SEQ ID NO: 187041 - DNA, 38 bp, Artificial Sequence
  Synthetic oligonucleotide
gaagggcaaggggtcgaggggcggtaggcggggaatga

SEQ ID NO: 187042 - DNA, 37 bp, Artificial Sequence
  Synthetic oligonucleotide
agaccgggagggacgggccgtaaacgggcaatcatga

SEQ ID NO: 187043 - DNA, 37 bp, Artificial Sequence
  Synthetic oligonucleotide
ggtggaacggggaaaggaagatacggcgagacgatga

SEQ ID NO: 187044 - DNA, 37 bp, Artificial Sequence
  Synthetic oligonucleotide
acagcccatctacgtggttccttcatcgcccctatga

SEQ ID NO: 187045 - DNA, 38 bp, Artificial Sequence
  Synthetic oligonucleotide
tggacccccgcctactggtaacggaccgccctctatga

SEQ ID NO: 187046 - DNA, 37 bp, Artificial Sequence
  Synthetic oligonucleotide
tcagagcgagccgtcagaagatgctccctccccctga

SEQ ID NO: 187047 - DNA, 36 bp, Artificial Sequence
  Synthetic oligonucleotide
gcaacgacattggcaatgtcccctttccctccctga

SEQ ID NO: 187048 - DNA, 37 bp, Artificial Sequence
  Synthetic oligonucleotide
tgaccatccatgtcacctgtcatcacccgcatcctga

SEQ ID NO: 187049 - DNA, 38 bp, Artificial Sequence
  Synthetic oligonucleotide
gcaggaacgggaagagggtaagcatgaggtgggtctga

SEQ ID NO: 187050 - DNA, 38 bp, Artificial Sequence
  Synthetic oligonucleotide
tgtgggtaggaaagggaagggatgcctaggcaaggtga

SEQ ID NO: 187051 - DNA, 38 bp, Artificial Sequence
  Synthetic oligonucleotide
agtgtcagagcggtgcggtcaggtagggcggggggtga

SEQ ID NO: 187052 - DNA, 38 bp, Artificial Sequence
  Synthetic oligonucleotide
agcgcggtagcgggtgaagggggggtgcttgggggtga

SEQ ID NO: 187053 - DNA, 38 bp, Artificial Sequence
  Synthetic oligonucleotide
gacgaagggggaggtggagtaatgcccggggcttgtga

SEQ ID NO: 187054 - DNA, 37 bp, Artificial Sequence
  Synthetic oligonucleotide
tagcccccctccgaccatagtcctatgaaacacttga

SEQ ID NO: 187055 - DNA, 37 bp, Artificial Sequence
  Synthetic oligonucleotide
gattcagcgctgcccctccacccctatgtctcgttga

SEQ ID NO: 187056 - DNA, 38 bp, Artificial Sequence
  Synthetic oligonucleotide
tccaccatagtaactgtagcatgcccacctgcctttga

SEQ ID NO: 187057 - DNA, 38 bp, Artificial Sequence
  Synthetic oligonucleotide
ggggtgtgagaaggatgggagggggcactagattttga

SEQ ID NO: 187058 - DNA, 36 bp, Artificial Sequence
  Synthetic oligonucleotide
accacgtcagtatacagcccgttcgtaccaccacta

SEQ ID NO: 187059 - DNA, 36 bp, Artificial Sequence
  Synthetic oligonucleotide
accgccgaagctctggctcctgtacggcctctccta

SEQ ID NO: 187060 - DNA, 35 bp, Artificial Sequence
  Synthetic oligonucleotide
tcagacacctctactttggtcacattttgcctcta

SEQ ID NO: 187061 - DNA, 36 bp, Artificial Sequence
  Synthetic oligonucleotide
tatggtgccggcatctgatttctcccgcccccctta

SEQ ID NO: 187062 - DNA, 35 bp, Artificial Sequence
  Synthetic oligonucleotide
ttgcccaacccacatcgtatctaaaccaccagtta

SEQ ID NO: 187063 - DNA, 34 bp, Artificial Sequence
  Synthetic oligonucleotide
ttccgccaccatgtcgatctcgttcttatcgtta

SEQ ID NO: 187064 - DNA, 35 bp, Artificial Sequence
  Synthetic oligonucleotide
ggagggaacggaggggcgagaaggatctattttta

SEQ ID NO: 187065 - DNA, 35 bp, Artificial Sequence
  Synthetic oligonucleotide
gagcaacgggtgggatgaagtcaaggggggggaac

SEQ ID NO: 187066 - DNA, 35 bp, Artificial Sequence
  Synthetic oligonucleotide
actgccccattgaacttatgccacacccgcctaac

SEQ ID NO: 187067 - DNA, 35 bp, Artificial Sequence
  Synthetic oligonucleotide
gggtccggtccacggctatcaagcgcaccatccac

SEQ ID NO: 187068 - DNA, 35 bp, Artificial Sequence
  Synthetic oligonucleotide
acatcgctcatatagcctctcgatacgttctccac

SEQ ID NO: 187069 - DNA, 35 bp, Artificial Sequence
  Synthetic oligonucleotide
tacggacatcgtcacatcccgcaactgccgtccac

SEQ ID NO: 187070 - DNA, 35 bp, Artificial Sequence
  Synthetic oligonucleotide
gaggtcgacacccgctcacttgtcttttgttccac

SEQ ID NO: 187071 - DNA, 35 bp, Artificial Sequence
  Synthetic oligonucleotide
ttcgagtcgcccgggcgctattttcgattactcac

SEQ ID NO: 187072 - DNA, 35 bp, Artificial Sequence
  Synthetic oligonucleotide
aatccgcccgctccgactcttgctctttcatatac

SEQ ID NO: 187073 - DNA, 35 bp, Artificial Sequence
  Synthetic oligonucleotide
gacagccccccgcaccatcgagctcatcgctttac

SEQ ID NO: 187074 - DNA, 35 bp, Artificial Sequence
  Synthetic oligonucleotide
accccttgcgccatcgcgattcctgttattacacc

SEQ ID NO: 187075 - DNA, 35 bp, Artificial Sequence
  Synthetic oligonucleotide
ggatcgctctccccgcaatgagccaaacctccacc

SEQ ID NO: 187076 - DNA, 35 bp, Artificial Sequence
  Synthetic oligonucleotide
gagaggaggaggcatggaggcataggaaagaagcc

SEQ ID NO: 187077 - DNA, 35 bp, Artificial Sequence
  Synthetic oligonucleotide
atcacccgcataggacgcaactcgtttcacacgcc

SEQ ID NO: 187078 - DNA, 35 bp, Artificial Sequence
  Synthetic oligonucleotide
gtgagacgccgattctctccgccccctgtcttgcc

SEQ ID NO: 187079 - DNA, 35 bp, Artificial Sequence
  Synthetic oligonucleotide
gttccccgaactggtaccttgacggatttcttgcc

SEQ ID NO: 187080 - DNA, 35 bp, Artificial Sequence
  Synthetic oligonucleotide
agagcttgcccactgagttctcccactgctaatcc

SEQ ID NO: 187081 - DNA, 35 bp, Artificial Sequence
  Synthetic oligonucleotide
tccagcgggtcgcccatctatccaacagaacctcc

SEQ ID NO: 187082 - DNA, 35 bp, Artificial Sequence
  Synthetic oligonucleotide
ttgggaaccgcgtcttgaactttgctgccacctcc

SEQ ID NO: 187083 - DNA, 34 bp, Artificial Sequence
  Synthetic oligonucleotide
acgtacctgactggaatatcctgtgcctacctcc

SEQ ID NO: 187084 - DNA, 35 bp, Artificial Sequence
  Synthetic oligonucleotide
tgttcatatacgcctgcagttttacgtagccctcc

SEQ ID NO: 187085 - DNA, 35 bp, Artificial Sequence
  Synthetic oligonucleotide
tacttgcgccaggccacgcacatctcggttcctcc

SEQ ID NO: 187086 - DNA, 35 bp, Artificial Sequence
  Synthetic oligonucleotide
gaacgcccttacatcatcgtgcagtggacatctcc

SEQ ID NO: 187087 - DNA, 35 bp, Artificial Sequence
  Synthetic oligonucleotide
gacacacggagggtctgtccacgttctttttgtcc

SEQ ID NO: 187088 - DNA, 35 bp, Artificial Sequence
  Synthetic oligonucleotide
gacagcccccctgatatggacatatctcttcttcc

SEQ ID NO: 187089 - DNA, 35 bp, Artificial Sequence
  Synthetic oligonucleotide
catggtcgccgctgcttatctgccctcttcctagc

SEQ ID NO: 187090 - DNA, 34 bp, Artificial Sequence
  Synthetic oligonucleotide
tagagcctcatcgttcgccgcatcccttacccgc

SEQ ID NO: 187091 - DNA, 35 bp, Artificial Sequence
  Synthetic oligonucleotide
tttccaccgccaccaatatggttgtcagttctcgc

SEQ ID NO: 187092 - DNA, 35 bp, Artificial Sequence
  Synthetic oligonucleotide
tcctgcgttatccctccacctctcggctttaaggc

SEQ ID NO: 187093 - DNA, 35 bp, Artificial Sequence
  Synthetic oligonucleotide
tcttcccccgccacgaaggtttccctgccgtatgc

SEQ ID NO: 187094 - DNA, 35 bp, Artificial Sequence
  Synthetic oligonucleotide
gtaccgctattcggagccttaaccacctgcactgc

SEQ ID NO: 187095 - DNA, 35 bp, Artificial Sequence
  Synthetic oligonucleotide
gtggacggtctacacattcgctttcatttacctgc

SEQ ID NO: 187096 - DNA, 35 bp, Artificial Sequence
  Synthetic oligonucleotide
gtcggacaacactccagcctcaccacgctccctgc

SEQ ID NO: 187097 - DNA, 35 bp, Artificial Sequence
  Synthetic oligonucleotide
accaacctcgcgtgttcattgaacctatcattatc

SEQ ID NO: 187098 - DNA, 35 bp, Artificial Sequence
  Synthetic oligonucleotide
accaagcagagcagtcacattcacaccctgccctc

SEQ ID NO: 187099 - DNA, 35 bp, Artificial Sequence
  Synthetic oligonucleotide
gtagccatatcgtttgctctaggcctccaatcctc

SEQ ID NO: 187100 - DNA, 35 bp, Artificial Sequence
  Synthetic oligonucleotide
gtccgctcgcccatcgttcaacggtaccttggctc

SEQ ID NO: 187101 - DNA, 35 bp, Artificial Sequence
  Synthetic oligonucleotide
atcctgccgtctctggcatttcttaggttgttctc

SEQ ID NO: 187102 - DNA, 35 bp, Artificial Sequence
  Synthetic oligonucleotide
gtcacagttcattaatcttcatgtcgccccctgtc

SEQ ID NO: 187103 - DNA, 35 bp, Artificial Sequence
  Synthetic oligonucleotide
atcgcaccacaccctgcggtagctacagttacttc

SEQ ID NO: 187104 - DNA, 34 bp, Artificial Sequence
  Synthetic oligonucleotide
tccgcacctgcttccccctcgccgaactgagttc

SEQ ID NO: 187105 - DNA, 35 bp, Artificial Sequence
  Synthetic oligonucleotide
ggcctcatccgcttgctgtaccctcctttactttc

SEQ ID NO: 187106 - DNA, 35 bp, Artificial Sequence
  Synthetic oligonucleotide
gtctccgaggccctctgtaatcttttcgtgctttc

SEQ ID NO: 187107 - DNA, 35 bp, Artificial Sequence
  Synthetic oligonucleotide
tgatcctgccgtgccatccagctacttcctctttc

SEQ ID NO: 187108 - DNA, 35 bp, Artificial Sequence
  Synthetic oligonucleotide
ttatcaccacagatccgtcgctccgcccccttttc

SEQ ID NO: 187109 - DNA, 35 bp, Artificial Sequence
  Synthetic oligonucleotide
ggttagcgggggcggttggggagggaagtaacaag

SEQ ID NO: 187110 - DNA, 35 bp, Artificial Sequence
  Synthetic oligonucleotide
tccacgcccccgccgcgcatcggatagctatccag

SEQ ID NO: 187111 - DNA, 35 bp, Artificial Sequence
  Synthetic oligonucleotide
gaacccccctgcatgtccccactatgctcgtagag

SEQ ID NO: 187112 - DNA, 35 bp, Artificial Sequence
  Synthetic oligonucleotide
gctcaacagtcgccccgcccctgcacactaactag

SEQ ID NO: 187113 - DNA, 35 bp, Artificial Sequence
  Synthetic oligonucleotide
tgcccttatctgtccttccgatgctctcgttcccg

SEQ ID NO: 187114 - DNA, 35 bp, Artificial Sequence
  Synthetic oligonucleotide
tgttcctggccgattcatcttctctctctccgccg

SEQ ID NO: 187115 - DNA, 35 bp, Artificial Sequence
  Synthetic oligonucleotide
taccggccccacccctttgtgtcttgttcctgccg

SEQ ID NO: 187116 - DNA, 35 bp, Artificial Sequence
  Synthetic oligonucleotide
atgctcgactgcccggctctaactccccattggcg

SEQ ID NO: 187117 - DNA, 35 bp, Artificial Sequence
  Synthetic oligonucleotide
tgtcctcctccctggttcaagcccggcccgtttcg

SEQ ID NO: 187118 - DNA, 35 bp, Artificial Sequence
  Synthetic oligonucleotide
accatccctccatcaacacgcctttcatttctagg

SEQ ID NO: 187119 - DNA, 35 bp, Artificial Sequence
  Synthetic oligonucleotide
tagctgtaacggagggaggagagaggatacatcgg

SEQ ID NO: 187120 - DNA, 35 bp, Artificial Sequence
  Synthetic oligonucleotide
agcccgggaggggataagttgggtcgtgttccggg

SEQ ID NO: 187121 - DNA, 35 bp, Artificial Sequence
  Synthetic oligonucleotide
tgttatcatcgtttgcttacattgctcctccctgg

SEQ ID NO: 187122 - DNA, 35 bp, Artificial Sequence
  Synthetic oligonucleotide
tccgcccgcggtctccttctgtcatattccccctg

SEQ ID NO: 187123 - DNA, 35 bp, Artificial Sequence
  Synthetic oligonucleotide
tcgcaccgccacaatcgttcttaccccgctccctg

SEQ ID NO: 187124 - DNA, 35 bp, Artificial Sequence
  Synthetic oligonucleotide
gcccgtgaacccgtgttgccgctccttccctcctg

SEQ ID NO: 187125 - DNA, 35 bp, Artificial Sequence
  Synthetic oligonucleotide
tgttggcttccaccatatagtttttccatctcttg

SEQ ID NO: 187126 - DNA, 35 bp, Artificial Sequence
  Synthetic oligonucleotide
gatacactcctcccgacgccttgaatagactgttg

SEQ ID NO: 187127 - DNA, 35 bp, Artificial Sequence
  Synthetic oligonucleotide
gctcgaggggctggaaaggggggcggaaaggccat

SEQ ID NO: 187128 - DNA, 35 bp, Artificial Sequence
  Synthetic oligonucleotide
gacaaccccctccgtatcccgtagctcgaatcgat

SEQ ID NO: 187129 - DNA, 35 bp, Artificial Sequence
  Synthetic oligonucleotide
atagccctccacttaccatctgcatgaggcacact

SEQ ID NO: 187130 - DNA, 35 bp, Artificial Sequence
  Synthetic oligonucleotide
acgtccggtcactcgctatccgtctgtttcttact

SEQ ID NO: 187131 - DNA, 35 bp, Artificial Sequence
  Synthetic oligonucleotide
taccgcccctgtgcatgctaccctacgtatttact

SEQ ID NO: 187132 - DNA, 35 bp, Artificial Sequence
  Synthetic oligonucleotide
tcaccatacgcagtacgcgtaatacgcactttact

SEQ ID NO: 187133 - DNA, 35 bp, Artificial Sequence
  Synthetic oligonucleotide
tacgcgccccctccgactaggttcggacaccccct

SEQ ID NO: 187134 - DNA, 35 bp, Artificial Sequence
  Synthetic oligonucleotide
aactccccagcctgccgcatcggaccggtcgccct

SEQ ID NO: 187135 - DNA, 35 bp, Artificial Sequence
  Synthetic oligonucleotide
tcatcacaccctcaattcgtgccgcttatcgctct

SEQ ID NO: 187136 - DNA, 35 bp, Artificial Sequence
  Synthetic oligonucleotide
gcgctagtcaggtctccctctggttcccctggtct

SEQ ID NO: 187137 - DNA, 35 bp, Artificial Sequence
  Synthetic oligonucleotide
gtgacgaccgcactgcgctcttttctggtttttct

SEQ ID NO: 187138 - DNA, 35 bp, Artificial Sequence
  Synthetic oligonucleotide
gccactcgcaccgcctactcaccgaccagcccagt

SEQ ID NO: 187139 - DNA, 35 bp, Artificial Sequence
  Synthetic oligonucleotide
gtgcccaggttgtctcgcgcgtcttccaatcccgt

SEQ ID NO: 187140 - DNA, 35 bp, Artificial Sequence
  Synthetic oligonucleotide
agaccagccaaccgctgctttgacaccattcctgt

SEQ ID NO: 187141 - DNA, 35 bp, Artificial Sequence
  Synthetic oligonucleotide
aacacatcgccccttgtctgtcctgcctgttactt

SEQ ID NO: 187142 - DNA, 35 bp, Artificial Sequence
  Synthetic oligonucleotide
gaatggtccgcccacgtagttgtctcactctcctt

SEQ ID NO: 187143 - DNA, 35 bp, Artificial Sequence
  Synthetic oligonucleotide
accatccatcgccctgttttgcggacaggcttctt

SEQ ID NO: 187144 - DNA, 35 bp, Artificial Sequence
  Synthetic oligonucleotide
tagccagccaccatccacactgatacctctcgttt

SEQ ID NO: 187145 - DNA, 36 bp, Artificial Sequence
  Synthetic oligonucleotide
aagacggtctggggcaaggtagggctagggggaaaa

SEQ ID NO: 187146 - DNA, 35 bp, Artificial Sequence
  Synthetic oligonucleotide
ataaaccgtgcgctgggcgggagtgggtggggaaa

SEQ ID NO: 187147 - DNA, 35 bp, Artificial Sequence
  Synthetic oligonucleotide
tccacccctcctgagcacctgattcactcatctaa

SEQ ID NO: 187148 - DNA, 36 bp, Artificial Sequence
  Synthetic oligonucleotide
gtgtccctccgattattgttaggccccccgtattaa

SEQ ID NO: 187149 - DNA, 36 bp, Artificial Sequence
  Synthetic oligonucleotide
acccactcagctgctccgctcgttacgtttacaaca

SEQ ID NO: 187150 - DNA, 36 bp, Artificial Sequence
  Synthetic oligonucleotide
gcccctgatagtcgaccctgttcatgccaccacaca

SEQ ID NO: 187151 - DNA, 36 bp, Artificial Sequence
  Synthetic oligonucleotide
gttccgtcgccaacgctgcatcacgaccgccccaca

SEQ ID NO: 187152 - DNA, 36 bp, Artificial Sequence
  Synthetic oligonucleotide
taccgtcactgcccttctgccacaacaccctccaca

SEQ ID NO: 187153 - DNA, 35 bp, Artificial Sequence
  Synthetic oligonucleotide
ttcgccacatccttccgagcctcacactgcgtaca

SEQ ID NO: 187154 - DNA, 36 bp, Artificial Sequence
  Synthetic oligonucleotide
gaactcaactctgcctggtaacatcacaactgtaca

SEQ ID NO: 187155 - DNA, 36 bp, Artificial Sequence
  Synthetic oligonucleotide
tcagaccccatcatctcttttggcgatccttcccca

SEQ ID NO: 187156 - DNA, 35 bp, Artificial Sequence
  Synthetic oligonucleotide
ggaaccactggattttttgccaccgagccttccca

SEQ ID NO: 187157 - DNA, 36 bp, Artificial Sequence
  Synthetic oligonucleotide
gcgacccagccgacctatcatgactcttcgcagcca

SEQ ID NO: 187158 - DNA, 35 bp, Artificial Sequence
  Synthetic oligonucleotide
tatgggcggggccgggggcaaacagggggatgcca

SEQ ID NO: 187159 - DNA, 36 bp, Artificial Sequence
  Synthetic oligonucleotide
ttgttcggacgcagacacatctgttgcccccctcca

SEQ ID NO: 187160 - DNA, 36 bp, Artificial Sequence
  Synthetic oligonucleotide
tgccctcccataccttctccgccatgcatgttcgca

SEQ ID NO: 187161 - DNA, 35 bp, Artificial Sequence
  Synthetic oligonucleotide
atggtcaccaatcgctgccacttactcgaacatca

SEQ ID NO: 187162 - DNA, 36 bp, Artificial Sequence
  Synthetic oligonucleotide
gccaggtgtggtcggtcggggttttgcggtggatca

SEQ ID NO: 187163 - DNA, 35 bp, Artificial Sequence
  Synthetic oligonucleotide
tttcgccccacgccgctgttcaccatggtgcttca

SEQ ID NO: 187164 - DNA, 36 bp, Artificial Sequence
  Synthetic oligonucleotide
gagtcgggtcgcctttccatctctcatgccagttca

SEQ ID NO: 187165 - DNA, 37 bp, Artificial Sequence
  Synthetic oligonucleotide
aaccccgctcgcctcaaattaccttgttccacgttca

SEQ ID NO: 187166 - DNA, 37 bp, Artificial Sequence
  Synthetic oligonucleotide
atccgtcggggggggaagggaggggacgactcgaaga

SEQ ID NO: 187167 - DNA, 37 bp, Artificial Sequence
  Synthetic oligonucleotide
acaacgtgaaagagtcgggagggggagcaaatggaga

SEQ ID NO: 187168 - DNA, 37 bp, Artificial Sequence
  Synthetic oligonucleotide
gccgcccccacccgccttgtagtggactctccctaga

SEQ ID NO: 187169 - DNA, 37 bp, Artificial Sequence
  Synthetic oligonucleotide
gtgtcaaccgggggagagataacggaatgggagacga

SEQ ID NO: 187170 - DNA, 37 bp, Artificial Sequence
  Synthetic oligonucleotide
atcccgccgtacgcctcacatagttccacatgctcga

SEQ ID NO: 187171 - DNA, 37 bp, Artificial Sequence
  Synthetic oligonucleotide
gtgcgccccaatccgccttcttgaacatctccgtcga

SEQ ID NO: 187172 - DNA, 37 bp, Artificial Sequence
  Synthetic oligonucleotide
gactgtccaccctgctctgtgcctctcctatccagga

SEQ ID NO: 187173 - DNA, 37 bp, Artificial Sequence
  Synthetic oligonucleotide
attgaggagggggcactgcctgtaatgggggggagga

SEQ ID NO: 187174 - DNA, 37 bp, Artificial Sequence
  Synthetic oligonucleotide
aacatctgcacatcgtcttcccgtttccctccccgga

SEQ ID NO: 187175 - DNA, 37 bp, Artificial Sequence
  Synthetic oligonucleotide
atcaggacggatagggtgagaggggcgggataaggga

SEQ ID NO: 187176 - DNA, 37 bp, Artificial Sequence
  Synthetic oligonucleotide
tgatggcggggaggactaggtgggccggggttaggga

SEQ ID NO: 187177 - DNA, 37 bp, Artificial Sequence
  Synthetic oligonucleotide
acttgacctccctcgcgtttgcgctccgtccccggga

SEQ ID NO: 187178 - DNA, 35 bp, Artificial Sequence
  Synthetic oligonucleotide
acaggagagatagtggtgcataacgtgggggggga

SEQ ID NO: 187179 - DNA, 38 bp, Artificial Sequence
  Synthetic oligonucleotide
atcgccccccctcctgttaattaggtcacacataatga

SEQ ID NO: 187180 - DNA, 38 bp, Artificial Sequence
  Synthetic oligonucleotide
acccctccctcgcccagactgctcaagaatatccatga

SEQ ID NO: 187181 - DNA, 38 bp, Artificial Sequence
  Synthetic oligonucleotide
tcatcgccgccacatcctcctacgagctttttgcatga

SEQ ID NO: 187182 - DNA, 38 bp, Artificial Sequence
  Synthetic oligonucleotide
gaaaacgtaagagagggagggcgcggcgcgggcgatga

SEQ ID NO: 187183 - DNA, 38 bp, Artificial Sequence
  Synthetic oligonucleotide
tgtctcgctccctcccgaatgttttaccgtgccactga

SEQ ID NO: 187184 - DNA, 38 bp, Artificial Sequence
  Synthetic oligonucleotide
tgtgaccggggaaagggggggagcattggtcatactga

SEQ ID NO: 187185 - DNA, 37 bp, Artificial Sequence
  Synthetic oligonucleotide
tgtcacaccaactctcgcacaaggccactgaacctga

SEQ ID NO: 187186 - DNA, 38 bp, Artificial Sequence
  Synthetic oligonucleotide
caacaccgcctcctagtgctcatgttacatcgccctga

SEQ ID NO: 187187 - DNA, 38 bp, Artificial Sequence
  Synthetic oligonucleotide
tgaatcccctcccgacgtactttgaacgactgccctga

SEQ ID NO: 187188 - DNA, 38 bp, Artificial Sequence
  Synthetic oligonucleotide
tgatcggctgtctgacgctttctcgccttcctcgctga

SEQ ID NO: 187189 - DNA, 38 bp, Artificial Sequence
  Synthetic oligonucleotide
tgcgctccctcggttcttctcaggtcgactccatctga

SEQ ID NO: 187190 - DNA, 37 bp, Artificial Sequence
  Synthetic oligonucleotide
tccgctcctcaaacgtttctcttatggcccactctga

SEQ ID NO: 187191 - DNA, 37 bp, Artificial Sequence
  Synthetic oligonucleotide
gagtgacgctccggttcgtaataccccttccctctga

SEQ ID NO: 187192 - DNA, 35 bp, Artificial Sequence
  Synthetic oligonucleotide
atgacgcgcctcctatcgcatatgctccccagtga

SEQ ID NO: 187193 - DNA, 38 bp, Artificial Sequence
  Synthetic oligonucleotide
acgtgtaaagaggggggaaggagcggtgtggggcgtga

SEQ ID NO: 187194 - DNA, 38 bp, Artificial Sequence
  Synthetic oligonucleotide
tacgccctctccgctcttgccgttccagtcgttcgtga

SEQ ID NO: 187195 - DNA, 38 bp, Artificial Sequence
  Synthetic oligonucleotide
gcagatgagccggaaggggcataaaacggggggggtga

SEQ ID NO: 187196 - DNA, 37 bp, Artificial Sequence
  Synthetic oligonucleotide
acagtcaggtagggcggtctgggagggggtaatgtga

SEQ ID NO: 187197 - DNA, 38 bp, Artificial Sequence
  Synthetic oligonucleotide
tttgcctcgtctatcttatacctgcacccaccccttga

SEQ ID NO: 187198 - DNA, 38 bp, Artificial Sequence
  Synthetic oligonucleotide
gcccaccaccatttgactagcacgattcaccctcttga

SEQ ID NO: 187199 - DNA, 37 bp, Artificial Sequence
  Synthetic oligonucleotide
aatacagtcccagggggggaggaggaaggatagttga

SEQ ID NO: 187200 - DNA, 38 bp, Artificial Sequence
  Synthetic oligonucleotide
acgattccccctcccccacgatctttaaggacgtttga

SEQ ID NO: 187201 - DNA, 36 bp, Artificial Sequence
  Synthetic oligonucleotide
ttgaacccctgcacaatgctttagcgcaacacccta

SEQ ID NO: 187202 - DNA, 36 bp, Artificial Sequence
  Synthetic oligonucleotide
tgctacgtcagacgtccccgcacactactctcgcta

SEQ ID NO: 187203 - DNA, 35 bp, Artificial Sequence
  Synthetic oligonucleotide
accttcttgccgccagttcgcctcccatttctcta

SEQ ID NO: 187204 - DNA, 36 bp, Artificial Sequence
  Synthetic oligonucleotide
gtggaagggaggtgggatcaactatagggccacgta

SEQ ID NO: 187205 - DNA, 36 bp, Artificial Sequence
  Synthetic oligonucleotide
ggaccccccgccgccgactaattctagactactgta

SEQ ID NO: 187206 - DNA, 36 bp, Artificial Sequence
  Synthetic oligonucleotide
actccgcacatgttccgctaccataattccatctta

SEQ ID NO: 187207 - DNA, 35 bp, Artificial Sequence
  Synthetic oligonucleotide
ggattcgccgctttgcacctctgccgtcccccaac

SEQ ID NO: 187208 - DNA, 35 bp, Artificial Sequence
  Synthetic oligonucleotide
tctgcccgcccaattagatatatccatccgccaac

SEQ ID NO: 187209 - DNA, 35 bp, Artificial Sequence
  Synthetic oligonucleotide
tgctctctcccctgctatgcgccttccatccgaac

SEQ ID NO: 187210 - DNA, 35 bp, Artificial Sequence
  Synthetic oligonucleotide
tcaaccttccgcatcatacgcgcctcttagggaac

SEQ ID NO: 187211 - DNA, 35 bp, Artificial Sequence
  Synthetic oligonucleotide
tgctctcccagccatagttacgccggtccaaacac

SEQ ID NO: 187212 - DNA, 35 bp, Artificial Sequence
  Synthetic oligonucleotide
gcacgagagtacggcttattctcgccacctaccac

SEQ ID NO: 187213 - DNA, 35 bp, Artificial Sequence
  Synthetic oligonucleotide
gtcatccagcctggtgcttgcgcgcaccctaccac

SEQ ID NO: 187214 - DNA, 35 bp, Artificial Sequence
  Synthetic oligonucleotide
tatgccacccgtcacatgccttcgcatgctagcac

SEQ ID NO: 187215 - DNA, 35 bp, Artificial Sequence
  Synthetic oligonucleotide
agagaccaccccgttattgtttgctttccactcac

SEQ ID NO: 187216 - DNA, 35 bp, Artificial Sequence
  Synthetic oligonucleotide
ggacaaactaatcgacccgctgcctacctgatgac

SEQ ID NO: 187217 - DNA, 35 bp, Artificial Sequence
  Synthetic oligonucleotide
ggatagagggacggggacaagaggagggtaagtac

SEQ ID NO: 187218 - DNA, 35 bp, Artificial Sequence
  Synthetic oligonucleotide
aaccgccgtcgtaggcccgcgcgttcatcccgtac

SEQ ID NO: 187219 - DNA, 35 bp, Artificial Sequence
  Synthetic oligonucleotide
tcctgcccccatgattattgccctccgcttgaacc

SEQ ID NO: 187220 - DNA, 35 bp, Artificial Sequence
  Synthetic oligonucleotide
atcctgtgaccatctgtgacatttacctgcccacc

SEQ ID NO: 187221 - DNA, 35 bp, Artificial Sequence
  Synthetic oligonucleotide
attgcatcaggtttgcggcgcctccttcactcacc

SEQ ID NO: 187222 - DNA, 35 bp, Artificial Sequence
  Synthetic oligonucleotide
tgtcccccctacaagtgtttcggcctcttactacc

SEQ ID NO: 187223 - DNA, 35 bp, Artificial Sequence
  Synthetic oligonucleotide
gcccgcagacgctatcactgcctttccgccctacc

SEQ ID NO: 187224 - DNA, 35 bp, Artificial Sequence
  Synthetic oligonucleotide
gtcacccgctatgtgggggatacccgactccaccc

SEQ ID NO: 187225 - DNA, 35 bp, Artificial Sequence
  Synthetic oligonucleotide
acttgcaccctttgactgatccagtcgcccagccc

SEQ ID NO: 187226 - DNA, 35 bp, Artificial Sequence
  Synthetic oligonucleotide
atcagttgcccgttccgatcggctccacattgccc

SEQ ID NO: 187227 - DNA, 35 bp, Artificial Sequence
  Synthetic oligonucleotide
tcacacgtgtctttccctgtcgtccgtcgttgccc

SEQ ID NO: 187228 - DNA, 35 bp, Artificial Sequence
  Synthetic oligonucleotide
gtcaacctagcatggactatgcttcacaaactccc

SEQ ID NO: 187229 - DNA, 35 bp, Artificial Sequence
  Synthetic oligonucleotide
gcaggcattactatgttatacatgtcccctccgcc

SEQ ID NO: 187230 - DNA, 35 bp, Artificial Sequence
  Synthetic oligonucleotide
acgacccttctacgattaccgtgctccgtttggcc

SEQ ID NO: 187231 - DNA, 35 bp, Artificial Sequence
  Synthetic oligonucleotide
gtaaccctcgcctgttacttcactgagatttatcc

SEQ ID NO: 187232 - DNA, 35 bp, Artificial Sequence
  Synthetic oligonucleotide
agatctgccaccttgtcgctgagcgattgtcctcc

SEQ ID NO: 187233 - DNA, 35 bp, Artificial Sequence
  Synthetic oligonucleotide
gaatatctactgctgccccctgcttattggtctcc

SEQ ID NO: 187234 - DNA, 35 bp, Artificial Sequence
  Synthetic oligonucleotide
tgctcagttcgcgtgcgatccatgttctcttgtcc

SEQ ID NO: 187235 - DNA, 35 bp, Artificial Sequence
  Synthetic oligonucleotide
acttggccaccctgcatcatggcaaaacctattcc

SEQ ID NO: 187236 - DNA, 35 bp, Artificial Sequence
  Synthetic oligonucleotide
ttatcctcgctgtaattgttagtgccacttcttcc

SEQ ID NO: 187237 - DNA, 35 bp, Artificial Sequence
  Synthetic oligonucleotide
atcctgtaaacgctgagtgcaccgacactctttcc

SEQ ID NO: 187238 - DNA, 35 bp, Artificial Sequence
  Synthetic oligonucleotide
agctacgtgtgagccaggagggggggtggggtagc

SEQ ID NO: 187239 - DNA, 35 bp, Artificial Sequence
  Synthetic oligonucleotide
gtgcccccgccctccgccccaagtataggatatgc

SEQ ID NO: 187240 - DNA, 35 bp, Artificial Sequence
  Synthetic oligonucleotide
tgatcagccggtgtgcaatctccatttctccctgc

SEQ ID NO: 187241 - DNA, 35 bp, Artificial Sequence
  Synthetic oligonucleotide
tccgaatgtcccaccctgcttgccctcgtgcttgc

SEQ ID NO: 187242 - DNA, 35 bp, Artificial Sequence
  Synthetic oligonucleotide
ttgcgctggccattttatttactcgtcctctttgc

SEQ ID NO: 187243 - DNA, 35 bp, Artificial Sequence
  Synthetic oligonucleotide
gtgtccagctcttccgttttgctgcatttcgaatc

SEQ ID NO: 187244 - DNA, 35 bp, Artificial Sequence
  Synthetic oligonucleotide
tcaccgcagtaaccatcagcaccatggcccccatc

SEQ ID NO: 187245 - DNA, 35 bp, Artificial Sequence
  Synthetic oligonucleotide
gaccggcgcattgcctgggcgctttcatttccatc

SEQ ID NO: 187246 - DNA, 35 bp, Artificial Sequence
  Synthetic oligonucleotide
attgccccgggagatatgcacacttccccttcatc

SEQ ID NO: 187247 - DNA, 35 bp, Artificial Sequence
  Synthetic oligonucleotide
tactccccgggtgtgaagtactgttccctgttatc

SEQ ID NO: 187248 - DNA, 35 bp, Artificial Sequence
  Synthetic oligonucleotide
gcacaccggcaaacatgccttttaggtgttacctc

SEQ ID NO: 187249 - DNA, 35 bp, Artificial Sequence
  Synthetic oligonucleotide
tcatcccaccagttgcccaaagcgctaatacgctc

SEQ ID NO: 187250 - DNA, 35 bp, Artificial Sequence
  Synthetic oligonucleotide
gcaaacacaccaatggtgttcattacaccgctctc

SEQ ID NO: 187251 - DNA, 35 bp, Artificial Sequence
  Synthetic oligonucleotide
gtcccaatcagcgcgtccctctacgttcgttggtc

SEQ ID NO: 187252 - DNA, 35 bp, Artificial Sequence
  Synthetic oligonucleotide
ttatccgacctcgccctctcatgtgctccactgtc

SEQ ID NO: 187253 - DNA, 35 bp, Artificial Sequence
  Synthetic oligonucleotide
tacgcgcctctcattcctgtccatcgccccctgtc

SEQ ID NO: 187254 - DNA, 35 bp, Artificial Sequence
  Synthetic oligonucleotide
aaacaccagtcggatactggcttacttcctctgtc

SEQ ID NO: 187255 - DNA, 35 bp, Artificial Sequence
  Synthetic oligonucleotide
acgtccaatccgcacgtgcactgactatctctgtc

SEQ ID NO: 187256 - DNA, 35 bp, Artificial Sequence
  Synthetic oligonucleotide
tcatcactatgtaggcgatcgcactcactgccttc

SEQ ID NO: 187257 - DNA, 35 bp, Artificial Sequence
  Synthetic oligonucleotide
gacgtaccactatgctcactgcctgaacttggttc

SEQ ID NO: 187258 - DNA, 35 bp, Artificial Sequence
  Synthetic oligonucleotide
gttgcctctgtgcgcatttctcgttttaactgttc

SEQ ID NO: 187259 - DNA, 35 bp, Artificial Sequence
  Synthetic oligonucleotide
gctcgctactcatgtactgtccgtgagttcctttc

SEQ ID NO: 187260 - DNA, 35 bp, Artificial Sequence
  Synthetic oligonucleotide
ggttacacacacgccgtagtccaccacaccttttc

SEQ ID NO: 187261 - DNA, 35 bp, Artificial Sequence
  Synthetic oligonucleotide
tagaccagggcagtttgaaccctcccctctttttc

SEQ ID NO: 187262 - DNA, 35 bp, Artificial Sequence
  Synthetic oligonucleotide
atcgcgatgttgtctttcccccctcccctcagaag

SEQ ID NO: 187263 - DNA, 35 bp, Artificial Sequence
  Synthetic oligonucleotide
ttcgagaaccggagggtgggcgacgggctgaggag

SEQ ID NO: 187264 - DNA, 35 bp, Artificial Sequence
  Synthetic oligonucleotide
gtacgaaggggggagtagggtaggaattccgggag

SEQ ID NO: 187265 - DNA, 35 bp, Artificial Sequence
  Synthetic oligonucleotide
aatgtgggggagaatacgtagagacggcaaatgag

SEQ ID NO: 187266 - DNA, 35 bp, Artificial Sequence
  Synthetic oligonucleotide
acagggcgccgccacccttgtcatccctggctccg

SEQ ID NO: 187267 - DNA, 35 bp, Artificial Sequence
  Synthetic oligonucleotide
gcacctacacgcgtgctaacctggtccacccctcg

SEQ ID NO: 187268 - DNA, 35 bp, Artificial Sequence
  Synthetic oligonucleotide
gtgcaaccacccgcagacctactcttgttccctcg

SEQ ID NO: 187269 - DNA, 35 bp, Artificial Sequence
  Synthetic oligonucleotide
gcataccgcggtgcgcattacacgaccccctctcg

SEQ ID NO: 187270 - DNA, 35 bp, Artificial Sequence
  Synthetic oligonucleotide
atcccctgctctgccgactggttacttttgattcg

SEQ ID NO: 187271 - DNA, 35 bp, Artificial Sequence
  Synthetic oligonucleotide
tttcgagcaacttgtccgagcttccctttccttcg

SEQ ID NO: 187272 - DNA, 35 bp, Artificial Sequence
  Synthetic oligonucleotide
ggggagggatcgggggggcgccctaaggaaagagg

SEQ ID NO: 187273 - DNA, 35 bp, Artificial Sequence
  Synthetic oligonucleotide
gatggggtgggatttggtacggtacggtggtgagg

SEQ ID NO: 187274 - DNA, 35 bp, Artificial Sequence
  Synthetic oligonucleotide
gagggcgggggaggcgctaaaccaatgacggaggg

SEQ ID NO: 187275 - DNA, 35 bp, Artificial Sequence
  Synthetic oligonucleotide
gtgtggctaaggagcgaattagggtggagggtggg

SEQ ID NO: 187276 - DNA, 35 bp, Artificial Sequence
  Synthetic oligonucleotide
ggagtcccgatccgatacaccaccatctgcccatg

SEQ ID NO: 187277 - DNA, 35 bp, Artificial Sequence
  Synthetic oligonucleotide
tcccaccgccccatctttgcatatgccctgccatg

SEQ ID NO: 187278 - DNA, 35 bp, Artificial Sequence
  Synthetic oligonucleotide
gctgccgtgatatttcgtacgtaccccccacactg

SEQ ID NO: 187279 - DNA, 35 bp, Artificial Sequence
  Synthetic oligonucleotide
tcttgcatcctgccgactctgccgcttaaaccctg

SEQ ID NO: 187280 - DNA, 35 bp, Artificial Sequence
  Synthetic oligonucleotide
taccgctgcccagttcccgccggtaccattcattg

SEQ ID NO: 187281 - DNA, 35 bp, Artificial Sequence
  Synthetic oligonucleotide
ttcgccggtacctctgacgcgcccctactacgttg

SEQ ID NO: 187282 - DNA, 35 bp, Artificial Sequence
  Synthetic oligonucleotide
accgccggacactgccccctcaccacaactggttg

SEQ ID NO: 187283 - DNA, 35 bp, Artificial Sequence
  Synthetic oligonucleotide
tctcggacgcccctagtaaatctcgcctgacccat

SEQ ID NO: 187284 - DNA, 35 bp, Artificial Sequence
  Synthetic oligonucleotide
taagtgctgctccatcgcgcggaaaacatccccat

SEQ ID NO: 187285 - DNA, 35 bp, Artificial Sequence
  Synthetic oligonucleotide
gacctcgcgcagttcgctttatttcgtaatcccat

SEQ ID NO: 187286 - DNA, 35 bp, Artificial Sequence
  Synthetic oligonucleotide
tacctcgccctgactgtaaatacacctccattcat

SEQ ID NO: 187287 - DNA, 35 bp, Artificial Sequence
  Synthetic oligonucleotide
tcaccatcctctcgctgtccatcgcggtctactat

SEQ ID NO: 187288 - DNA, 35 bp, Artificial Sequence
  Synthetic oligonucleotide
tcatcgttgttcggccctcccacgcgctgttcact

SEQ ID NO: 187289 - DNA, 35 bp, Artificial Sequence
  Synthetic oligonucleotide
acacatccgaacgtgaatccaccactcgctatact

SEQ ID NO: 187290 - DNA, 35 bp, Artificial Sequence
  Synthetic oligonucleotide
gccgacccgccatgacccgtgtccattcaccacct

SEQ ID NO: 187291 - DNA, 35 bp, Artificial Sequence
  Synthetic oligonucleotide
aaggcgccttccaggctgaatcgccacactcccct

SEQ ID NO: 187292 - DNA, 35 bp, Artificial Sequence
  Synthetic oligonucleotide
tccgaccaccctagcgtatattcgccctgattcct

SEQ ID NO: 187293 - DNA, 35 bp, Artificial Sequence
  Synthetic oligonucleotide
tgatgcatgtggaggaagggtaatgaagtaatgct

SEQ ID NO: 187294 - DNA, 35 bp, Artificial Sequence
  Synthetic oligonucleotide
tgtcgccatagtagccacagtgcctgctccactct

SEQ ID NO: 187295 - DNA, 35 bp, Artificial Sequence
  Synthetic oligonucleotide
agagcggcccgtggagcgtgcgtgccttcccctct

SEQ ID NO: 187296 - DNA, 35 bp, Artificial Sequence
  Synthetic oligonucleotide
gtgcccccgccttctcactcatgttattcgtgtct

SEQ ID NO: 187297 - DNA, 35 bp, Artificial Sequence
  Synthetic oligonucleotide
ttcggagcctcgccttcattggtaccaatcgttct

SEQ ID NO: 187298 - DNA, 35 bp, Artificial Sequence
  Synthetic oligonucleotide
agtgcggaaggggagagcaagttgggggagaccgt

SEQ ID NO: 187299 - DNA, 35 bp, Artificial Sequence
  Synthetic oligonucleotide
gggttgcctaaccacatgttcccgctgcctcccgt

SEQ ID NO: 187300 - DNA, 35 bp, Artificial Sequence
  Synthetic oligonucleotide
gcccgccattggttcgtcaaagttcactcgtccgt

SEQ ID NO: 187301 - DNA, 35 bp, Artificial Sequence
  Synthetic oligonucleotide
tcccgacattcggttgtattctcacgccccttcgt

SEQ ID NO: 187302 - DNA, 35 bp, Artificial Sequence
  Synthetic oligonucleotide
agccggttgtcctcttgcccgcttcactctccggt

SEQ ID NO: 187303 - DNA, 35 bp, Artificial Sequence
  Synthetic oligonucleotide
tgaccgatttcgcgttgtctttctctcttcttggt

SEQ ID NO: 187304 - DNA, 35 bp, Artificial Sequence
  Synthetic oligonucleotide
gggtcccggtgcctggttaatgtctcttgtcctgt

SEQ ID NO: 187305 - DNA, 35 bp, Artificial Sequence
  Synthetic oligonucleotide
taacagcggtccgtttttcttaccgttccccttgt

SEQ ID NO: 187306 - DNA, 35 bp, Artificial Sequence
  Synthetic oligonucleotide
tcgcactccctccggctgcatccgacctcccactt

SEQ ID NO: 187307 - DNA, 35 bp, Artificial Sequence
  Synthetic oligonucleotide
tgccctacccggacgcaccttcgttgttccccctt

SEQ ID NO: 187308 - DNA, 35 bp, Artificial Sequence
  Synthetic oligonucleotide
aaaccgtagttgcggcgagacctcatcctcccctt

SEQ ID NO: 187309 - DNA, 35 bp, Artificial Sequence
  Synthetic oligonucleotide
aaacccctccgcgtgccatccctaaggccactgtt

SEQ ID NO: 187310 - DNA, 35 bp, Artificial Sequence
  Synthetic oligonucleotide
tctatccccgtcctgcttcctctaacggccttgtt

SEQ ID NO: 187311 - DNA, 35 bp, Artificial Sequence
  Synthetic oligonucleotide
atgccctcaacgtgtttttcttggcatgcaccttt

SEQ ID NO: 187312 - DNA, 35 bp, Artificial Sequence
  Synthetic oligonucleotide
tgatgtgcctgatcttcctttggtccgcccccttt

SEQ ID NO: 187313 - DNA, 35 bp, Artificial Sequence
  Synthetic oligonucleotide
attgacgcctcgaagttagccctttcactcgcttt

SEQ ID NO: 187314 - DNA, 35 bp, Artificial Sequence
  Synthetic oligonucleotide
cccccgtacccgcctctgtcgcattcgatgctttt

SEQ ID NO: 187315 - DNA, 36 bp, Artificial Sequence
  Synthetic oligonucleotide
gaaggtggaggacggccaaaaggagatctcgtacaa

SEQ ID NO: 187316 - DNA, 35 bp, Artificial Sequence
  Synthetic oligonucleotide
ccagggggggagggaaataggggaaacacgagcaa

SEQ ID NO: 187317 - DNA, 36 bp, Artificial Sequence
  Synthetic oligonucleotide
accctgttcctcactctgcatcgactttctaccgaa

SEQ ID NO: 187318 - DNA, 35 bp, Artificial Sequence
  Synthetic oligonucleotide
tgagcacctggcgtggggggaaaggtggggaggaa

SEQ ID NO: 187319 - DNA, 36 bp, Artificial Sequence
  Synthetic oligonucleotide
tacttgccgggggggggtaaaatgctggggagggaa

SEQ ID NO: 187320 - DNA, 36 bp, Artificial Sequence
  Synthetic oligonucleotide
gcactcgttgcttgccctatccgcctactcgtggaa

SEQ ID NO: 187321 - DNA, 36 bp, Artificial Sequence
  Synthetic oligonucleotide
gcacgacgactagtctcgttcaccttcatagcttaa

SEQ ID NO: 187322 - DNA, 35 bp, Artificial Sequence
  Synthetic oligonucleotide
ttcgtcgatctgccccgcttgctttccctggaaca

SEQ ID NO: 187323 - DNA, 35 bp, Artificial Sequence
  Synthetic oligonucleotide
actcgatcgggctgagcatgttctacccgcccaca

SEQ ID NO: 187324 - DNA, 36 bp, Artificial Sequence
  Synthetic oligonucleotide
tgcataacatcaaccgcgtactgggccaccatcaca

SEQ ID NO: 187325 - DNA, 35 bp, Artificial Sequence
  Synthetic oligonucleotide
atcccgccccaactgcctttcatatcaaccgtaca

SEQ ID NO: 187326 - DNA, 36 bp, Artificial Sequence
  Synthetic oligonucleotide
gccaactcacagtctatcatcactctatcctcacca

SEQ ID NO: 187327 - DNA, 35 bp, Artificial Sequence
  Synthetic oligonucleotide
gacacagttgaattggtctcgcatctcttccccca

SEQ ID NO: 187328 - DNA, 36 bp, Artificial Sequence
  Synthetic oligonucleotide
ggtcgcgaagtcttgttccgtccgcccttgatccca

SEQ ID NO: 187329 - DNA, 35 bp, Artificial Sequence
  Synthetic oligonucleotide
tgaccacgccatactgcttgtctctctccaggcca

SEQ ID NO: 187330 - DNA, 36 bp, Artificial Sequence
  Synthetic oligonucleotide
tccgcgctttcctcctcgatctgaccatagtggcca

SEQ ID NO: 187331 - DNA, 36 bp, Artificial Sequence
  Synthetic oligonucleotide
atgtcagtccgtatgcgccgcgtccacgaacctcca

SEQ ID NO: 187332 - DNA, 36 bp, Artificial Sequence
  Synthetic oligonucleotide
tccatcgcttggtaatggtaattcattctcgctcca

SEQ ID NO: 187333 - DNA, 36 bp, Artificial Sequence
  Synthetic oligonucleotide
acatcccatccgacatagcttgcggaccgctctcca

SEQ ID NO: 187334 - DNA, 35 bp, Artificial Sequence
  Synthetic oligonucleotide
tcgcgcccctcgtatttactcccgtccccgttcca

SEQ ID NO: 187335 - DNA, 36 bp, Artificial Sequence
  Synthetic oligonucleotide
agcgcatcccttccttgctctatcctcgccgtagca

SEQ ID NO: 187336 - DNA, 36 bp, Artificial Sequence
  Synthetic oligonucleotide
acgcaccttctcttctggtccgtgctttgtttcgca

SEQ ID NO: 187337 - DNA, 36 bp, Artificial Sequence
  Synthetic oligonucleotide
actcaacggtcagatcgtttgccccccacactatca

SEQ ID NO: 187338 - DNA, 36 bp, Artificial Sequence
  Synthetic oligonucleotide
tctgaggccccaatgtcttgttcaactacttcctca

SEQ ID NO: 187339 - DNA, 36 bp, Artificial Sequence
  Synthetic oligonucleotide
gtcgtctccgtcctgacccgccacgtgcccgtctca

SEQ ID NO: 187340 - DNA, 35 bp, Artificial Sequence
  Synthetic oligonucleotide
gccccccatgacgtcatgcgctccactccggttca

SEQ ID NO: 187341 - DNA, 35 bp, Artificial Sequence
  Synthetic oligonucleotide
tcgcacttccatcctgtctatccttcgcctgttca

SEQ ID NO: 187342 - DNA, 35 bp, Artificial Sequence
  Synthetic oligonucleotide
actcgaccaccctgcgttacagcttaactctttca

SEQ ID NO: 187343 - DNA, 36 bp, Artificial Sequence
  Synthetic oligonucleotide
tctcaatcgctgactacatgaaccaccgctctttca

SEQ ID NO: 187344 - DNA, 37 bp, Artificial Sequence
  Synthetic oligonucleotide
gctgggaggagtgggggtggtaattgacaggaacaga

SEQ ID NO: 187345 - DNA, 37 bp, Artificial Sequence
  Synthetic oligonucleotide
ttctcccccctctgcccaacgtatagacaggtccaga

SEQ ID NO: 187346 - DNA, 37 bp, Artificial Sequence
  Synthetic oligonucleotide
gaggcgggggggatgcgcggggtggaggtaatataga

SEQ ID NO: 187347 - DNA, 37 bp, Artificial Sequence
  Synthetic oligonucleotide
tgtaacgcctcgccctgtctattcatccgtgccacga

SEQ ID NO: 187348 - DNA, 37 bp, Artificial Sequence
  Synthetic oligonucleotide
aactgtcaccagtaggcttaataccctgttcccccga

SEQ ID NO: 187349 - DNA, 36 bp, Artificial Sequence
  Synthetic oligonucleotide
acacctgccccaccaagtggcgacctgcctccgcga

SEQ ID NO: 187350 - DNA, 37 bp, Artificial Sequence
  Synthetic oligonucleotide
actgacaccctcgccgtgcgtccgcgttgctccgcga

SEQ ID NO: 187351 - DNA, 36 bp, Artificial Sequence
  Synthetic oligonucleotide
gaacattcccccattggctctcagtcctcaaaagga

SEQ ID NO: 187352 - DNA, 36 bp, Artificial Sequence
  Synthetic oligonucleotide
gatgggttcgcgcatggggtggcgtgggtgggcgga

SEQ ID NO: 187353 - DNA, 35 bp, Artificial Sequence
  Synthetic oligonucleotide
atgccgccctgcctgcaccgagcctttctctcgga

SEQ ID NO: 187354 - DNA, 37 bp, Artificial Sequence
  Synthetic oligonucleotide
cacggagtgaaggggaggagggtaggtagtaacggga

SEQ ID NO: 187355 - DNA, 37 bp, Artificial Sequence
  Synthetic oligonucleotide
gaacggatagcacgggtggaggggaatggtagtggga

SEQ ID NO: 187356 - DNA, 37 bp, Artificial Sequence
  Synthetic oligonucleotide
actacgccgccgccgctctcttactccgacccctgga

SEQ ID NO: 187357 - DNA, 37 bp, Artificial Sequence
  Synthetic oligonucleotide
tcagggaggagaggggtatgatgggagggttcgtgga

SEQ ID NO: 187358 - DNA, 36 bp, Artificial Sequence
  Synthetic oligonucleotide
accgctgcccccctcgttcccattgtacgtccatga

SEQ ID NO: 187359 - DNA, 36 bp, Artificial Sequence
  Synthetic oligonucleotide
tcatcccccctgcgctctatgatcctggcatcatga

SEQ ID NO: 187360 - DNA, 37 bp, Artificial Sequence
  Synthetic oligonucleotide
ggaagggaagacggggaggaaacttcagctgagatga

SEQ ID NO: 187361 - DNA, 38 bp, Artificial Sequence
  Synthetic oligonucleotide
gaaatgccgggcgggtgggattgggtggtcaccgatga

SEQ ID NO: 187362 - DNA, 36 bp, Artificial Sequence
  Synthetic oligonucleotide
gtgatggggaaatgaggtatgtggcggaatggatga

SEQ ID NO: 187363 - DNA, 38 bp, Artificial Sequence
  Synthetic oligonucleotide
gatgcggaagggggggcgggtgcagccggacttactga

SEQ ID NO: 187364 - DNA, 37 bp, Artificial Sequence
  Synthetic oligonucleotide
tccgcaacggtctacttccttacgtactgccacctga

SEQ ID NO: 187365 - DNA, 36 bp, Artificial Sequence
  Synthetic oligonucleotide
gcaccttgcgcttatctgggctccctctattcctga

SEQ ID NO: 187366 - DNA, 38 bp, Artificial Sequence
  Synthetic oligonucleotide
gttgccgccaggcattattgtaccgacccctgttctga

SEQ ID NO: 187367 - DNA, 36 bp, Artificial Sequence
  Synthetic oligonucleotide
gtcctgttcgccgctatgcccccctgagccacgtga

SEQ ID NO: 187368 - DNA, 37 bp, Artificial Sequence
  Synthetic oligonucleotide
tcgatagccagatattccaccgctctgttccctgtga

SEQ ID NO: 187369 - DNA, 37 bp, Artificial Sequence
  Synthetic oligonucleotide
atcgcgcccgactctctcttggggctccctcttgtga

SEQ ID NO: 187370 - DNA, 37 bp, Artificial Sequence
  Synthetic oligonucleotide
ggtgccgatctcctgcccttactgaccctcccattga

SEQ ID NO: 187371 - DNA, 36 bp, Artificial Sequence
  Synthetic oligonucleotide
gagtacccccacgcctgttcaacacagtcctattga

SEQ ID NO: 187372 - DNA, 38 bp, Artificial Sequence
  Synthetic oligonucleotide
agcggtgtagccgtgctatccgtgccttgcccccttga

SEQ ID NO: 187373 - DNA, 38 bp, Artificial Sequence
  Synthetic oligonucleotide
tgcctgtgtcttatttcccttacgtgccctgttcttga

SEQ ID NO: 187374 - DNA, 38 bp, Artificial Sequence
  Synthetic oligonucleotide
acctctccgacgcatgtatctccttgtgcccccgttga

SEQ ID NO: 187375 - DNA, 37 bp, Artificial Sequence
  Synthetic oligonucleotide
acgttccccgccctcgagcacactttcacgccgttga

SEQ ID NO: 187376 - DNA, 37 bp, Artificial Sequence
  Synthetic oligonucleotide
ttggtcagctgtaatcttgtccctccatgcctgttga

SEQ ID NO: 187377 - DNA, 38 bp, Artificial Sequence
  Synthetic oligonucleotide
ttggccccccctttttttgttgcagtgtccgtctttga

SEQ ID NO: 187378 - DNA, 37 bp, Artificial Sequence
  Synthetic oligonucleotide
acgccacctgcaatcctctcaccacggctcattttga

SEQ ID NO: 187379 - DNA, 36 bp, Artificial Sequence
  Synthetic oligonucleotide
gtttgtcgccgccgttttcaaccctcattcttttga

SEQ ID NO: 187380 - DNA, 36 bp, Artificial Sequence
  Synthetic oligonucleotide
gggaacgggtggcggacgaaagcagggtgcaggata

SEQ ID NO: 187381 - DNA, 36 bp, Artificial Sequence
  Synthetic oligonucleotide
gcccaccacacctaacgccggtgctacagtatccta

SEQ ID NO: 187382 - DNA, 36 bp, Artificial Sequence
  Synthetic oligonucleotide
gtttcgcattgtgcacttagtcattcgcttctccta

SEQ ID NO: 187383 - DNA, 35 bp, Artificial Sequence
  Synthetic oligonucleotide
gcacacgcctcactggacctgtatgcaccattcta

SEQ ID NO: 187384 - DNA, 36 bp, Artificial Sequence
  Synthetic oligonucleotide
tacccctcgccggacgagagtcctctgttacttcta

SEQ ID NO: 187385 - DNA, 35 bp, Artificial Sequence
  Synthetic oligonucleotide
acgctccacatgtccatccctcggtctgttcctta

SEQ ID NO: 187386 - DNA, 36 bp, Artificial Sequence
  Synthetic oligonucleotide
gcctgtgacagggcgggggggacttagggtttgtta

SEQ ID NO: 187387 - DNA, 35 bp, Artificial Sequence
  Synthetic oligonucleotide
ttttaacccccgctgccttcccccagagtgaacac

SEQ ID NO: 187388 - DNA, 35 bp, Artificial Sequence
  Synthetic oligonucleotide
tgcgaaccacccattttattaagatctgttaacac

SEQ ID NO: 187389 - DNA, 35 bp, Artificial Sequence
  Synthetic oligonucleotide
tgttacccgccctctgaattattggcgctccacac

SEQ ID NO: 187390 - DNA, 35 bp, Artificial Sequence
  Synthetic oligonucleotide
tcactccgtactagccaaatggatctcgccaccac

SEQ ID NO: 187391 - DNA, 35 bp, Artificial Sequence
  Synthetic oligonucleotide
gttacactgcatcttctgcgcttatgctcctgcac

SEQ ID NO: 187392 - DNA, 34 bp, Artificial Sequence
  Synthetic oligonucleotide
actactcgcttgtccctccccggtgccccgagac

SEQ ID NO: 187393 - DNA, 35 bp, Artificial Sequence
  Synthetic oligonucleotide
taaaggggcgccacttgcatctgtacgtcctctac

SEQ ID NO: 187394 - DNA, 35 bp, Artificial Sequence
  Synthetic oligonucleotide
acccccctgccacctaatgcgcctgttttcgcacc

SEQ ID NO: 187395 - DNA, 35 bp, Artificial Sequence
  Synthetic oligonucleotide
gcctacctgtccggtggaccctactgcctttcacc

SEQ ID NO: 187396 - DNA, 35 bp, Artificial Sequence
  Synthetic oligonucleotide
tcccatcccacgggtccacagagccgtctccgacc

SEQ ID NO: 187397 - DNA, 35 bp, Artificial Sequence
  Synthetic oligonucleotide
agccgaacctgataggcttacgcaccacttttacc

SEQ ID NO: 187398 - DNA, 35 bp, Artificial Sequence
  Synthetic oligonucleotide
ttcacgtgccctcgctttgcagacatgtttgcccc

SEQ ID NO: 187399 - DNA, 35 bp, Artificial Sequence
  Synthetic oligonucleotide
ttcccggtgaagatgtgttctgcccttccgcgccc

SEQ ID NO: 187400 - DNA, 35 bp, Artificial Sequence
  Synthetic oligonucleotide
tactccactccgaccttatgcgttccatcttgccc

SEQ ID NO: 187401 - DNA, 35 bp, Artificial Sequence
  Synthetic oligonucleotide
gcccgaacctgctcgcctgtattattgcatgtccc

SEQ ID NO: 187402 - DNA, 35 bp, Artificial Sequence
  Synthetic oligonucleotide
gaagccgcgtgtcctcggtcacatcccctatcgcc

SEQ ID NO: 187403 - DNA, 35 bp, Artificial Sequence
  Synthetic oligonucleotide
gttccacagacttttgttgcgctttcccagttgcc

SEQ ID NO: 187404 - DNA, 35 bp, Artificial Sequence
  Synthetic oligonucleotide
gccggttgtcactcacgggcgctcttggtccatcc

SEQ ID NO: 187405 - DNA, 35 bp, Artificial Sequence
  Synthetic oligonucleotide
tccagtactcatcttgttgcagctcacttacttcc

SEQ ID NO: 187406 - DNA, 35 bp, Artificial Sequence
  Synthetic oligonucleotide
ttacttgcaccacccctcagtctctgaagcgttcc

SEQ ID NO: 187407 - DNA, 35 bp, Artificial Sequence
  Synthetic oligonucleotide
gcctgccacgactatacaaccgttaacactgccgc

SEQ ID NO: 187408 - DNA, 35 bp, Artificial Sequence
  Synthetic oligonucleotide
agccctaccacatacataatccactcgcaccgcgc

SEQ ID NO: 187409 - DNA, 35 bp, Artificial Sequence
  Synthetic oligonucleotide
taacgtatacgttggctctatattacccctctcgc

SEQ ID NO: 187410 - DNA, 35 bp, Artificial Sequence
  Synthetic oligonucleotide
tccccccgcccaaatttctcaccttgttgtttcgc

SEQ ID NO: 187411 - DNA, 35 bp, Artificial Sequence
  Synthetic oligonucleotide
tgcctcatgcctagcccggtttcgctctttcatgc

SEQ ID NO: 187412 - DNA, 35 bp, Artificial Sequence
  Synthetic oligonucleotide
gcccgcacttgttcaaacgttccccgtctacttgc

SEQ ID NO: 187413 - DNA, 35 bp, Artificial Sequence
  Synthetic oligonucleotide
ggaaccagctttgccgaatatatgcctccccaatc

SEQ ID NO: 187414 - DNA, 35 bp, Artificial Sequence
  Synthetic oligonucleotide
gtgcatactgtctgtccggtcaagtcgccgccatc

SEQ ID NO: 187415 - DNA, 35 bp, Artificial Sequence
  Synthetic oligonucleotide
acccatcctcgggccgacgagcgcggtcttccatc

SEQ ID NO: 187416 - DNA, 35 bp, Artificial Sequence
  Synthetic oligonucleotide
ttcctgcccccaccgtagttttaccaagtcttatc

SEQ ID NO: 187417 - DNA, 35 bp, Artificial Sequence
  Synthetic oligonucleotide
accgaccgaccgacccatgactaaaaaatccactc

SEQ ID NO: 187418 - DNA, 35 bp, Artificial Sequence
  Synthetic oligonucleotide
gcacctttccctatcgctatgcaccggctatactc

SEQ ID NO: 187419 - DNA, 35 bp, Artificial Sequence
  Synthetic oligonucleotide
atccgctcgttgccgtttcttctcgacgcctactc

SEQ ID NO: 187420 - DNA, 35 bp, Artificial Sequence
  Synthetic oligonucleotide
gttagtgccctgtccagtttctgcgtctcctactc

SEQ ID NO: 187421 - DNA, 35 bp, Artificial Sequence
  Synthetic oligonucleotide
tgtcacgcatgatgtctgccgtcccttactccctc

SEQ ID NO: 187422 - DNA, 35 bp, Artificial Sequence
  Synthetic oligonucleotide
attacgcagccttacccctgccgtgtcactatctc

SEQ ID NO: 187423 - DNA, 35 bp, Artificial Sequence
  Synthetic oligonucleotide
tacattggaagtgtgcctgcccatcccttgctctc

SEQ ID NO: 187424 - DNA, 35 bp, Artificial Sequence
  Synthetic oligonucleotide
tcgttgggcacataccgtattctgtcctttgtctc

SEQ ID NO: 187425 - DNA, 35 bp, Artificial Sequence
  Synthetic oligonucleotide
tcgatcgcactgcttcccgcccatattcccaggtc

SEQ ID NO: 187426 - DNA, 35 bp, Artificial Sequence
  Synthetic oligonucleotide
ttgtccagccacatttacagcgcggccccgaattc

SEQ ID NO: 187427 - DNA, 35 bp, Artificial Sequence
  Synthetic oligonucleotide
tccaacgccacagtaccacccgttctccggaattc

SEQ ID NO: 187428 - DNA, 35 bp, Artificial Sequence
  Synthetic oligonucleotide
tgcactcccgtccgtctctagcttagcgtacattc

SEQ ID NO: 187429 - DNA, 35 bp, Artificial Sequence
  Synthetic oligonucleotide
tagatcgtactatcctctttgctctcgaggccttc

SEQ ID NO: 187430 - DNA, 34 bp, Artificial Sequence
  Synthetic oligonucleotide
aactctccacgcgctaacattaaatcgggccttc

SEQ ID NO: 187431 - DNA, 35 bp, Artificial Sequence
  Synthetic oligonucleotide
actgggtgggcgggcaataatgtttgggctgaaag

SEQ ID NO: 187432 - DNA, 35 bp, Artificial Sequence
  Synthetic oligonucleotide
ttgatggcggacgggtcgggggtggagctgggtag

SEQ ID NO: 187433 - DNA, 35 bp, Artificial Sequence
  Synthetic oligonucleotide
gtcccccccacagtacctacctcttcggtacaccg

SEQ ID NO: 187434 - DNA, 35 bp, Artificial Sequence
  Synthetic oligonucleotide
gttgcaccctcacgacaatacacctaacccctccg

SEQ ID NO: 187435 - DNA, 35 bp, Artificial Sequence
  Synthetic oligonucleotide
attcccctcagccatcgccgcctcatagtcatgcg

SEQ ID NO: 187436 - DNA, 35 bp, Artificial Sequence
  Synthetic oligonucleotide
tcagctcactggtcccgctcggccgccaccactcg

SEQ ID NO: 187437 - DNA, 35 bp, Artificial Sequence
  Synthetic oligonucleotide
tagcccgccacggctccgatccaccgcgtcactcg

SEQ ID NO: 187438 - DNA, 35 bp, Artificial Sequence
  Synthetic oligonucleotide
agtgccaccgcacacttacaccaactgtactttcg

SEQ ID NO: 187439 - DNA, 35 bp, Artificial Sequence
  Synthetic oligonucleotide
ttgggggaggaaaaacaaacaaggagactaagagg

SEQ ID NO: 187440 - DNA, 35 bp, Artificial Sequence
  Synthetic oligonucleotide
aacggtgggggcaaactaggaaggacaaaaagcgg

SEQ ID NO: 187441 - DNA, 35 bp, Artificial Sequence
  Synthetic oligonucleotide
agatctggcggggggagtaaggacgggagaggggg

SEQ ID NO: 187442 - DNA, 35 bp, Artificial Sequence
  Synthetic oligonucleotide
tgtcagaaggggattaggaaggggtggaggatatg

SEQ ID NO: 187443 - DNA, 35 bp, Artificial Sequence
  Synthetic oligonucleotide
attcgctgccgtctcagtaatatctcacctcactg

SEQ ID NO: 187444 - DNA, 35 bp, Artificial Sequence
  Synthetic oligonucleotide
gcgctcaccttcgccctcgtcccatgtccattgtg

SEQ ID NO: 187445 - DNA, 35 bp, Artificial Sequence
  Synthetic oligonucleotide
acactcccgattcgctacggtactccctctccttg

SEQ ID NO: 187446 - DNA, 35 bp, Artificial Sequence
  Synthetic oligonucleotide
acacaccctacgcccgtcccccctatctgcggaat

SEQ ID NO: 187447 - DNA, 35 bp, Artificial Sequence
  Synthetic oligonucleotide
gggacgggagggaagcaagggaggtcagcagccat

SEQ ID NO: 187448 - DNA, 35 bp, Artificial Sequence
  Synthetic oligonucleotide
actgtcctccgcctacatttttatcgcactggcat

SEQ ID NO: 187449 - DNA, 35 bp, Artificial Sequence
  Synthetic oligonucleotide
tcgacacatcctacagcgtccttcccgatcctcat

SEQ ID NO: 187450 - DNA, 35 bp, Artificial Sequence
  Synthetic oligonucleotide
gccacagtccgcctgtactccatctgctatttcat

SEQ ID NO: 187451 - DNA, 35 bp, Artificial Sequence
  Synthetic oligonucleotide
gaaacaggactggtggcggtaaggtggggaacgat

SEQ ID NO: 187452 - DNA, 35 bp, Artificial Sequence
  Synthetic oligonucleotide
gtgaagggacacagggaaaggggctacgaaatgat

SEQ ID NO: 187453 - DNA, 35 bp, Artificial Sequence
  Synthetic oligonucleotide
gttccgcctcccttgcgaagatcgccacatgttat

SEQ ID NO: 187454 - DNA, 36 bp, Artificial Sequence
  Synthetic oligonucleotide
acaccacgacgccatctcactacgccaggaatcact

SEQ ID NO: 187455 - DNA, 35 bp, Artificial Sequence
  Synthetic oligonucleotide
gcgcacctctcgctatacacgcatggatcaaccct

SEQ ID NO: 187456 - DNA, 35 bp, Artificial Sequence
  Synthetic oligonucleotide
atcgaggtcgtaatgcttcccgccaactgtaccct

SEQ ID NO: 187457 - DNA, 35 bp, Artificial Sequence
  Synthetic oligonucleotide
tatgcgcctcgatttccaggaacattgccctccct

SEQ ID NO: 187458 - DNA, 35 bp, Artificial Sequence
  Synthetic oligonucleotide
gtccgtcgcccacaaatctttaaggcgtgctccct

SEQ ID NO: 187459 - DNA, 35 bp, Artificial Sequence
  Synthetic oligonucleotide
agcgcgtgcgcagttgtacagtcttcggcccctct

SEQ ID NO: 187460 - DNA, 35 bp, Artificial Sequence
  Synthetic oligonucleotide
tgtgcgttgcatcggatctccccgcttctcgctct

SEQ ID NO: 187461 - DNA, 35 bp, Artificial Sequence
  Synthetic oligonucleotide
tcaccccccatgttaatgatgcctggtccctctct

SEQ ID NO: 187462 - DNA, 35 bp, Artificial Sequence
  Synthetic oligonucleotide
gaactgatcgccgccctccaagtgtttctgcttct

SEQ ID NO: 187463 - DNA, 35 bp, Artificial Sequence
  Synthetic oligonucleotide
acttacgctctggtacaagccccgcgatatcttct

SEQ ID NO: 187464 - DNA, 35 bp, Artificial Sequence
  Synthetic oligonucleotide
ggggcctggcgcactgtccctcctttatccgttct

SEQ ID NO: 187465 - DNA, 35 bp, Artificial Sequence
  Synthetic oligonucleotide
ttagtggtcgcaccgccagcccgtgcttcctttct

SEQ ID NO: 187466 - DNA, 35 bp, Artificial Sequence
  Synthetic oligonucleotide
atggaaggtgtgggtagcaataaggggggagaggt

SEQ ID NO: 187467 - DNA, 35 bp, Artificial Sequence
  Synthetic oligonucleotide
tcaaccactctctacccgtccctttaggttctggt

SEQ ID NO: 187468 - DNA, 35 bp, Artificial Sequence
  Synthetic oligonucleotide
tccaccgacccgctatatctgcactcgattcctgt

SEQ ID NO: 187469 - DNA, 35 bp, Artificial Sequence
  Synthetic oligonucleotide
tgttgctatgctgcgttcgtcttgcagctcccctt

SEQ ID NO: 187470 - DNA, 35 bp, Artificial Sequence
  Synthetic oligonucleotide
gtcaatccgcgatctcccgttaccatgctttgctt

SEQ ID NO: 187471 - DNA, 35 bp, Artificial Sequence
  Synthetic oligonucleotide
agcccccgttgctctcttgcctatgcccagtcgtt

SEQ ID NO: 187472 - DNA, 35 bp, Artificial Sequence
  Synthetic oligonucleotide
gcacaccgcaggcgcactttcccggtcactcggtt

SEQ ID NO: 187473 - DNA, 35 bp, Artificial Sequence
  Synthetic oligonucleotide
gcgtgtccccggtctgtcgtaacttactcttcttt

SEQ ID NO: 187474 - DNA, 35 bp, Artificial Sequence
  Synthetic oligonucleotide
ggttacctccgccggctccaactcaccacgctttt

SEQ ID NO: 187475 - DNA, 36 bp, Artificial Sequence
  Synthetic oligonucleotide
agtgtgtgaagaagggtatggggtggtggaaaaaaa

SEQ ID NO: 187476 - DNA, 36 bp, Artificial Sequence
  Synthetic oligonucleotide
ttgtcgccacaacggcctttcctctgctgatccaaa

SEQ ID NO: 187477 - DNA, 36 bp, Artificial Sequence
  Synthetic oligonucleotide
gtgtcgtcgcctagctctgtcacgtcattccttaaa

SEQ ID NO: 187478 - DNA, 36 bp, Artificial Sequence
  Synthetic oligonucleotide
tagggtgagggcggagtggtgtgggaggtaaggcaa

SEQ ID NO: 187479 - DNA, 36 bp, Artificial Sequence
  Synthetic oligonucleotide
accgcctcgtccccatggtcccttccctatctgcaa

SEQ ID NO: 187480 - DNA, 35 bp, Artificial Sequence
  Synthetic oligonucleotide
ttcgtctcgtccgtgtccccgccccattgtctgaa

SEQ ID NO: 187481 - DNA, 36 bp, Artificial Sequence
  Synthetic oligonucleotide
gagggggtatggattgggaagaacgggtggtattaa

SEQ ID NO: 187482 - DNA, 35 bp, Artificial Sequence
  Synthetic oligonucleotide
gtacacatgccctcacttccctgataactaacaca

SEQ ID NO: 187483 - DNA, 36 bp, Artificial Sequence
  Synthetic oligonucleotide
gacccagactgccgtaggtagtatcgtgccccccca

SEQ ID NO: 187484 - DNA, 35 bp, Artificial Sequence
  Synthetic oligonucleotide
accctgcgctatacattgtttcagcgttactccca

SEQ ID NO: 187485 - DNA, 35 bp, Artificial Sequence
  Synthetic oligonucleotide
acgacacttgctgttgtttcgcccctggcctccca

SEQ ID NO: 187486 - DNA, 35 bp, Artificial Sequence
  Synthetic oligonucleotide
tacacctcacgatattgacctgccccctcgtgcca

SEQ ID NO: 187487 - DNA, 34 bp, Artificial Sequence
  Synthetic oligonucleotide
atcccaatccactcaccgacctgtaaagactcca

SEQ ID NO: 187488 - DNA, 35 bp, Artificial Sequence
  Synthetic oligonucleotide
gtgcctagcttccatggcgcccatccgactttcca

SEQ ID NO: 187489 - DNA, 35 bp, Artificial Sequence
  Synthetic oligonucleotide
aaatagggagtgcgggcgtggggcgggtaagggca

SEQ ID NO: 187490 - DNA, 35 bp, Artificial Sequence
  Synthetic oligonucleotide
tgtccacccttgccaatgtaacatctaaagatgca

SEQ ID NO: 187491 - DNA, 36 bp, Artificial Sequence
  Synthetic oligonucleotide
tgcggacggcctctgctccctgattatttcatctca

SEQ ID NO: 187492 - DNA, 36 bp, Artificial Sequence
  Synthetic oligonucleotide
gcagacaacgcatgccctgcgtattttaccatttca

SEQ ID NO: 187493 - DNA, 36 bp, Artificial Sequence
  Synthetic oligonucleotide
attgtcaggtgtcattcttcgctcgtccccttttca

SEQ ID NO: 187494 - DNA, 35 bp, Artificial Sequence
  Synthetic oligonucleotide
tgcatggtccgcctacaccttcgtaccggttttca

SEQ ID NO: 187495 - DNA, 36 bp, Artificial Sequence
  Synthetic oligonucleotide
tagaacattgggagggagggagggtccgattgcaga

SEQ ID NO: 187496 - DNA, 37 bp, Artificial Sequence
  Synthetic oligonucleotide
tgcacaacaagggggcaagagggaactggtgtagaga

SEQ ID NO: 187497 - DNA, 37 bp, Artificial Sequence
  Synthetic oligonucleotide
tacgcgggcgggttgaaatgggacgtaggaagggaga

SEQ ID NO: 187498 - DNA, 37 bp, Artificial Sequence
  Synthetic oligonucleotide
taaacttgcgggaaagggtgggaagggctaaatgaga

SEQ ID NO: 187499 - DNA, 37 bp, Artificial Sequence
  Synthetic oligonucleotide
aagtaatggagagggggagaaggaagaggtcttgaga

SEQ ID NO: 187500 - DNA, 37 bp, Artificial Sequence
  Synthetic oligonucleotide
acgagggtgggtgcatttggtttggagagcgggacga

SEQ ID NO: 187501 - DNA, 37 bp, Artificial Sequence
  Synthetic oligonucleotide
agcgggggtggagggggaagtgatctgagatggacga

SEQ ID NO: 187502 - DNA, 37 bp, Artificial Sequence
  Synthetic oligonucleotide
accgcgccgaaattgtctcgcccaacaccatccccga

SEQ ID NO: 187503 - DNA, 37 bp, Artificial Sequence
  Synthetic oligonucleotide
gctcacgccactgccaggtctcccgacgatatcccga

SEQ ID NO: 187504 - DNA, 37 bp, Artificial Sequence
  Synthetic oligonucleotide
tgcaacccctgatgcacattattacgctgccttccga

SEQ ID NO: 187505 - DNA, 37 bp, Artificial Sequence
  Synthetic oligonucleotide
aaatgagagggagggttgggagccagaggggtcgcga

SEQ ID NO: 187506 - DNA, 37 bp, Artificial Sequence
  Synthetic oligonucleotide
atgcctcgtaacatcaagcgtacattccctccctcga

SEQ ID NO: 187507 - DNA, 37 bp, Artificial Sequence
  Synthetic oligonucleotide
tattccccgtagcgtcgcgtttctgtccccgcctcga

SEQ ID NO: 187508 - DNA, 37 bp, Artificial Sequence
  Synthetic oligonucleotide
agacaagactccagctgcgcttaatcgcccctctcga

SEQ ID NO: 187509 - DNA, 37 bp, Artificial Sequence
  Synthetic oligonucleotide
tccacggtagatcgcccttccgcccttgtcaattcga

SEQ ID NO: 187510 - DNA, 37 bp, Artificial Sequence
  Synthetic oligonucleotide
attagcaggagagggcgggaggcacaggcggccagga

SEQ ID NO: 187511 - DNA, 37 bp, Artificial Sequence
  Synthetic oligonucleotide
gtggacggggggaatgggtgatgagtgttatgcagga

SEQ ID NO: 187512 - DNA, 37 bp, Artificial Sequence
  Synthetic oligonucleotide
tacgaccaggggcgggaaacgaaggggcgatgacgga

SEQ ID NO: 187513 - DNA, 37 bp, Artificial Sequence
  Synthetic oligonucleotide
gggaggaacggggaggtgagcaagcgtgctatacgga

SEQ ID NO: 187514 - DNA, 37 bp, Artificial Sequence
  Synthetic oligonucleotide
acagccacacattcgccttttgcggagccctcccgga

SEQ ID NO: 187515 - DNA, 37 bp, Artificial Sequence
  Synthetic oligonucleotide
gtaacatgggagggggtagtgaggtcaatagcgggga

SEQ ID NO: 187516 - DNA, 37 bp, Artificial Sequence
  Synthetic oligonucleotide
gacgggcggcacggggggaagaagtgagcggcgggga

SEQ ID NO: 187517 - DNA, 37 bp, Artificial Sequence
  Synthetic oligonucleotide
ggaatggtgtggtggctggggggagcgcgggcatgga

SEQ ID NO: 187518 - DNA, 37 bp, Artificial Sequence
  Synthetic oligonucleotide
gtcctcgggtgggtgggaccgggagtcctggcaatga

SEQ ID NO: 187519 - DNA, 38 bp, Artificial Sequence
  Synthetic oligonucleotide
gtgacgagggcggatggcggagggagggtcctcaatga

SEQ ID NO: 187520 - DNA, 38 bp, Artificial Sequence
  Synthetic oligonucleotide
tgacgatccccccgcgctacttccacagtcggtaatga

SEQ ID NO: 187521 - DNA, 38 bp, Artificial Sequence
  Synthetic oligonucleotide
gagacgcatgagaggtaggcggggagatgaggttatga

SEQ ID NO: 187522 - DNA, 36 bp, Artificial Sequence
  Synthetic oligonucleotide
accatcccgcacaggccgcctataaacaatacctga

SEQ ID NO: 187523 - DNA, 38 bp, Artificial Sequence
  Synthetic oligonucleotide
gactacgcacattgtccctccctcatacctgcatctga

SEQ ID NO: 187524 - DNA, 38 bp, Artificial Sequence
  Synthetic oligonucleotide
gtcgtggtcgtgctgccttttaacccgtccgtttctga

SEQ ID NO: 187525 - DNA, 37 bp, Artificial Sequence
  Synthetic oligonucleotide
aaaggggaggcgaggcggaggaaacagacgggagtga

SEQ ID NO: 187526 - DNA, 38 bp, Artificial Sequence
  Synthetic oligonucleotide
gatggggaaaagagacagtacagcagggagggtggtga

SEQ ID NO: 187527 - DNA, 38 bp, Artificial Sequence
  Synthetic oligonucleotide
tcatccccctcggttttatcttatgccagttaacttga

SEQ ID NO: 187528 - DNA, 34 bp, Artificial Sequence
  Synthetic oligonucleotide
gtaccgcccatccgcgtagttaaacactacttga

SEQ ID NO: 187529 - DNA, 35 bp, Artificial Sequence
  Synthetic oligonucleotide
gcatggacgacggtatcttccctgtaacaccttga

SEQ ID NO: 187530 - DNA, 38 bp, Artificial Sequence
  Synthetic oligonucleotide
tcccctggcccccttggttgagccccagttctccttga

SEQ ID NO: 187531 - DNA, 38 bp, Artificial Sequence
  Synthetic oligonucleotide
tcacaactccttgccgtggctaacgcgcctcatcttga

SEQ ID NO: 187532 - DNA, 38 bp, Artificial Sequence
  Synthetic oligonucleotide
tgatgtcagcccaagcgcctctccatccccctggttga

SEQ ID NO: 187533 - DNA, 38 bp, Artificial Sequence
  Synthetic oligonucleotide
gcatcaccgctcgctgtcccacgaatgatccttgttga

SEQ ID NO: 187534 - DNA, 38 bp, Artificial Sequence
  Synthetic oligonucleotide
gatcccccgccacatagtaactgtttgtctacgtttga

SEQ ID NO: 187535 - DNA, 37 bp, Artificial Sequence
  Synthetic oligonucleotide
accctctccgatgcaatccgccgaccccgacttttga

SEQ ID NO: 187536 - DNA, 36 bp, Artificial Sequence
  Synthetic oligonucleotide
gccttacagaagtatacccgccctgttccctctcta

SEQ ID NO: 187537 - DNA, 35 bp, Artificial Sequence
  Synthetic oligonucleotide
gcctgccacacttgcgttcctatccttttcccgta

SEQ ID NO: 187538 - DNA, 36 bp, Artificial Sequence
  Synthetic oligonucleotide
gaaacgatccgtagaagagtgggagggaggcgggta

SEQ ID NO: 187539 - DNA, 36 bp, Artificial Sequence
  Synthetic oligonucleotide
gcatacaccccgtataacctcctgcgctccctggta

SEQ ID NO: 187540 - DNA, 36 bp, Artificial Sequence
  Synthetic oligonucleotide
gaaaggggggcaaatggggggagcacgctgtggtta

SEQ ID NO: 187541 - DNA, 35 bp, Artificial Sequence
  Synthetic oligonucleotide
gtgcctatgtgtacattccctccctatgccttaac

SEQ ID NO: 187542 - DNA, 35 bp, Artificial Sequence
  Synthetic oligonucleotide
actacgcccactcgcgcctttgcttgaaggttaac

SEQ ID NO: 187543 - DNA, 35 bp, Artificial Sequence
  Synthetic oligonucleotide
atcgctatcggcccatcttgtcttccctgtgccac

SEQ ID NO: 187544 - DNA, 35 bp, Artificial Sequence
  Synthetic oligonucleotide
tttgagcccatccttgttactcacccggcctccac

SEQ ID NO: 187545 - DNA, 35 bp, Artificial Sequence
  Synthetic oligonucleotide
tcattgcgccgctcctgtgcccccgcaggcctgac

SEQ ID NO: 187546 - DNA, 35 bp, Artificial Sequence
  Synthetic oligonucleotide
tcatgcgctaccggcgctgttacccattgcacacc

SEQ ID NO: 187547 - DNA, 35 bp, Artificial Sequence
  Synthetic oligonucleotide
gaccctcgacatctagtataacccgccttctcacc

SEQ ID NO: 187548 - DNA, 35 bp, Artificial Sequence
  Synthetic oligonucleotide
tgttgcggtcacacgttccctacgcaatggctacc

SEQ ID NO: 187549 - DNA, 34 bp, Artificial Sequence
  Synthetic oligonucleotide
gcacacccccttgagtgctactttagacgcaccc

SEQ ID NO: 187550 - DNA, 35 bp, Artificial Sequence
  Synthetic oligonucleotide
actgccaacctccgcacgtattggctcagcacccc

SEQ ID NO: 187551 - DNA, 35 bp, Artificial Sequence
  Synthetic oligonucleotide
actacgcgaacactcgtatcgcccattcactcccc

SEQ ID NO: 187552 - DNA, 35 bp, Artificial Sequence
  Synthetic oligonucleotide
gccccgggatgccaggctccccactcctagtgccc

SEQ ID NO: 187553 - DNA, 35 bp, Artificial Sequence
  Synthetic oligonucleotide
ggtaccacatggtgctattttcctactctcctccc

SEQ ID NO: 187554 - DNA, 35 bp, Artificial Sequence
  Synthetic oligonucleotide
tcccctcccaccactatcttcgtcggtcaaaagcc

SEQ ID NO: 187555 - DNA, 35 bp, Artificial Sequence
  Synthetic oligonucleotide
acatgagcgctacttgactatccttgaacacagcc

SEQ ID NO: 187556 - DNA, 35 bp, Artificial Sequence
  Synthetic oligonucleotide
gcctgagtgcccctgttacttgtctatctaccgcc

SEQ ID NO: 187557 - DNA, 36 bp, Artificial Sequence
  Synthetic oligonucleotide
actctgacagtatgcgccccccccgacatcatggcc

SEQ ID NO: 187558 - DNA, 35 bp, Artificial Sequence
  Synthetic oligonucleotide
tgcctgtgtccgcatcataacgccgttccgctgcc

SEQ ID NO: 187559 - DNA, 35 bp, Artificial Sequence
  Synthetic oligonucleotide
gctcggtcctctgcctcacccggtcattttctgcc

SEQ ID NO: 187560 - DNA, 35 bp, Artificial Sequence
  Synthetic oligonucleotide
tccatgtgccaatttagggcgagcaccttacttcc

SEQ ID NO: 187561 - DNA, 35 bp, Artificial Sequence
  Synthetic oligonucleotide
aacggagccacgcgctgttctaacgtgcctcttcc

SEQ ID NO: 187562 - DNA, 35 bp, Artificial Sequence
  Synthetic oligonucleotide
tccacgtcaccccttccaaagtgattcccttttcc

SEQ ID NO: 187563 - DNA, 35 bp, Artificial Sequence
  Synthetic oligonucleotide
tccattaacctgccagcatctcgttgcctgtccgc

SEQ ID NO: 187564 - DNA, 35 bp, Artificial Sequence
  Synthetic oligonucleotide
gccgaacggcctccgatgactacttctcttctcgc

SEQ ID NO: 187565 - DNA, 35 bp, Artificial Sequence
  Synthetic oligonucleotide
atttcgcccccgattctgtgttggttcctcacggc

SEQ ID NO: 187566 - DNA, 35 bp, Artificial Sequence
  Synthetic oligonucleotide
atcacctcacagaacgtctcttacacacacccggc

SEQ ID NO: 187567 - DNA, 35 bp, Artificial Sequence
  Synthetic oligonucleotide
gcttgtgccgtacgccccgcttattttctcccggc

SEQ ID NO: 187568 - DNA, 35 bp, Artificial Sequence
  Synthetic oligonucleotide
atcccacaatcgttcccctccgttgtcgaccctgc

SEQ ID NO: 187569 - DNA, 35 bp, Artificial Sequence
  Synthetic oligonucleotide
gatgctagctccccttactctctggtcgcgcctgc

SEQ ID NO: 187570 - DNA, 35 bp, Artificial Sequence
  Synthetic oligonucleotide
gacttgtcccctgtatcacgtacaccctctcttgc

SEQ ID NO: 187571 - DNA, 35 bp, Artificial Sequence
  Synthetic oligonucleotide
gttcatcagtaggtctctgctacattcgcaccatc

SEQ ID NO: 187572 - DNA, 35 bp, Artificial Sequence
  Synthetic oligonucleotide
taactgtccgcccgcctgccttgtcaccgcttatc

SEQ ID NO: 187573 - DNA, 35 bp, Artificial Sequence
  Synthetic oligonucleotide
atgccatacgctcgccatatagtccttgcacactc

SEQ ID NO: 187574 - DNA, 35 bp, Artificial Sequence
  Synthetic oligonucleotide
acaccggtctacgtggtttggctaccccgcacctc

SEQ ID NO: 187575 - DNA, 35 bp, Artificial Sequence
  Synthetic oligonucleotide
ccatcatcccgtacctgttggtcaaattctacctc

SEQ ID NO: 187576 - DNA, 35 bp, Artificial Sequence
  Synthetic oligonucleotide
gcgtacacaccttcaacattgctcgactgccgctc

SEQ ID NO: 187577 - DNA, 35 bp, Artificial Sequence
  Synthetic oligonucleotide
gctgcctgtactactcaccatgggcttcgcatctc

SEQ ID NO: 187578 - DNA, 35 bp, Artificial Sequence
  Synthetic oligonucleotide
acacaaccgccccaatgtccttcgctccggacgtc

SEQ ID NO: 187579 - DNA, 35 bp, Artificial Sequence
  Synthetic oligonucleotide
ggtgcatttcaccggtacgccgccctagccttgtc

SEQ ID NO: 187580 - DNA, 35 bp, Artificial Sequence
  Synthetic oligonucleotide
attgccccccgcggccatgtccgacctccttcttc

SEQ ID NO: 187581 - DNA, 35 bp, Artificial Sequence
  Synthetic oligonucleotide
tcccctccctggtgtgctgccgctatttctcgttc

SEQ ID NO: 187582 - DNA, 34 bp, Artificial Sequence
  Synthetic oligonucleotide
actagtcccggctacgtcgcccccgctttggttc

SEQ ID NO: 187583 - DNA, 35 bp, Artificial Sequence
  Synthetic oligonucleotide
gtcaacccgccttcctttatgactatcgatatttc

SEQ ID NO: 187584 - DNA, 35 bp, Artificial Sequence
  Synthetic oligonucleotide
tgtgacccagtatcttgtttgatctctctcttttc

SEQ ID NO: 187585 - DNA, 35 bp, Artificial Sequence
  Synthetic oligonucleotide
tgccgccgcctcgaccatgctcgcacacatcatag

SEQ ID NO: 187586 - DNA, 35 bp, Artificial Sequence
  Synthetic oligonucleotide
tgcgtccgcgcccgccctcctcaatttgcccttag

SEQ ID NO: 187587 - DNA, 35 bp, Artificial Sequence
  Synthetic oligonucleotide
gcaccggggtccccaccgccttaacctccctgacg

SEQ ID NO: 187588 - DNA, 35 bp, Artificial Sequence
  Synthetic oligonucleotide
acaccgcccccgtaatcagttcttgggtactcccg

SEQ ID NO: 187589 - DNA, 35 bp, Artificial Sequence
  Synthetic oligonucleotide
atatgcctctgcgcaattcccaagactcctctccg

SEQ ID NO: 187590 - DNA, 35 bp, Artificial Sequence
  Synthetic oligonucleotide
gttgggcgggaacaggggctaatagggaatctgcg

SEQ ID NO: 187591 - DNA, 35 bp, Artificial Sequence
  Synthetic oligonucleotide
gtacacgcgcccacgtctcttcaacctccggatcg

SEQ ID NO: 187592 - DNA, 35 bp, Artificial Sequence
  Synthetic oligonucleotide
gctgtagccatataaagccccacccttcttcctcg

SEQ ID NO: 187593 - DNA, 35 bp, Artificial Sequence
  Synthetic oligonucleotide
gaatggggacgggcaaaaaggacatgtggcgttcg

SEQ ID NO: 187594 - DNA, 35 bp, Artificial Sequence
  Synthetic oligonucleotide
accatgctcgaccgttagccatgctcctactttcg

SEQ ID NO: 187595 - DNA, 35 bp, Artificial Sequence
  Synthetic oligonucleotide
gaccaccgtgtcgttcgcatatttccatcctttcg

SEQ ID NO: 187596 - DNA, 36 bp, Artificial Sequence
  Synthetic oligonucleotide
gctacccgccatcatgtttctgcttctatttaccgg

SEQ ID NO: 187597 - DNA, 35 bp, Artificial Sequence
  Synthetic oligonucleotide
aacctgggtgggagggaccgtgtgttggacgaggg

SEQ ID NO: 187598 - DNA, 35 bp, Artificial Sequence
  Synthetic oligonucleotide
ggacacgcgcgttcgtctctatatatctcacctgg

SEQ ID NO: 187599 - DNA, 30 bp, Artificial Sequence
  Synthetic oligonucleotide
gaattgcccctcacctgcgccccgtgaatg

SEQ ID NO: 187600 - DNA, 35 bp, Artificial Sequence
  Synthetic oligonucleotide
tcacgtcgcaccgtttcttttccctcgcccccatg

SEQ ID NO: 187601 - DNA, 35 bp, Artificial Sequence
  Synthetic oligonucleotide
tgttcaacggccacagtctttacgcctacaacctg

SEQ ID NO: 187602 - DNA, 35 bp, Artificial Sequence
  Synthetic oligonucleotide
atgagtgggaggtgaagcggggcgggcgctgggtg

SEQ ID NO: 187603 - DNA, 35 bp, Artificial Sequence
  Synthetic oligonucleotide
tttgcggcccattgccccggtcgtgcctcctaact

SEQ ID NO: 187604 - DNA, 35 bp, Artificial Sequence
  Synthetic oligonucleotide
atccggtgaccccctacgcacgtgctgcccttact

SEQ ID NO: 187605 - DNA, 35 bp, Artificial Sequence
  Synthetic oligonucleotide
tcccagttcgccgtgtttgccgccacgtaccccct

SEQ ID NO: 187606 - DNA, 35 bp, Artificial Sequence
  Synthetic oligonucleotide
gagacgctgccagcggcttggttaccgtgccccct

SEQ ID NO: 187607 - DNA, 35 bp, Artificial Sequence
  Synthetic oligonucleotide
gccgccttacgatcatattcacccattctggccct

SEQ ID NO: 187608 - DNA, 35 bp, Artificial Sequence
  Synthetic oligonucleotide
gacacgctcagataccttcccttccacttctgcct

SEQ ID NO: 187609 - DNA, 35 bp, Artificial Sequence
  Synthetic oligonucleotide
tccgacctttgcgttgacggcttatctcttgtcct

SEQ ID NO: 187610 - DNA, 35 bp, Artificial Sequence
  Synthetic oligonucleotide
tagccatcccgtacctgatatccttcgccctcgct

SEQ ID NO: 187611 - DNA, 34 bp, Artificial Sequence
  Synthetic oligonucleotide
ttatccacccgcctgcgtccttatgcgttctgct

SEQ ID NO: 187612 - DNA, 35 bp, Artificial Sequence
  Synthetic oligonucleotide
ggtctcctccccctgtcattcagcagacacttgct

SEQ ID NO: 187613 - DNA, 35 bp, Artificial Sequence
  Synthetic oligonucleotide
gctgagtcattgccgtacttgtggccgtactatct

SEQ ID NO: 187614 - DNA, 35 bp, Artificial Sequence
  Synthetic oligonucleotide
gacgaaccacatcctgtgttttatgctaattctct

SEQ ID NO: 187615 - DNA, 35 bp, Artificial Sequence
  Synthetic oligonucleotide
tctgaccctgccaccccactgtactggctaattct

SEQ ID NO: 187616 - DNA, 35 bp, Artificial Sequence
  Synthetic oligonucleotide
gttctacgcgcataccgatatatctgttcccttct

SEQ ID NO: 187617 - DNA, 35 bp, Artificial Sequence
  Synthetic oligonucleotide
actcagaccgatcgcagccgttgctaagcctttct

SEQ ID NO: 187618 - DNA, 35 bp, Artificial Sequence
  Synthetic oligonucleotide
tgctgcccccgctcgcttcatgtttccactcacgt

SEQ ID NO: 187619 - DNA, 35 bp, Artificial Sequence
  Synthetic oligonucleotide
gcgtggtcggcccctctgcacttgatctgtcccgt

SEQ ID NO: 187620 - DNA, 35 bp, Artificial Sequence
  Synthetic oligonucleotide
tgtgggatagggtaagagcgggcgggcgggacggt

SEQ ID NO: 187621 - DNA, 35 bp, Artificial Sequence
  Synthetic oligonucleotide
gaacgacccccacccttcgcccaccgtataattgt

SEQ ID NO: 187622 - DNA, 35 bp, Artificial Sequence
  Synthetic oligonucleotide
gttcccgccaagtgggttaatccactcatttcctt

SEQ ID NO: 187623 - DNA, 35 bp, Artificial Sequence
  Synthetic oligonucleotide
gatataccccgccaagcacgctaatgtcgcttctt

SEQ ID NO: 187624 - DNA, 36 bp, Artificial Sequence
  Synthetic oligonucleotide
gtagagggagccagtacaagggggaggataaaaaaa

SEQ ID NO: 187625 - DNA, 35 bp, Artificial Sequence
  Synthetic oligonucleotide
gtggtcctcctcctgatatccgtggccctcaaaaa

SEQ ID NO: 187626 - DNA, 36 bp, Artificial Sequence
  Synthetic oligonucleotide
gtggggttgactgacggcggagaaggagttgcaaaa

SEQ ID NO: 187627 - DNA, 36 bp, Artificial Sequence
  Synthetic oligonucleotide
tccaacttacggaggcaggagaaggggaggtgaaaa

SEQ ID NO: 187628 - DNA, 36 bp, Artificial Sequence
  Synthetic oligonucleotide
gtccggccatccgccactggctacccgccccttaaa

SEQ ID NO: 187629 - DNA, 36 bp, Artificial Sequence
  Synthetic oligonucleotide
ggtggcaccagccgttattctccgcctcgtccccaa

SEQ ID NO: 187630 - DNA, 35 bp, Artificial Sequence
  Synthetic oligonucleotide
gcccagcccttatagttaaacgtccgtctgcccaa

SEQ ID NO: 187631 - DNA, 35 bp, Artificial Sequence
  Synthetic oligonucleotide
ttgacaggggcgagaggcggcggggaaaagcgcaa

SEQ ID NO: 187632 - DNA, 36 bp, Artificial Sequence
  Synthetic oligonucleotide
gcccatcctgtatcgtttttgtcacctactgtgcaa

SEQ ID NO: 187633 - DNA, 36 bp, Artificial Sequence
  Synthetic oligonucleotide
gacctcccctcaactgtatgtccgtgacacgctcaa

SEQ ID NO: 187634 - DNA, 36 bp, Artificial Sequence
  Synthetic oligonucleotide
ggaacgggaagctagggcagggagggtccgatggaa

SEQ ID NO: 187635 - DNA, 35 bp, Artificial Sequence
  Synthetic oligonucleotide
tagctccccacacgccttatctgctcctatttgaa

SEQ ID NO: 187636 - DNA, 35 bp, Artificial Sequence
  Synthetic oligonucleotide
ttgtcgcgtactcatcaagcccaggcccctcctaa

SEQ ID NO: 187637 - DNA, 34 bp, Artificial Sequence
  Synthetic oligonucleotide
ggaagtgcgcccgagcaccccctccgtaacccca

SEQ ID NO: 187638 - DNA, 36 bp, Artificial Sequence
  Synthetic oligonucleotide
gttcgaaccgatccacttggtgcatgactcctccca

SEQ ID NO: 187639 - DNA, 35 bp, Artificial Sequence
  Synthetic oligonucleotide
gtgctgtgcacgcgcttcttactgacaaaacgcca

SEQ ID NO: 187640 - DNA, 36 bp, Artificial Sequence
  Synthetic oligonucleotide
tagacacgcctttgctccccatgctttgtaccgcca

SEQ ID NO: 187641 - DNA, 35 bp, Artificial Sequence
  Synthetic oligonucleotide
gtgccccccgttttctcatcatgcggatgttcgca

SEQ ID NO: 187642 - DNA, 35 bp, Artificial Sequence
  Synthetic oligonucleotide
tccccgctagcccattatccggacaccctttcgca

SEQ ID NO: 187643 - DNA, 35 bp, Artificial Sequence
  Synthetic oligonucleotide
ttgcaacccctcgcctgcgcccgccttacaaggca

SEQ ID NO: 187644 - DNA, 35 bp, Artificial Sequence
  Synthetic oligonucleotide
tgctatcccgatcctgccctcacaacgacctggca

SEQ ID NO: 187645 - DNA, 36 bp, Artificial Sequence
  Synthetic oligonucleotide
atggcccacgccgccggtcctcacacaattacctca

SEQ ID NO: 187646 - DNA, 35 bp, Artificial Sequence
  Synthetic oligonucleotide
ttgccttcgccgtgcgaacacatatccttacctca

SEQ ID NO: 187647 - DNA, 36 bp, Artificial Sequence
  Synthetic oligonucleotide
gggacccctccgtagtcgttcgtccgcctccgctca

SEQ ID NO: 187648 - DNA, 36 bp, Artificial Sequence
  Synthetic oligonucleotide
tgtgcgagcctcaagccctcccttgatcacttctca

SEQ ID NO: 187649 - DNA, 36 bp, Artificial Sequence
  Synthetic oligonucleotide
actggtcgccctcaccggagttacatccagttctca

SEQ ID NO: 187650 - DNA, 36 bp, Artificial Sequence
  Synthetic oligonucleotide
aaacccgcccccctcggccttacatccagtttgtca

SEQ ID NO: 187651 - DNA, 36 bp, Artificial Sequence
  Synthetic oligonucleotide
tcacaccacagagtcgtcgcccattatcttacttca

SEQ ID NO: 187652 - DNA, 35 bp, Artificial Sequence
  Synthetic oligonucleotide
acctggtcccctgcctgaagctacctgtgctttca

SEQ ID NO: 187653 - DNA, 37 bp, Artificial Sequence
  Synthetic oligonucleotide
aaggtggaggggagggcggtggcagcaatcaggaaga

SEQ ID NO: 187654 - DNA, 35 bp, Artificial Sequence
  Synthetic oligonucleotide
tgcactcacccgctcctacgtcgtctacttacaga

SEQ ID NO: 187655 - DNA, 36 bp, Artificial Sequence
  Synthetic oligonucleotide
tacgtagattagggcgggggaggacgagaggggaga

SEQ ID NO: 187656 - DNA, 37 bp, Artificial Sequence
  Synthetic oligonucleotide
gagtaggagaggatgtggggggggttcaagggctaga

SEQ ID NO: 187657 - DNA, 37 bp, Artificial Sequence
  Synthetic oligonucleotide
ggacgggccatgagacgggagggtgggtgaaattaga

SEQ ID NO: 187658 - DNA, 37 bp, Artificial Sequence
  Synthetic oligonucleotide
ttcacccgcatgctatgccgacttcacatctttacga

SEQ ID NO: 187659 - DNA, 37 bp, Artificial Sequence
  Synthetic oligonucleotide
agactggtccactgcaacgttactttcccgcctccga

SEQ ID NO: 187660 - DNA, 37 bp, Artificial Sequence
  Synthetic oligonucleotide
gttcagccccttgctgtgtccagttccctgcctccga

SEQ ID NO: 187661 - DNA, 37 bp, Artificial Sequence
  Synthetic oligonucleotide
ttgcgtcccctcgcgctatgttccccttcctttccga

SEQ ID NO: 187662 - DNA, 37 bp, Artificial Sequence
  Synthetic oligonucleotide
accggggaggggggtaaaaaaaggcaggacaacgcga

SEQ ID NO: 187663 - DNA, 37 bp, Artificial Sequence
  Synthetic oligonucleotide
tcaagcgggtgaaggttggaacggggaatcggggcga

SEQ ID NO: 187664 - DNA, 37 bp, Artificial Sequence
  Synthetic oligonucleotide
tcactcgctgttctagctcgccacattcaccactcga

SEQ ID NO: 187665 - DNA, 37 bp, Artificial Sequence
  Synthetic oligonucleotide
tgaccgatcagactcgttgcctctcccccatgctcga

SEQ ID NO: 187666 - DNA, 37 bp, Artificial Sequence
  Synthetic oligonucleotide
tgccgcagactagtgcgctcccccctttacgtgtcga

SEQ ID NO: 187667 - DNA, 37 bp, Artificial Sequence
  Synthetic oligonucleotide
gtccacccgcccttagcccgttccgtcgtatcacgga

SEQ ID NO: 187668 - DNA, 37 bp, Artificial Sequence
  Synthetic oligonucleotide
gtgccaagctccggtctactacctgcccactcccgga

SEQ ID NO: 187669 - DNA, 37 bp, Artificial Sequence
  Synthetic oligonucleotide
tgtcatactctcctgctggttctactacactctcgga

SEQ ID NO: 187670 - DNA, 37 bp, Artificial Sequence
  Synthetic oligonucleotide
aaggtgagggtgccggtgggggactgagggaaaggga

SEQ ID NO: 187671 - DNA, 37 bp, Artificial Sequence
  Synthetic oligonucleotide
gacgtgcttatcaatgggtgggaagggcggcccggga

SEQ ID NO: 187672 - DNA, 37 bp, Artificial Sequence
  Synthetic oligonucleotide
accacgggcggggttgtgttttgtttgggagagggga

SEQ ID NO: 187673 - DNA, 37 bp, Artificial Sequence
  Synthetic oligonucleotide
acagggaagggagctgtaggggagcgagtgggctgga

SEQ ID NO: 187674 - DNA, 37 bp, Artificial Sequence
  Synthetic oligonucleotide
ttgtcccgcccgttttgctatgcctcaagttcttgga

SEQ ID NO: 187675 - DNA, 37 bp, Artificial Sequence
  Synthetic oligonucleotide
gaagagcatgaagggggaaacgggaggttcgtgatga

SEQ ID NO: 187676 - DNA, 36 bp, Artificial Sequence
  Synthetic oligonucleotide
tacatcccccgcccccgctttaacgtccatctatga

SEQ ID NO: 187677 - DNA, 38 bp, Artificial Sequence
  Synthetic oligonucleotide
gactccccccgctttgactccgatgctagtcggactga

SEQ ID NO: 187678 - DNA, 38 bp, Artificial Sequence
  Synthetic oligonucleotide
gttctcgttccccgtgcttttcgactcgcctttcctga

SEQ ID NO: 187679 - DNA, 38 bp, Artificial Sequence
  Synthetic oligonucleotide
gacgcatcactacgcgcatacgttatcctccttgctga

SEQ ID NO: 187680 - DNA, 38 bp, Artificial Sequence
  Synthetic oligonucleotide
ggggaaacgggaagttagggagggagctgtaggagtga

SEQ ID NO: 187681 - DNA, 38 bp, Artificial Sequence
  Synthetic oligonucleotide
atcatcacgtcctttcccagtgtcagcccgcaccgtga

SEQ ID NO: 187682 - DNA, 37 bp, Artificial Sequence
  Synthetic oligonucleotide
gcaccaccaacgtaccacccagtttactcctccgtga

SEQ ID NO: 187683 - DNA, 38 bp, Artificial Sequence
  Synthetic oligonucleotide
tcaacacccccccagttctggaattgtcacacgcgtga

SEQ ID NO: 187684 - DNA, 38 bp, Artificial Sequence
  Synthetic oligonucleotide
tcaccgcttgtttcgcctcccccgccacgcatgcgtga

SEQ ID NO: 187685 - DNA, 38 bp, Artificial Sequence
  Synthetic oligonucleotide
atctgggcggagggaggcgttagaaggggcggctgtga

SEQ ID NO: 187686 - DNA, 38 bp, Artificial Sequence
  Synthetic oligonucleotide
gcaccgcctaccaccattgtacccccagtcctgtgtga

SEQ ID NO: 187687 - DNA, 38 bp, Artificial Sequence
  Synthetic oligonucleotide
attccccgccccgctcctggcattctgcttaacattga

SEQ ID NO: 187688 - DNA, 37 bp, Artificial Sequence
  Synthetic oligonucleotide
ggtacggtcgccctgtcttcccgttagttctccttga

SEQ ID NO: 187689 - DNA, 37 bp, Artificial Sequence
  Synthetic oligonucleotide
gcgggacacgctgctccaccatatggccgttccttga

SEQ ID NO: 187690 - DNA, 37 bp, Artificial Sequence
  Synthetic oligonucleotide
gccatcgcgcacctcgttccgtcctttcgcactttga

SEQ ID NO: 187691 - DNA, 35 bp, Artificial Sequence
  Synthetic oligonucleotide
gcccgaggacgggaactgagggatagagggaaata

SEQ ID NO: 187692 - DNA, 35 bp, Artificial Sequence
  Synthetic oligonucleotide
tcaacgttaactgcttgtttgccccctccgccata

SEQ ID NO: 187693 - DNA, 34 bp, Artificial Sequence
  Synthetic oligonucleotide
aacatcgccgccggacacagcggttcccttacta

SEQ ID NO: 187694 - DNA, 35 bp, Artificial Sequence
  Synthetic oligonucleotide
ttcacgcctgccttgccgatcccaggcctccgcta

SEQ ID NO: 187695 - DNA, 35 bp, Artificial Sequence
  Synthetic oligonucleotide
tactcatcctcgttcttaatatgcctgtggctcta

SEQ ID NO: 187696 - DNA, 36 bp, Artificial Sequence
  Synthetic oligonucleotide
acacccccctcttcgatgcacaacccggacagtgta

SEQ ID NO: 187697 - DNA, 35 bp, Artificial Sequence
  Synthetic oligonucleotide
gcccctgtgggtacttaccaccgctccacctgtta

SEQ ID NO: 187698 - DNA, 36 bp, Artificial Sequence
  Synthetic oligonucleotide
aaccgccacatgttttcgcctatcgtccctacttta

SEQ ID NO: 187699 - DNA, 35 bp, Artificial Sequence
  Synthetic oligonucleotide
atcgtcacccgccgaccccctcgtactttcgatac

SEQ ID NO: 187700 - DNA, 35 bp, Artificial Sequence
  Synthetic oligonucleotide
atcacaccgctgcagaggccactcgcgccccgtac

SEQ ID NO: 187701 - DNA, 35 bp, Artificial Sequence
  Synthetic oligonucleotide
gacctacgctccaagctatgctgtctggctcttac

SEQ ID NO: 187702 - DNA, 35 bp, Artificial Sequence
  Synthetic oligonucleotide
tgccactctcactcgatagtagctgtctcgccacc

SEQ ID NO: 187703 - DNA, 35 bp, Artificial Sequence
  Synthetic oligonucleotide
gttccgccccctcacatatatgcttacggttcacc

SEQ ID NO: 187704 - DNA, 35 bp, Artificial Sequence
  Synthetic oligonucleotide
tcgaaagccgcgaaacctatgccgctcccgctacc

SEQ ID NO: 187705 - DNA, 35 bp, Artificial Sequence
  Synthetic oligonucleotide
gtgatccggggagggggtctgggtgggtatctacc

SEQ ID NO: 187706 - DNA, 35 bp, Artificial Sequence
  Synthetic oligonucleotide
tcgacccccctcgtttcaacagtgaattgcacccc

SEQ ID NO: 187707 - DNA, 35 bp, Artificial Sequence
  Synthetic oligonucleotide
cccacccctgagcttgccgtgagataccgcccccc

SEQ ID NO: 187708 - DNA, 35 bp, Artificial Sequence
  Synthetic oligonucleotide
tgaagctccattcgtctttaacttatttgcccccc

SEQ ID NO: 187709 - DNA, 35 bp, Artificial Sequence
  Synthetic oligonucleotide
tatcggtgtgccgctctctccgccagcctatgccc

SEQ ID NO: 187710 - DNA, 35 bp, Artificial Sequence
  Synthetic oligonucleotide
acgtagcaccctgatatttagtcagccccttgccc

SEQ ID NO: 187711 - DNA, 35 bp, Artificial Sequence
  Synthetic oligonucleotide
aagcaacaccgcttattcagcctgccgacgctccc

SEQ ID NO: 187712 - DNA, 35 bp, Artificial Sequence
  Synthetic oligonucleotide
tcatcgcgctatattacttgtgttacccccgtccc

SEQ ID NO: 187713 - DNA, 35 bp, Artificial Sequence
  Synthetic oligonucleotide
tatggaaccgtcacgttcccgttttgcattttccc

SEQ ID NO: 187714 - DNA, 35 bp, Artificial Sequence
  Synthetic oligonucleotide
gtgcgtgagatcatttcatcgtgccccccttcgcc

SEQ ID NO: 187715 - DNA, 35 bp, Artificial Sequence
  Synthetic oligonucleotide
tcccgcccctgttgttgcctcaagctcggtcatcc

SEQ ID NO: 187716 - DNA, 35 bp, Artificial Sequence
  Synthetic oligonucleotide
attcagtcaggcctctgcttcctattcgtcactcc

SEQ ID NO: 187717 - DNA, 35 bp, Artificial Sequence
  Synthetic oligonucleotide
acacacgtgcaatccctgtcatagccatgtactcc

SEQ ID NO: 187718 - DNA, 35 bp, Artificial Sequence
  Synthetic oligonucleotide
acaccgcatcacctcggacgttcatcgtgccctcc

SEQ ID NO: 187719 - DNA, 35 bp, Artificial Sequence
  Synthetic oligonucleotide
acacctccgacgtacttccatatcctgggcgctcc

SEQ ID NO: 187720 - DNA, 35 bp, Artificial Sequence
  Synthetic oligonucleotide
ttgcccttccatcgggcgagactgttgcttcttcc

SEQ ID NO: 187721 - DNA, 35 bp, Artificial Sequence
  Synthetic oligonucleotide
ttacacgtgcacctagattggcgtgctctctttcc

SEQ ID NO: 187722 - DNA, 35 bp, Artificial Sequence
  Synthetic oligonucleotide
tatcaacaccccagctctgttgcagctccgcccgc

SEQ ID NO: 187723 - DNA, 35 bp, Artificial Sequence
  Synthetic oligonucleotide
agccgggagggcgcgggaagggtcaagtcaagcgc

SEQ ID NO: 187724 - DNA, 35 bp, Artificial Sequence
  Synthetic oligonucleotide
tgtctagcacccgtgtctcttcttgccctactcgc

SEQ ID NO: 187725 - DNA, 35 bp, Artificial Sequence
  Synthetic oligonucleotide
tgattagcctcctctcgccccgctgacatttaggc

SEQ ID NO: 187726 - DNA, 35 bp, Artificial Sequence
  Synthetic oligonucleotide
ttcccaccacatgttgtccgaactccatccactgc

SEQ ID NO: 187727 - DNA, 35 bp, Artificial Sequence
  Synthetic oligonucleotide
gtgaagcccgatctcctatgacacgctccaacatc

SEQ ID NO: 187728 - DNA, 35 bp, Artificial Sequence
  Synthetic oligonucleotide
tccacgccgtgaggtacgtcggctcaccttctatc

SEQ ID NO: 187729 - DNA, 35 bp, Artificial Sequence
  Synthetic oligonucleotide
acactcttcactgcctatgggacacacatattatc

SEQ ID NO: 187730 - DNA, 35 bp, Artificial Sequence
  Synthetic oligonucleotide
tccaccacaaggagtgtccccggccccctgcactc

SEQ ID NO: 187731 - DNA, 35 bp, Artificial Sequence
  Synthetic oligonucleotide
gaaccgcgtcggggaacgggtgggaagggcccctc

SEQ ID NO: 187732 - DNA, 30 bp, Artificial Sequence
  Synthetic oligonucleotide
atgcccatgcatccgttgaaattagctctc

SEQ ID NO: 187733 - DNA, 35 bp, Artificial Sequence
  Synthetic oligonucleotide
aacaccggtcattgggctcaatttggctacccttc

SEQ ID NO: 187734 - DNA, 35 bp, Artificial Sequence
  Synthetic oligonucleotide
ttgcgcactagtgcataatgtcccccgttcccttc

SEQ ID NO: 187735 - DNA, 35 bp, Artificial Sequence
  Synthetic oligonucleotide
aatccgcccttaacctcacgcatgtttcctcgttc

SEQ ID NO: 187736 - DNA, 35 bp, Artificial Sequence
  Synthetic oligonucleotide
ggacgggtcttgagcaaaagggaggtaggggagag

SEQ ID NO: 187737 - DNA, 34 bp, Artificial Sequence
  Synthetic oligonucleotide
gacaatctgtagactctatttaccgccacctacg

SEQ ID NO: 187738 - DNA, 35 bp, Artificial Sequence
  Synthetic oligonucleotide
gcgcaatactgctgcgtaacgccatcgcctacccg

SEQ ID NO: 187739 - DNA, 35 bp, Artificial Sequence
  Synthetic oligonucleotide
ttccccgcttgcaagtcttcctgccgttctgcccg

SEQ ID NO: 187740 - DNA, 35 bp, Artificial Sequence
  Synthetic oligonucleotide
gtaagccgccgcccaatgctctcaccctgcagccg

SEQ ID NO: 187741 - DNA, 35 bp, Artificial Sequence
  Synthetic oligonucleotide
tgtcccccctcgagcgattcccttcaactttgccg

SEQ ID NO: 187742 - DNA, 35 bp, Artificial Sequence
  Synthetic oligonucleotide
gcgttggctcgcccgtacctccgttcctccgtccg

SEQ ID NO: 187743 - DNA, 34 bp, Artificial Sequence
  Synthetic oligonucleotide
tctgccatacgttcggccgtgctgactccttccg

SEQ ID NO: 187744 - DNA, 35 bp, Artificial Sequence
  Synthetic oligonucleotide
actgcatccgacaatctactaacacacccgttccg

SEQ ID NO: 187745 - DNA, 35 bp, Artificial Sequence
  Synthetic oligonucleotide
gctccacccccccactatcagagcccttcccagcg

SEQ ID NO: 187746 - DNA, 35 bp, Artificial Sequence
  Synthetic oligonucleotide
gacgcctgtggaagggtagtgattaggagggggcg

SEQ ID NO: 187747 - DNA, 35 bp, Artificial Sequence
  Synthetic oligonucleotide
gtggtcccacctgcagcacaactccttcctgggcg

SEQ ID NO: 187748 - DNA, 35 bp, Artificial Sequence
  Synthetic oligonucleotide
tactcgccgcaatttccttgtctattttcgtctcg

SEQ ID NO: 187749 - DNA, 35 bp, Artificial Sequence
  Synthetic oligonucleotide
gatcatcccaatgtgtccgtaccccctccccttcg

SEQ ID NO: 187750 - DNA, 35 bp, Artificial Sequence
  Synthetic oligonucleotide
gtccctcgcaccctctgttctccccgccgttgcgg

SEQ ID NO: 187751 - DNA, 35 bp, Artificial Sequence
  Synthetic oligonucleotide
acgcacagatgggggggtcttgagggggacgaggg

SEQ ID NO: 187752 - DNA, 35 bp, Artificial Sequence
  Synthetic oligonucleotide
tggtatggtgtgtggtggggggcgggatcatgggg

SEQ ID NO: 187753 - DNA, 35 bp, Artificial Sequence
  Synthetic oligonucleotide
tacagtactcagccgctctctgatccctttcactg

SEQ ID NO: 187754 - DNA, 35 bp, Artificial Sequence
  Synthetic oligonucleotide
gctcgtatctcgccgaacacccaccttagatcctg

SEQ ID NO: 187755 - DNA, 35 bp, Artificial Sequence
  Synthetic oligonucleotide
ggggggagggtgagagagtttggaaggcgcttgtg

SEQ ID NO: 187756 - DNA, 35 bp, Artificial Sequence
  Synthetic oligonucleotide
gttcgcccaatgctcaccctggttcaactttattg

SEQ ID NO: 187757 - DNA, 35 bp, Artificial Sequence
  Synthetic oligonucleotide
acaccccacctaacatgttcgccgttccgctcttg

SEQ ID NO: 187758 - DNA, 35 bp, Artificial Sequence
  Synthetic oligonucleotide
gacccccgctatgccatgccaatctgcctccgttg

SEQ ID NO: 187759 - DNA, 35 bp, Artificial Sequence
  Synthetic oligonucleotide
tcctccgggcccgctaccttactcaagttcctcat

SEQ ID NO: 187760 - DNA, 35 bp, Artificial Sequence
  Synthetic oligonucleotide
gcgaccgctttccagccgagcatcacctctcttat

SEQ ID NO: 187761 - DNA, 35 bp, Artificial Sequence
  Synthetic oligonucleotide
ggtccaatgcgacgtcgcccgcccgcctcatttat

SEQ ID NO: 187762 - DNA, 35 bp, Artificial Sequence
  Synthetic oligonucleotide
gagcgacgcttgctctgtaccccgccctgctcact

SEQ ID NO: 187763 - DNA, 35 bp, Artificial Sequence
  Synthetic oligonucleotide
gtagccccgtcatgaccatccccttgtgcgcacct

SEQ ID NO: 187764 - DNA, 35 bp, Artificial Sequence
  Synthetic oligonucleotide
atctccccgacgccacgaggttaggtgtcccgcct

SEQ ID NO: 187765 - DNA, 35 bp, Artificial Sequence
  Synthetic oligonucleotide
tccctactccgcctgtactttacgcgcgcttagct

SEQ ID NO: 187766 - DNA, 35 bp, Artificial Sequence
  Synthetic oligonucleotide
gtaggggtggggtgggttggctgggataaatggct

SEQ ID NO: 187767 - DNA, 35 bp, Artificial Sequence
  Synthetic oligonucleotide
gtggccctccttgccatattgtgttgccgccctct

SEQ ID NO: 187768 - DNA, 35 bp, Artificial Sequence
  Synthetic oligonucleotide
tagtgtcgcgccacttctccactcagttcttgtct

SEQ ID NO: 187769 - DNA, 35 bp, Artificial Sequence
  Synthetic oligonucleotide
agcacaggcacctagccgcgacctcctccgcttct

SEQ ID NO: 187770 - DNA, 35 bp, Artificial Sequence
  Synthetic oligonucleotide
gttggtggtccgcccttgtttctcgcaggtcttct

SEQ ID NO: 187771 - DNA, 35 bp, Artificial Sequence
  Synthetic oligonucleotide
gacaaggaatggacaggggttaggacgaggggagt

SEQ ID NO: 187772 - DNA, 35 bp, Artificial Sequence
  Synthetic oligonucleotide
atgtagagggtggaagggtggagacaagaaggcgt

SEQ ID NO: 187773 - DNA, 35 bp, Artificial Sequence
  Synthetic oligonucleotide
ggacctcaggggtgggaggcgggatgggaactggt

SEQ ID NO: 187774 - DNA, 35 bp, Artificial Sequence
  Synthetic oligonucleotide
taccgcacatcgggttcgtgggcccttctacctgt

SEQ ID NO: 187775 - DNA, 35 bp, Artificial Sequence
  Synthetic oligonucleotide
actatagccgcagcatcgttcgccgcttaccttgt

SEQ ID NO: 187776 - DNA, 35 bp, Artificial Sequence
  Synthetic oligonucleotide
ttcacacccgtgggtggtccgtttctgtaaccatt

SEQ ID NO: 187777 - DNA, 35 bp, Artificial Sequence
  Synthetic oligonucleotide
actccgactcgaaccgctacgtgattactgccatt

SEQ ID NO: 187778 - DNA, 35 bp, Artificial Sequence
  Synthetic oligonucleotide
ttagcgcgagacgcagttttcgcagcacccccctt

SEQ ID NO: 187779 - DNA, 35 bp, Artificial Sequence
  Synthetic oligonucleotide
gactgcccgacccggtaggaagtagtcccgccctt

SEQ ID NO: 187780 - DNA, 35 bp, Artificial Sequence
  Synthetic oligonucleotide
atgatcgcgagtgtcgcacgtgcgttttgctcctt

SEQ ID NO: 187781 - DNA, 35 bp, Artificial Sequence
  Synthetic oligonucleotide
gccatctgtagtcccacgcccgaatcgcctctctt

SEQ ID NO: 187782 - DNA, 35 bp, Artificial Sequence
  Synthetic oligonucleotide
ttcgactgttcatcagtcttcttaccacccacttt

SEQ ID NO: 187783 - DNA, 35 bp, Artificial Sequence
  Synthetic oligonucleotide
gatttgccggtgccactactcgcatcttcgccttt

SEQ ID NO: 187784 - DNA, 34 bp, Artificial Sequence
  Synthetic oligonucleotide
tgacccatctcccgttacgaattcgttggtcttt

SEQ ID NO: 187785 - DNA, 35 bp, Artificial Sequence
  Synthetic oligonucleotide
atcctcgcacgaggtccttgtactctttttggttt

SEQ ID NO: 187786 - DNA, 36 bp, Artificial Sequence
  Synthetic oligonucleotide
gcgcgaggggcactagggtgggtggtgaggtggaaa

SEQ ID NO: 187787 - DNA, 36 bp, Artificial Sequence
  Synthetic oligonucleotide
gagtgggcgacagggttagtaagggggggggatcaa

SEQ ID NO: 187788 - DNA, 35 bp, Artificial Sequence
  Synthetic oligonucleotide
gtccgccctgccttctattgtaaaccatcagtcaa

SEQ ID NO: 187789 - DNA, 36 bp, Artificial Sequence
  Synthetic oligonucleotide
tccggttcgagacgagggggaagaaagagggacgaa

SEQ ID NO: 187790 - DNA, 36 bp, Artificial Sequence
  Synthetic oligonucleotide
accccctccgcctgccaaggactgcccctacccgaa

SEQ ID NO: 187791 - DNA, 35 bp, Artificial Sequence
  Synthetic oligonucleotide
gatggagggggagagggatccaattggagggcaca

SEQ ID NO: 187792 - DNA, 36 bp, Artificial Sequence
  Synthetic oligonucleotide
aatgccctccaccgaccctctattggcagttagaca

SEQ ID NO: 187793 - DNA, 36 bp, Artificial Sequence
  Synthetic oligonucleotide
gccactcgccgggattcctcgatacgcttcaaccca

SEQ ID NO: 187794 - DNA, 36 bp, Artificial Sequence
  Synthetic oligonucleotide
tcgtgccgggccctatcagcgtgacaacttccccca

SEQ ID NO: 187795 - DNA, 36 bp, Artificial Sequence
  Synthetic oligonucleotide
gagtacccctgttgataaagttcccatccgtcccca

SEQ ID NO: 187796 - DNA, 35 bp, Artificial Sequence
  Synthetic oligonucleotide
tgtcctcagccccaggaccagttgctacacctcca

SEQ ID NO: 187797 - DNA, 36 bp, Artificial Sequence
  Synthetic oligonucleotide
acatagcggaagcttcgttgaactgccctatctcca

SEQ ID NO: 187798 - DNA, 35 bp, Artificial Sequence
  Synthetic oligonucleotide
agccacttcacccttcccccgttcatgtcctagca

SEQ ID NO: 187799 - DNA, 36 bp, Artificial Sequence
  Synthetic oligonucleotide
gagggtgccaagaaagggggatggggataataggca

SEQ ID NO: 187800 - DNA, 35 bp, Artificial Sequence
  Synthetic oligonucleotide
acctcccctcaccgtgcaaattacttgcatatgca

SEQ ID NO: 187801 - DNA, 35 bp, Artificial Sequence
  Synthetic oligonucleotide
ttactcacccgtcattcctgtagtttccaccgtca

SEQ ID NO: 187802 - DNA, 36 bp, Artificial Sequence
  Synthetic oligonucleotide
gatacgcagggtttgctcccgttgcgctcctcttca

SEQ ID NO: 187803 - DNA, 35 bp, Artificial Sequence
  Synthetic oligonucleotide
gtggtcaccaagcaatgcgtccataaccctgttca

SEQ ID NO: 187804 - DNA, 35 bp, Artificial Sequence
  Synthetic oligonucleotide
aaccgccccactcgcgcagttcttcctcctgttca

SEQ ID NO: 187805 - DNA, 35 bp, Artificial Sequence
  Synthetic oligonucleotide
tctagccctgccctagtcgactgacgcccctttca

SEQ ID NO: 187806 - DNA, 37 bp, Artificial Sequence
  Synthetic oligonucleotide
gaggacaggggggggtatgtaagggtggtagtagaga

SEQ ID NO: 187807 - DNA, 36 bp, Artificial Sequence
  Synthetic oligonucleotide
aagaccacgcagccccggaccctcttctctcttaga

SEQ ID NO: 187808 - DNA, 37 bp, Artificial Sequence
  Synthetic oligonucleotide
atggccaccgtctgtgagaacgctccaccccctacga

SEQ ID NO: 187809 - DNA, 36 bp, Artificial Sequence
  Synthetic oligonucleotide
tatccaatcacggctcccctctatctcgctctacga

SEQ ID NO: 187810 - DNA, 36 bp, Artificial Sequence
  Synthetic oligonucleotide
tgcatttgtcagttatcaacttccctgccctcccga

SEQ ID NO: 187811 - DNA, 37 bp, Artificial Sequence
  Synthetic oligonucleotide
ggaaggggaagggtgggatttataggactgaacgcga

SEQ ID NO: 187812 - DNA, 37 bp, Artificial Sequence
  Synthetic oligonucleotide
gagaaactgcgggtggtgagtgggccgggcttatcga

SEQ ID NO: 187813 - DNA, 37 bp, Artificial Sequence
  Synthetic oligonucleotide
tctcccccctccgcttcctccggtgtgcattcacgga

SEQ ID NO: 187814 - DNA, 37 bp, Artificial Sequence
  Synthetic oligonucleotide
tacccccgccccagggtagttcttattgtcacccgga

SEQ ID NO: 187815 - DNA, 35 bp, Artificial Sequence
  Synthetic oligonucleotide
tccgcccctggcacctgctctaccttcctcccgga

SEQ ID NO: 187816 - DNA, 37 bp, Artificial Sequence
  Synthetic oligonucleotide
gttggggtagccggggtgagctggggacgagggcgga

SEQ ID NO: 187817 - DNA, 37 bp, Artificial Sequence
  Synthetic oligonucleotide
gggtggagggatcggaggcgaaacaagcgagaaggga

SEQ ID NO: 187818 - DNA, 36 bp, Artificial Sequence
  Synthetic oligonucleotide
gcaagagggggccgggatgggtaaagagggaaggga

SEQ ID NO: 187819 - DNA, 37 bp, Artificial Sequence
  Synthetic oligonucleotide
tgatttcgccgatccgcccttctccccccaactggga

SEQ ID NO: 187820 - DNA, 37 bp, Artificial Sequence
  Synthetic oligonucleotide
aagtatcgcagcaagagggaagggggcaaggtctgga

SEQ ID NO: 187821 - DNA, 37 bp, Artificial Sequence
  Synthetic oligonucleotide
gacgtgggggagacgagattagggtagcgggggtgga

SEQ ID NO: 187822 - DNA, 37 bp, Artificial Sequence
  Synthetic oligonucleotide
taaggtggaggcggggttggaaggacagcatggtgga

SEQ ID NO: 187823 - DNA, 38 bp, Artificial Sequence
  Synthetic oligonucleotide
tccacgccccgttgccgttccacattatctgcccatga

SEQ ID NO: 187824 - DNA, 37 bp, Artificial Sequence
  Synthetic oligonucleotide
ggtcaagagggagtggtggaggggccgatgtgactga

SEQ ID NO: 187825 - DNA, 37 bp, Artificial Sequence
  Synthetic oligonucleotide
gcgccaacacggttgccgatagccctccttaccctga

SEQ ID NO: 187826 - DNA, 37 bp, Artificial Sequence
  Synthetic oligonucleotide
tcccgtacgtccagtcttctcctacggacccccctga

SEQ ID NO: 187827 - DNA, 35 bp, Artificial Sequence
  Synthetic oligonucleotide
gtgcatacacgcaggacactatcgacctcccctga

SEQ ID NO: 187828 - DNA, 38 bp, Artificial Sequence
  Synthetic oligonucleotide
ttacgcatcggctccttgtacctttgcacacctcctga

SEQ ID NO: 187829 - DNA, 36 bp, Artificial Sequence
  Synthetic oligonucleotide
tagcacaacgtgctgttctgcctcacttctcgctga

SEQ ID NO: 187830 - DNA, 35 bp, Artificial Sequence
  Synthetic oligonucleotide
atgtgatgagacgtgaggggagaaggggaggctga

SEQ ID NO: 187831 - DNA, 38 bp, Artificial Sequence
  Synthetic oligonucleotide
agatacggtcagtggaattcaccatcccccgctgctga

SEQ ID NO: 187832 - DNA, 37 bp, Artificial Sequence
  Synthetic oligonucleotide
gacaatgtcagtcgctcgcctcccacacttttgctga

SEQ ID NO: 187833 - DNA, 36 bp, Artificial Sequence
  Synthetic oligonucleotide
ttaaagggtggaggggtaggggagttactttagtga

SEQ ID NO: 187834 - DNA, 38 bp, Artificial Sequence
  Synthetic oligonucleotide
gaagatcaggagagaggggggtgaggctacgaacgtga

SEQ ID NO: 187835 - DNA, 37 bp, Artificial Sequence
  Synthetic oligonucleotide
tgtcatccacactcccccccgtacgtgcaacacgtga

SEQ ID NO: 187836 - DNA, 38 bp, Artificial Sequence
  Synthetic oligonucleotide
tcccactccactgcgcaccctcgaacagtcttacgtga

SEQ ID NO: 187837 - DNA, 38 bp, Artificial Sequence
  Synthetic oligonucleotide
ggtaagggggtggaggtgaaggggcgcggatgtcgtga

SEQ ID NO: 187838 - DNA, 36 bp, Artificial Sequence
  Synthetic oligonucleotide
gacagatgggggcgcccggaaaggtggaggttgtga

SEQ ID NO: 187839 - DNA, 38 bp, Artificial Sequence
  Synthetic oligonucleotide
gtgtgcgccagtcggtgtttcgtgccacccttccttga

SEQ ID NO: 187840 - DNA, 38 bp, Artificial Sequence
  Synthetic oligonucleotide
gcaaccgcaactacctccctaatgcagtcgttccttga

SEQ ID NO: 187841 - DNA, 38 bp, Artificial Sequence
  Synthetic oligonucleotide
acattcaccgcaggtcagcattacgattgccctcttga

SEQ ID NO: 187842 - DNA, 37 bp, Artificial Sequence
  Synthetic oligonucleotide
gactgccctgctggtccgcattacgcatattctttga

SEQ ID NO: 187843 - DNA, 36 bp, Artificial Sequence
  Synthetic oligonucleotide
gccgcccaagtaaacctgcctcaatgtcctgccata

SEQ ID NO: 187844 - DNA, 36 bp, Artificial Sequence
  Synthetic oligonucleotide
taaacagtcgggggggaggagaggggccgggggata

SEQ ID NO: 187845 - DNA, 36 bp, Artificial Sequence
  Synthetic oligonucleotide
gctgccccgcatctgttctctcgctcgctgttacta

SEQ ID NO: 187846 - DNA, 35 bp, Artificial Sequence
  Synthetic oligonucleotide
accaaccatggtccgccacctgctcgagttcccta

SEQ ID NO: 187847 - DNA, 35 bp, Artificial Sequence
  Synthetic oligonucleotide
gcccactcccgattccctgacgcctgtattgccta

SEQ ID NO: 187848 - DNA, 36 bp, Artificial Sequence
  Synthetic oligonucleotide
atgcgcaccatgcacacatatccctacaccctggta

SEQ ID NO: 187849 - DNA, 36 bp, Artificial Sequence
  Synthetic oligonucleotide
aaccgggacgcgcaacgtcaagccgcccttcctgta

SEQ ID NO: 187850 - DNA, 35 bp, Artificial Sequence
  Synthetic oligonucleotide
tcaaaccacgacccgcacgttctccccactctgta

SEQ ID NO: 187851 - DNA, 35 bp, Artificial Sequence
  Synthetic oligonucleotide
tccaccgcgccaatacccccctgggacccatctta

SEQ ID NO: 187852 - DNA, 36 bp, Artificial Sequence
  Synthetic oligonucleotide
gcgcctcccgtagttacttgtcatctctctccgtta

SEQ ID NO: 187853 - DNA, 36 bp, Artificial Sequence
  Synthetic oligonucleotide
tctatgcccctcaccatgtctatgcaaattcattta

SEQ ID NO: 187854 - DNA, 36 bp, Artificial Sequence
  Synthetic oligonucleotide
gtacggaggttcgcgatcgtactggttccttcttta

SEQ ID NO: 187855 - DNA, 35 bp, Artificial Sequence
  Synthetic oligonucleotide
atgtcgcaactgtgccttccgcgtcaacctgacac

SEQ ID NO: 187856 - DNA, 35 bp, Artificial Sequence
  Synthetic oligonucleotide
aaccttgcctctgttctatcgcgctgtgccttcac

SEQ ID NO: 187857 - DNA, 35 bp, Artificial Sequence
  Synthetic oligonucleotide
accatcaccctagcatattgtagcacatatttcac

SEQ ID NO: 187858 - DNA, 35 bp, Artificial Sequence
  Synthetic oligonucleotide
gacccccctggtaatcctagcagtcccccaaggac

SEQ ID NO: 187859 - DNA, 35 bp, Artificial Sequence
  Synthetic oligonucleotide
tgcgcctccagttccgtccgctctcctccgttgac

SEQ ID NO: 187860 - DNA, 33 bp, Artificial Sequence
  Synthetic oligonucleotide
gccctcagcatccgactctggccactttcttac

SEQ ID NO: 187861 - DNA, 35 bp, Artificial Sequence
  Synthetic oligonucleotide
tttcgactgccgttgcctaccgttctttctacacc

SEQ ID NO: 187862 - DNA, 35 bp, Artificial Sequence
  Synthetic oligonucleotide
gaccgccacttgctgttagatttcgcttcatcacc

SEQ ID NO: 187863 - DNA, 35 bp, Artificial Sequence
  Synthetic oligonucleotide
gaatccccccggatggagtgactcacctcttcccc

SEQ ID NO: 187864 - DNA, 35 bp, Artificial Sequence
  Synthetic oligonucleotide
gtgtcccccacccgcgagctggtttcatatcgccc

SEQ ID NO: 187865 - DNA, 35 bp, Artificial Sequence
  Synthetic oligonucleotide
gcgactccaccggttgcatggacatcgattcgccc

SEQ ID NO: 187866 - DNA, 35 bp, Artificial Sequence
  Synthetic oligonucleotide
gcgagcgactcatttgcccccgtagtacctggccc

SEQ ID NO: 187867 - DNA, 35 bp, Artificial Sequence
  Synthetic oligonucleotide
tcccctctcgcttggtgttacttgttgcactgccc

SEQ ID NO: 187868 - DNA, 29 bp, Artificial Sequence
  Synthetic oligonucleotide
tacttcgccgccctacactatcggtgccc

SEQ ID NO: 187869 - DNA, 35 bp, Artificial Sequence
  Synthetic oligonucleotide
tgcgccaagtccttccctgggttcatcctcgtccc

SEQ ID NO: 187870 - DNA, 35 bp, Artificial Sequence
  Synthetic oligonucleotide
atcgctgtgccgctttcccgttacacggttctgcc

SEQ ID NO: 187871 - DNA, 35 bp, Artificial Sequence
  Synthetic oligonucleotide
tccccaatcgtcacacctcgacctctctggactcc

SEQ ID NO: 187872 - DNA, 35 bp, Artificial Sequence
  Synthetic oligonucleotide
ttcccctccgtgcagtctcctaataggacctctcc

SEQ ID NO: 187873 - DNA, 35 bp, Artificial Sequence
  Synthetic oligonucleotide
tcgctagccgccacagcagtacccgccttttctcc

SEQ ID NO: 187874 - DNA, 35 bp, Artificial Sequence
  Synthetic oligonucleotide
agggcggggcatatgggtgggggtgttatcggtcc

SEQ ID NO: 187875 - DNA, 35 bp, Artificial Sequence
  Synthetic oligonucleotide
tgaaacaccatttgttcctgttccccttcgggtcc

SEQ ID NO: 187876 - DNA, 35 bp, Artificial Sequence
  Synthetic oligonucleotide
gtaacaggcgacactatggtcccgccggtccttcc

SEQ ID NO: 187877 - DNA, 35 bp, Artificial Sequence
  Synthetic oligonucleotide
gtccgtcatctgtactgcgcgtcccctatgcttcc

SEQ ID NO: 187878 - DNA, 35 bp, Artificial Sequence
  Synthetic oligonucleotide
gcacccgcttgccatcattttatcgcccgcaacgc

SEQ ID NO: 187879 - DNA, 35 bp, Artificial Sequence
  Synthetic oligonucleotide
tacattcccgcgccctgttcctagtgcttgcgcgc

SEQ ID NO: 187880 - DNA, 35 bp, Artificial Sequence
  Synthetic oligonucleotide
gatcccctcgatgtcactaacgtctaattcctcgc

SEQ ID NO: 187881 - DNA, 35 bp, Artificial Sequence
  Synthetic oligonucleotide
accgcggtgccttaccctatgtcgtttttcctcgc

SEQ ID NO: 187882 - DNA, 35 bp, Artificial Sequence
  Synthetic oligonucleotide
tgtggtacccccaatgtcctcgcccgatagctcgc

SEQ ID NO: 187883 - DNA, 35 bp, Artificial Sequence
  Synthetic oligonucleotide
gacctgccctctatctgccatctgttctttctcgc

SEQ ID NO: 187884 - DNA, 35 bp, Artificial Sequence
  Synthetic oligonucleotide
acccgatgtccgttgagcgttcatttcccattcgc

SEQ ID NO: 187885 - DNA, 35 bp, Artificial Sequence
  Synthetic oligonucleotide
gacattcaaccaactcgagtccgccgccgtttcgc

SEQ ID NO: 187886 - DNA, 35 bp, Artificial Sequence
  Synthetic oligonucleotide
tgctctcacctgttccctaaggcccggctttaatc

SEQ ID NO: 187887 - DNA, 35 bp, Artificial Sequence
  Synthetic oligonucleotide
gcgaccgagccctgacgcaccttcacctgtacatc

SEQ ID NO: 187888 - DNA, 35 bp, Artificial Sequence
  Synthetic oligonucleotide
ggaactgcctttctggcgcagattcccgccctatc

SEQ ID NO: 187889 - DNA, 35 bp, Artificial Sequence
  Synthetic oligonucleotide
gtccaaactgagcattgtgacttcctggctccctc

SEQ ID NO: 187890 - DNA, 35 bp, Artificial Sequence
  Synthetic oligonucleotide
gcgtagccgccctgaacgttgctcttcactgcctc

SEQ ID NO: 187891 - DNA, 35 bp, Artificial Sequence
  Synthetic oligonucleotide
acgctcccctacagtgtcccacgcttgcctgcctc

SEQ ID NO: 187892 - DNA, 35 bp, Artificial Sequence
  Synthetic oligonucleotide
gcacgaaagtgcctccgtagtacatccgcttcctc

SEQ ID NO: 187893 - DNA, 35 bp, Artificial Sequence
  Synthetic oligonucleotide
gcatatacacactgctcagttctgcactttcgctc

SEQ ID NO: 187894 - DNA, 35 bp, Artificial Sequence
  Synthetic oligonucleotide
agtcgacctccacacccgctgctcaagcttacgtc

SEQ ID NO: 187895 - DNA, 35 bp, Artificial Sequence
  Synthetic oligonucleotide
ttaggcattgttcatggctgctttccgttctcgtc

SEQ ID NO: 187896 - DNA, 35 bp, Artificial Sequence
  Synthetic oligonucleotide
gtccacatccccttgccctctaagtgtaaagcttc

SEQ ID NO: 187897 - DNA, 35 bp, Artificial Sequence
  Synthetic oligonucleotide
gaaggggcgggaattaggaatgtaggacacgggag

SEQ ID NO: 187898 - DNA, 35 bp, Artificial Sequence
  Synthetic oligonucleotide
acaccttgccctgtaccccgttaatctcatctacg

SEQ ID NO: 187899 - DNA, 35 bp, Artificial Sequence
  Synthetic oligonucleotide
cggtcgcaccgccgtcatcacccgccgtccccccg

SEQ ID NO: 187900 - DNA, 35 bp, Artificial Sequence
  Synthetic oligonucleotide
atccctctcgcccgataagacccgccgccactccg

SEQ ID NO: 187901 - DNA, 35 bp, Artificial Sequence
  Synthetic oligonucleotide
attcgcactcccgcattggcctttagctttactcg

SEQ ID NO: 187902 - DNA, 35 bp, Artificial Sequence
  Synthetic oligonucleotide
tgacccccctctggttgagttgcccgcctctctcg

SEQ ID NO: 187903 - DNA, 36 bp, Artificial Sequence
  Synthetic oligonucleotide
gccccgcccactacctcgtttactcgcattacttcg

SEQ ID NO: 187904 - DNA, 35 bp, Artificial Sequence
  Synthetic oligonucleotide
tgaaggggccgtcgtggggcaggggttcaagaggg

SEQ ID NO: 187905 - DNA, 35 bp, Artificial Sequence
  Synthetic oligonucleotide
ttgttgcaggcagtctatcgttcctcccgcgctgg

SEQ ID NO: 187906 - DNA, 35 bp, Artificial Sequence
  Synthetic oligonucleotide
tcccccctcgccacctgagccccccgcttttctgg

SEQ ID NO: 187907 - DNA, 35 bp, Artificial Sequence
  Synthetic oligonucleotide
tagcccgtgcccccccatcgttccaatatcagatg

SEQ ID NO: 187908 - DNA, 35 bp, Artificial Sequence
  Synthetic oligonucleotide
ttggccccgcaccgttcacaacctatccatttatg

SEQ ID NO: 187909 - DNA, 35 bp, Artificial Sequence
  Synthetic oligonucleotide
gacacgcatcagcatccgtctcctgtcctcctctg

SEQ ID NO: 187910 - DNA, 35 bp, Artificial Sequence
  Synthetic oligonucleotide
gtacgccgacgccgcagccgcttactaccctcaat

SEQ ID NO: 187911 - DNA, 35 bp, Artificial Sequence
  Synthetic oligonucleotide
tcccccctgccgcccactgcctcgtgtcccttaat

SEQ ID NO: 187912 - DNA, 35 bp, Artificial Sequence
  Synthetic oligonucleotide
agcactgcatactgtctcgctgttatctcccccat

SEQ ID NO: 187913 - DNA, 35 bp, Artificial Sequence
  Synthetic oligonucleotide
gcgcgtagcaccatcgggatcctgccaccttaact

SEQ ID NO: 187914 - DNA, 35 bp, Artificial Sequence
  Synthetic oligonucleotide
gatggggaatggatggacgggacgaaagcgcgact

SEQ ID NO: 187915 - DNA, 35 bp, Artificial Sequence
  Synthetic oligonucleotide
tatcagcaactggcttgcactctctccactttact

SEQ ID NO: 187916 - DNA, 35 bp, Artificial Sequence
  Synthetic oligonucleotide
atgttaccgcgtacatctttatgcgcactcaccct

SEQ ID NO: 187917 - DNA, 35 bp, Artificial Sequence
  Synthetic oligonucleotide
agcccgttgcggtccttctacccgagctctaccct

SEQ ID NO: 187918 - DNA, 35 bp, Artificial Sequence
  Synthetic oligonucleotide
taaaaccgccgccggtgaccctacacttgtgccct

SEQ ID NO: 187919 - DNA, 35 bp, Artificial Sequence
  Synthetic oligonucleotide
aacacgtctcacgggtccctttcgtactttcatct

SEQ ID NO: 187920 - DNA, 35 bp, Artificial Sequence
  Synthetic oligonucleotide
tccatcctcgcccgtgaatcgcttaaccttgctct

SEQ ID NO: 187921 - DNA, 35 bp, Artificial Sequence
  Synthetic oligonucleotide
gaggggagtgggggggagtgggatctagcaggtct

SEQ ID NO: 187922 - DNA, 35 bp, Artificial Sequence
  Synthetic oligonucleotide
atcgttgcaacgtaaccggtcctcctcgtacttct

SEQ ID NO: 187923 - DNA, 35 bp, Artificial Sequence
  Synthetic oligonucleotide
taatcaggcgtgttaccgtccatcctccccgttct

SEQ ID NO: 187924 - DNA, 35 bp, Artificial Sequence
  Synthetic oligonucleotide
gccgctacatcgcatcctggtcctaacatcccagt

SEQ ID NO: 187925 - DNA, 36 bp, Artificial Sequence
  Synthetic oligonucleotide
tgccggttcacagccgcaacgtctttccctctccgt

SEQ ID NO: 187926 - DNA, 35 bp, Artificial Sequence
  Synthetic oligonucleotide
gaccctcccctgacgattaaagtgtatccttcggt

SEQ ID NO: 187927 - DNA, 35 bp, Artificial Sequence
  Synthetic oligonucleotide
gactgacacaacgggcctccgatatccttcacctt

SEQ ID NO: 187928 - DNA, 35 bp, Artificial Sequence
  Synthetic oligonucleotide
atgcgaatcgtgaatgcgtcactcgggccatcctt

SEQ ID NO: 187929 - DNA, 35 bp, Artificial Sequence
  Synthetic oligonucleotide
gcgcaccgttgtgcgtcactcatagtttcctcctt

SEQ ID NO: 187930 - DNA, 35 bp, Artificial Sequence
  Synthetic oligonucleotide
atgccacgcacctcccatgatgtccacttgtcctt

SEQ ID NO: 187931 - DNA, 35 bp, Artificial Sequence
  Synthetic oligonucleotide
tcgatctctgacgccgggccacactctcttctgtt

SEQ ID NO: 187932 - DNA, 36 bp, Artificial Sequence
  Synthetic oligonucleotide
gttgaggggaggagggggggtgaagcattgctcaaa

SEQ ID NO: 187933 - DNA, 36 bp, Artificial Sequence
  Synthetic oligonucleotide
aagagaggagggtgtgatataggggccgcggggaaa

SEQ ID NO: 187934 - DNA, 36 bp, Artificial Sequence
  Synthetic oligonucleotide
tgcaacccccatctactccaagcagctggtttccaa

SEQ ID NO: 187935 - DNA, 36 bp, Artificial Sequence
  Synthetic oligonucleotide
tctcacccgccgaccgcctcactacgtgcatacgaa

SEQ ID NO: 187936 - DNA, 35 bp, Artificial Sequence
  Synthetic oligonucleotide
actgccactgggcccatacgaatccactctgctaa

SEQ ID NO: 187937 - DNA, 36 bp, Artificial Sequence
  Synthetic oligonucleotide
acgtgcatcccccgtcatcgttctccatgccgtaca

SEQ ID NO: 187938 - DNA, 35 bp, Artificial Sequence
  Synthetic oligonucleotide
tcacggtaccgcgtggccgccgtttagcccttaca

SEQ ID NO: 187939 - DNA, 36 bp, Artificial Sequence
  Synthetic oligonucleotide
tcacctagttcccatcacggtctcgtgcctgttaca

SEQ ID NO: 187940 - DNA, 35 bp, Artificial Sequence
  Synthetic oligonucleotide
acaccctcccctgtgccgttgatgtgctgcaacca

SEQ ID NO: 187941 - DNA, 35 bp, Artificial Sequence
  Synthetic oligonucleotide
gtccgccctttatacgttttttgtccccgctacca

SEQ ID NO: 187942 - DNA, 35 bp, Artificial Sequence
  Synthetic oligonucleotide
tgcaacccacatgcgttcaccaccccgcgcaccca

SEQ ID NO: 187943 - DNA, 36 bp, Artificial Sequence
  Synthetic oligonucleotide
tgcggggagggcggggttgtcctatgtcgggaccca

SEQ ID NO: 187944 - DNA, 35 bp, Artificial Sequence
  Synthetic oligonucleotide
tgacctgttcgacctttacgctggttccttgccca

SEQ ID NO: 187945 - DNA, 35 bp, Artificial Sequence
  Synthetic oligonucleotide
ttggaccctaacgcctagccatggcctcgatccca

SEQ ID NO: 187946 - DNA, 32 bp, Artificial Sequence
  Synthetic oligonucleotide
tccgtccgctcaggccgtccctcgccccgcca

SEQ ID NO: 187947 - DNA, 35 bp, Artificial Sequence
  Synthetic oligonucleotide
ggggcgacacgtcgatcttgagatccctccctcca

SEQ ID NO: 187948 - DNA, 36 bp, Artificial Sequence
  Synthetic oligonucleotide
tccaccgccggtgaaacgataccaccctcgcctcca

SEQ ID NO: 187949 - DNA, 35 bp, Artificial Sequence
  Synthetic oligonucleotide
tccacccgcggtcttacattcctaccctcatagca

SEQ ID NO: 187950 - DNA, 36 bp, Artificial Sequence
  Synthetic oligonucleotide
atgggacagggggacgcaaagtgcgagggaacggca

SEQ ID NO: 187951 - DNA, 35 bp, Artificial Sequence
  Synthetic oligonucleotide
aacacagaggggattgaggggggtgcagttggtca

SEQ ID NO: 187952 - DNA, 36 bp, Artificial Sequence
  Synthetic oligonucleotide
gcctcctctatgcttcacctccagggtaccatttca

SEQ ID NO: 187953 - DNA, 35 bp, Artificial Sequence
  Synthetic oligonucleotide
tatgggcgtcggtgtattagggagggtgggtttca

SEQ ID NO: 187954 - DNA, 36 bp, Artificial Sequence
  Synthetic oligonucleotide
tgaacaaccctctctcttcgtctgcgagaccgcaga

SEQ ID NO: 187955 - DNA, 37 bp, Artificial Sequence
  Synthetic oligonucleotide
aagacggtactgttgtaggggacgtgagggagggaga

SEQ ID NO: 187956 - DNA, 37 bp, Artificial Sequence
  Synthetic oligonucleotide
acgcaaaaagtagggggaagggtaaccaagtgggaga

SEQ ID NO: 187957 - DNA, 37 bp, Artificial Sequence
  Synthetic oligonucleotide
gtgccccccattatgcttttttgttaccgagccacga

SEQ ID NO: 187958 - DNA, 37 bp, Artificial Sequence
  Synthetic oligonucleotide
gctacaccctctctctcaccgtcccacccctggacga

SEQ ID NO: 187959 - DNA, 37 bp, Artificial Sequence
  Synthetic oligonucleotide
tctcacctcgcatccctcgtgcactacctcgctacga

SEQ ID NO: 187960 - DNA, 37 bp, Artificial Sequence
  Synthetic oligonucleotide
acacgcacgatacgcccatgttccctctgtcctccga

SEQ ID NO: 187961 - DNA, 36 bp, Artificial Sequence
  Synthetic oligonucleotide
tgcaaggggaaatctgtagggtgaaggggatggcga

SEQ ID NO: 187962 - DNA, 34 bp, Artificial Sequence
  Synthetic oligonucleotide
gccactgacagttatttccattcgccgtactcga

SEQ ID NO: 187963 - DNA, 37 bp, Artificial Sequence
  Synthetic oligonucleotide
gcgtgtccgcctggctactatttccaccgtacttcga

SEQ ID NO: 187964 - DNA, 37 bp, Artificial Sequence
  Synthetic oligonucleotide
aaatgggggaggcaggggggaggggcatgctatagga

SEQ ID NO: 187965 - DNA, 36 bp, Artificial Sequence
  Synthetic oligonucleotide
ttacacccgccatccatcatagcaataggcctagga

SEQ ID NO: 187966 - DNA, 35 bp, Artificial Sequence
  Synthetic oligonucleotide
gagaggtggatggaggtgaaaacaagggcgtagga

SEQ ID NO: 187967 - DNA, 36 bp, Artificial Sequence
  Synthetic oligonucleotide
ttcgccccacctctgcctttccgcgtgcccttagga

SEQ ID NO: 187968 - DNA, 37 bp, Artificial Sequence
  Synthetic oligonucleotide
tccaactcctccatcgctctgccgtgcacccaacgga

SEQ ID NO: 187969 - DNA, 37 bp, Artificial Sequence
  Synthetic oligonucleotide
tcattcgcctcctacataaccgtccctcgtccgcgga

SEQ ID NO: 187970 - DNA, 37 bp, Artificial Sequence
  Synthetic oligonucleotide
gtgggtggaggcgcaacgaggggcgaggtaggaggga

SEQ ID NO: 187971 - DNA, 37 bp, Artificial Sequence
  Synthetic oligonucleotide
tcgcggaccacgggacaattatgggactagggaggga

SEQ ID NO: 187972 - DNA, 37 bp, Artificial Sequence
  Synthetic oligonucleotide
acagatgaatggggggaaagttgcaaaacgggaggga

SEQ ID NO: 187973 - DNA, 37 bp, Artificial Sequence
  Synthetic oligonucleotide
gtcagaggaagggcacgggaaagtggaagcaacggga

SEQ ID NO: 187974 - DNA, 37 bp, Artificial Sequence
  Synthetic oligonucleotide
gccctggcggggtgtcctaggggcgcgtattagggga

SEQ ID NO: 187975 - DNA, 37 bp, Artificial Sequence
  Synthetic oligonucleotide
gctcactccccaatgacccgccgcatcatgccaatga

SEQ ID NO: 187976 - DNA, 38 bp, Artificial Sequence
  Synthetic oligonucleotide
acgagggaagagggaatacggactgcggagggggatga

SEQ ID NO: 187977 - DNA, 38 bp, Artificial Sequence
  Synthetic oligonucleotide
tgactgcgcgggagaagggagcacgaggaaggatatga

SEQ ID NO: 187978 - DNA, 36 bp, Artificial Sequence
  Synthetic oligonucleotide
tatacctccacctctgatcgttctgcctaaacctga

SEQ ID NO: 187979 - DNA, 38 bp, Artificial Sequence
  Synthetic oligonucleotide
gacacgtgctgccgttccgccgttcccatcctacctga

SEQ ID NO: 187980 - DNA, 37 bp, Artificial Sequence
  Synthetic oligonucleotide
tcaacaccttctcttgtttcagacgctcttagcctga

SEQ ID NO: 187981 - DNA, 38 bp, Artificial Sequence
  Synthetic oligonucleotide
acctcctgcagttgtcctcttagtgtcctcccttctga

SEQ ID NO: 187982 - DNA, 38 bp, Artificial Sequence
  Synthetic oligonucleotide
tccgcccgcccccctcttaccgagactcgaaatcgtga

SEQ ID NO: 187983 - DNA, 38 bp, Artificial Sequence
  Synthetic oligonucleotide
gttcaccccctccgaggcaatagatatggcacacttga

SEQ ID NO: 187984 - DNA, 38 bp, Artificial Sequence
  Synthetic oligonucleotide
gtaaggtgggtggaaggggcgggataagtggaagttga

SEQ ID NO: 187985 - DNA, 38 bp, Artificial Sequence
  Synthetic oligonucleotide
gttcaaagaagggggaggcataggaggggtacagttga

SEQ ID NO: 187986 - DNA, 38 bp, Artificial Sequence
  Synthetic oligonucleotide
gccatccccattcctgccactagagagtcctcggttga

SEQ ID NO: 187987 - DNA, 37 bp, Artificial Sequence
  Synthetic oligonucleotide
ggaggtggttgggtggacttatggcggtacctgttga

SEQ ID NO: 187988 - DNA, 37 bp, Artificial Sequence
  Synthetic oligonucleotide
gtgactaacgcttgtagtgcttccctcgtccctttga

SEQ ID NO: 187989 - DNA, 36 bp, Artificial Sequence
  Synthetic oligonucleotide
tcaacaaaccgcccctgcattcgccttcttgacata

SEQ ID NO: 187990 - DNA, 35 bp, Artificial Sequence
  Synthetic oligonucleotide
gtgacgcccacccatccattatgagcattcgtata

SEQ ID NO: 187991 - DNA, 36 bp, Artificial Sequence
  Synthetic oligonucleotide
tgtgcccgccacatctgctccacccacgcttgtata

SEQ ID NO: 187992 - DNA, 35 bp, Artificial Sequence
  Synthetic oligonucleotide
ttgagccgcctgtagcctggcccatttacttacta

SEQ ID NO: 187993 - DNA, 36 bp, Artificial Sequence
  Synthetic oligonucleotide
gactacccacctcaggcgctaatgggcgcatcccta

SEQ ID NO: 187994 - DNA, 36 bp, Artificial Sequence
  Synthetic oligonucleotide
tgccgcagtgagggcagggagggataccaagggcta

SEQ ID NO: 187995 - DNA, 35 bp, Artificial Sequence
  Synthetic oligonucleotide
atcgccttcactatgccgccggtactaatcttcta

SEQ ID NO: 187996 - DNA, 36 bp, Artificial Sequence
  Synthetic oligonucleotide
gtgcacgttgatatcgccatcccaccctctgtagta

SEQ ID NO: 187997 - DNA, 35 bp, Artificial Sequence
  Synthetic oligonucleotide
gtaccacccgccactttgccccaatccgaccggta

SEQ ID NO: 187998 - DNA, 35 bp, Artificial Sequence
  Synthetic oligonucleotide
gtgaaccaagggtgggatagactgagggccgggta

SEQ ID NO: 187999 - DNA, 35 bp, Artificial Sequence
  Synthetic oligonucleotide
tgtccacatccttttccgccgactccctgatggta

SEQ ID NO: 188000 - DNA, 35 bp, Artificial Sequence
  Synthetic oligonucleotide
gatcgccgtccgcttcactttcaatcgcactggta

SEQ ID NO: 188001 - DNA, 35 bp, Artificial Sequence
  Synthetic oligonucleotide
gtatcgccccctctgctatcattcgaatatctgta

SEQ ID NO: 188002 - DNA, 35 bp, Artificial Sequence
  Synthetic oligonucleotide
acgatcgccaccacacatctgcatactgctcatta

SEQ ID NO: 188003 - DNA, 35 bp, Artificial Sequence
  Synthetic oligonucleotide
tcaatcccgctccctccgactgcagttcgggctta

SEQ ID NO: 188004 - DNA, 35 bp, Artificial Sequence
  Synthetic oligonucleotide
tgtccgcgcgcaatacacctctccgcctgtagtta

SEQ ID NO: 188005 - DNA, 35 bp, Artificial Sequence
  Synthetic oligonucleotide
gaaaggccgatcgaccgaaggaggagagggattta

SEQ ID NO: 188006 - DNA, 36 bp, Artificial Sequence
  Synthetic oligonucleotide
ttcgactgaatgatgccgtcttactcccccgcttta

SEQ ID NO: 188007 - DNA, 35 bp, Artificial Sequence
  Synthetic oligonucleotide
gaagggggtctcaaaatctgggggcggggttcaac

SEQ ID NO: 188008 - DNA, 35 bp, Artificial Sequence
  Synthetic oligonucleotide
tgtccgttcgacgcggaaaggcccctgcacaccac

SEQ ID NO: 188009 - DNA, 35 bp, Artificial Sequence
  Synthetic oligonucleotide
acccccaccatccactggcaatatttctgggcgac

SEQ ID NO: 188010 - DNA, 35 bp, Artificial Sequence
  Synthetic oligonucleotide
tagtcgccgtaccatctctggcttatgacccgtac

SEQ ID NO: 188011 - DNA, 35 bp, Artificial Sequence
  Synthetic oligonucleotide
ttgtgcccacgtcctccctcgtatgcaatttgtac

SEQ ID NO: 188012 - DNA, 35 bp, Artificial Sequence
  Synthetic oligonucleotide
tcctaccacgacattctcttttagcctcgcattac

SEQ ID NO: 188013 - DNA, 35 bp, Artificial Sequence
  Synthetic oligonucleotide
tgcttcccatcttgtgcgcccatcacagctgaacc

SEQ ID NO: 188014 - DNA, 35 bp, Artificial Sequence
  Synthetic oligonucleotide
ggtgccaacttcactcggtgacctgaccccccacc

SEQ ID NO: 188015 - DNA, 35 bp, Artificial Sequence
  Synthetic oligonucleotide
tcagacccgctggatcttgcccctctggtttcacc

SEQ ID NO: 188016 - DNA, 35 bp, Artificial Sequence
  Synthetic oligonucleotide
tacgccccaaccaatgattgcgtgatctaccgccc

SEQ ID NO: 188017 - DNA, 35 bp, Artificial Sequence
  Synthetic oligonucleotide
aacccccctagatgttgtcctccccgtctggtccc

SEQ ID NO: 188018 - DNA, 35 bp, Artificial Sequence
  Synthetic oligonucleotide
agatgacccgtgattactagcgcggcccccccgcc

SEQ ID NO: 188019 - DNA, 35 bp, Artificial Sequence
  Synthetic oligonucleotide
atcgcggaagctggtcgacccattcctctctggcc

SEQ ID NO: 188020 - DNA, 35 bp, Artificial Sequence
  Synthetic oligonucleotide
ttgaactcagggcattatacgctccatctgtggcc

SEQ ID NO: 188021 - DNA, 35 bp, Artificial Sequence
  Synthetic oligonucleotide
tgccaccatgttttgtgcagccgtatcctcctgcc

SEQ ID NO: 188022 - DNA, 35 bp, Artificial Sequence
  Synthetic oligonucleotide
aactcccgctccatgcgtctcccagaccctctgcc

SEQ ID NO: 188023 - DNA, 35 bp, Artificial Sequence
  Synthetic oligonucleotide
gcatacggtaactgtatagtgtcgccccttttgcc

SEQ ID NO: 188024 - DNA, 35 bp, Artificial Sequence
  Synthetic oligonucleotide
taggacgatggttagtcgcccctctcttttgatcc

SEQ ID NO: 188025 - DNA, 35 bp, Artificial Sequence
  Synthetic oligonucleotide
agaccggtgcccagtgtcagtgtccacctctatcc

SEQ ID NO: 188026 - DNA, 35 bp, Artificial Sequence
  Synthetic oligonucleotide
tgcgagatcatgtatcgccacccacatcgctttcc

SEQ ID NO: 188027 - DNA, 35 bp, Artificial Sequence
  Synthetic oligonucleotide
gccagtatacgtgcaacatttgtctcccccttggc

SEQ ID NO: 188028 - DNA, 35 bp, Artificial Sequence
  Synthetic oligonucleotide
aagttcgcgcggttaactctgcacctcccgcttgc

SEQ ID NO: 188029 - DNA, 35 bp, Artificial Sequence
  Synthetic oligonucleotide
gcccgtctgcccgaccttgccccccacatttaatc

SEQ ID NO: 188030 - DNA, 35 bp, Artificial Sequence
  Synthetic oligonucleotide
taccgttccgtctgccgtatttttgttattccatc

SEQ ID NO: 188031 - DNA, 35 bp, Artificial Sequence
  Synthetic oligonucleotide
ttggttaggcctcactgctgcacctatctctcatc

SEQ ID NO: 188032 - DNA, 35 bp, Artificial Sequence
  Synthetic oligonucleotide
atcatttcgcctcacacgcccggattcccgctatc

SEQ ID NO: 188033 - DNA, 28 bp, Artificial Sequence
  Synthetic oligonucleotide
actgttcttcccacgcaactcgaacctc

SEQ ID NO: 188034 - DNA, 35 bp, Artificial Sequence
  Synthetic oligonucleotide
taccctgccccgagcgtgctgccctcaagcccctc

SEQ ID NO: 188035 - DNA, 35 bp, Artificial Sequence
  Synthetic oligonucleotide
atgaccctgttcgggttgtggtcgtactttccctc

SEQ ID NO: 188036 - DNA, 35 bp, Artificial Sequence
  Synthetic oligonucleotide
tctcgcaccgcctctcgtcccgcgggttcctcctc

SEQ ID NO: 188037 - DNA, 35 bp, Artificial Sequence
  Synthetic oligonucleotide
gttggctccgaggttttatcgctgctattactctc

SEQ ID NO: 188038 - DNA, 35 bp, Artificial Sequence
  Synthetic oligonucleotide
tcccttggtcccaacccgtgttataccttaccgtc

SEQ ID NO: 188039 - DNA, 35 bp, Artificial Sequence
  Synthetic oligonucleotide
acctcattcgtgttctatccttcaccagtctcgtc

SEQ ID NO: 188040 - DNA, 35 bp, Artificial Sequence
  Synthetic oligonucleotide
acccaccattgagtgctatccgctttgacggtgtc

SEQ ID NO: 188041 - DNA, 35 bp, Artificial Sequence
  Synthetic oligonucleotide
taccccgtgttgccttactgtctgtttccccattc

SEQ ID NO: 188042 - DNA, 35 bp, Artificial Sequence
  Synthetic oligonucleotide
gcgccaacacacacctatttgtcgacccggccttc

SEQ ID NO: 188043 - DNA, 35 bp, Artificial Sequence
  Synthetic oligonucleotide
tacgcccattacctccgcccgttatgctactgttc

SEQ ID NO: 188044 - DNA, 35 bp, Artificial Sequence
  Synthetic oligonucleotide
aaccgagggaatggaagagagatgggctgcttaag

SEQ ID NO: 188045 - DNA, 34 bp, Artificial Sequence
  Synthetic oligonucleotide
aactgatctaggggtgagggtggaggataaagag

SEQ ID NO: 188046 - DNA, 35 bp, Artificial Sequence
  Synthetic oligonucleotide
gagtcctccgccattccgtatcccttcaaccttag

SEQ ID NO: 188047 - DNA, 35 bp, Artificial Sequence
  Synthetic oligonucleotide
agaaatgtggaggatgggggagttaaatggggccg

SEQ ID NO: 188048 - DNA, 35 bp, Artificial Sequence
  Synthetic oligonucleotide
gccaaccccaacactttgacaccacgccccttccg

SEQ ID NO: 188049 - DNA, 35 bp, Artificial Sequence
  Synthetic oligonucleotide
tgtgcaaccacggctccccccttcttccaagttgg

SEQ ID NO: 188050 - DNA, 35 bp, Artificial Sequence
  Synthetic oligonucleotide
ggagggcctgggaacaagggaatcggtaaggcatg

SEQ ID NO: 188051 - DNA, 35 bp, Artificial Sequence
  Synthetic oligonucleotide
gggattagggcaaggtggtggagggctggatcatg

SEQ ID NO: 188052 - DNA, 36 bp, Artificial Sequence
  Synthetic oligonucleotide
gggagcaacgttggaatgggagggcgtgggttgatg

SEQ ID NO: 188053 - DNA, 35 bp, Artificial Sequence
  Synthetic oligonucleotide
gtgcacctcctgtcttgaattcatggtactccctg

SEQ ID NO: 188054 - DNA, 35 bp, Artificial Sequence
  Synthetic oligonucleotide
gtgacccaatctgcacaagtgcctgtccttccctg

SEQ ID NO: 188055 - DNA, 35 bp, Artificial Sequence
  Synthetic oligonucleotide
gcatatgaaggcggggttttaacgggggacgggtg

SEQ ID NO: 188056 - DNA, 35 bp, Artificial Sequence
  Synthetic oligonucleotide
gttacacccgcattctgttctttgtgcctctccat

SEQ ID NO: 188057 - DNA, 35 bp, Artificial Sequence
  Synthetic oligonucleotide
tcgtgaccgccactgaccccgccgcaattttccat

SEQ ID NO: 188058 - DNA, 35 bp, Artificial Sequence
  Synthetic oligonucleotide
gtatcgtgagtggagggggggtaacggaatacgat

SEQ ID NO: 188059 - DNA, 35 bp, Artificial Sequence
  Synthetic oligonucleotide
ggaacactggcagggtgggccgggagtaggaggat

SEQ ID NO: 188060 - DNA, 35 bp, Artificial Sequence
  Synthetic oligonucleotide
gatctaaacctcgcccggaccacatgttgtggact

SEQ ID NO: 188061 - DNA, 35 bp, Artificial Sequence
  Synthetic oligonucleotide
tgcccgtgaaagcgcaataactatcggctccacct

SEQ ID NO: 188062 - DNA, 35 bp, Artificial Sequence
  Synthetic oligonucleotide
aacccgatccgcgatgtcgcccttcgcaccgccct

SEQ ID NO: 188063 - DNA, 35 bp, Artificial Sequence
  Synthetic oligonucleotide
gcaggcgcgaagcacataaagccccgtcctgccct

SEQ ID NO: 188064 - DNA, 35 bp, Artificial Sequence
  Synthetic oligonucleotide
acgccgccccatactgttggtctttataaccgcct

SEQ ID NO: 188065 - DNA, 35 bp, Artificial Sequence
  Synthetic oligonucleotide
atggtcaagggtcataatctccattgttccatcct

SEQ ID NO: 188066 - DNA, 35 bp, Artificial Sequence
  Synthetic oligonucleotide
agtccgccgtttagtcggcccgattcatccttcct

SEQ ID NO: 188067 - DNA, 35 bp, Artificial Sequence
  Synthetic oligonucleotide
gtacctaccgcttcaccagccctttgtttgtcgct

SEQ ID NO: 188068 - DNA, 35 bp, Artificial Sequence
  Synthetic oligonucleotide
tcccaccgtccggtccaacctgttgaattcctgct

SEQ ID NO: 188069 - DNA, 35 bp, Artificial Sequence
  Synthetic oligonucleotide
tttcgcatgccagcatcccggcgccctttattgct

SEQ ID NO: 188070 - DNA, 35 bp, Artificial Sequence
  Synthetic oligonucleotide
aacttggccctgtttccatcgtgttttgtccatct

SEQ ID NO: 188071 - DNA, 35 bp, Artificial Sequence
  Synthetic oligonucleotide
gtaagtgggggatgggcgtaatggggaaacggagt

SEQ ID NO: 188072 - DNA, 35 bp, Artificial Sequence
  Synthetic oligonucleotide
taattggccaacgtcccaggtctccgctctcccgt

SEQ ID NO: 188073 - DNA, 35 bp, Artificial Sequence
  Synthetic oligonucleotide
tgcgcgcagccactgtccctggtattcctgtccgt

SEQ ID NO: 188074 - DNA, 35 bp, Artificial Sequence
  Synthetic oligonucleotide
actatcaccgcctcttacctttaccctgttatggt

SEQ ID NO: 188075 - DNA, 33 bp, Artificial Sequence
  Synthetic oligonucleotide
acgctcaccgccccatttgcttatccgtagtgt

SEQ ID NO: 188076 - DNA, 35 bp, Artificial Sequence
  Synthetic oligonucleotide
tcacctaccatctgcattttttattgacgtatatt

SEQ ID NO: 188077 - DNA, 35 bp, Artificial Sequence
  Synthetic oligonucleotide
accgtccggtcccagccactctcgaatcgcttatt

SEQ ID NO: 188078 - DNA, 35 bp, Artificial Sequence
  Synthetic oligonucleotide
agtgcgtcggttccattgccacccgcttatgcctt

SEQ ID NO: 188079 - DNA, 35 bp, Artificial Sequence
  Synthetic oligonucleotide
tgcgaatcaccacaacactagtgcacactgctctt

SEQ ID NO: 188080 - DNA, 35 bp, Artificial Sequence
  Synthetic oligonucleotide
tttgaacgtcctggccattgtatcgctctctcgtt

SEQ ID NO: 188081 - DNA, 35 bp, Artificial Sequence
  Synthetic oligonucleotide
atgtgacacggtaaagagggggtatgagggcggtt

SEQ ID NO: 188082 - DNA, 35 bp, Artificial Sequence
  Synthetic oligonucleotide
ttggggggtgagggaggaacagagacgtcagggtt

SEQ ID NO: 188083 - DNA, 35 bp, Artificial Sequence
  Synthetic oligonucleotide
acacgtccacgcccgccacaatgtcatttcctgtt

SEQ ID NO: 188084 - DNA, 35 bp, Artificial Sequence
  Synthetic oligonucleotide
acgcgagtgccccgccactcaccgatcactgtttt

SEQ ID NO: 188085 - DNA, 36 bp, Artificial Sequence
  Synthetic oligonucleotide
gctgacccatcgccgtatcccttatattactcccaa

SEQ ID NO: 188086 - DNA, 36 bp, Artificial Sequence
  Synthetic oligonucleotide
gaaccaccgcggcccaatgttccttcctgtatccaa

SEQ ID NO: 188087 - DNA, 35 bp, Artificial Sequence
  Synthetic oligonucleotide
aacgcccgctcccccgcacctaagtttgtccgcaa

SEQ ID NO: 188088 - DNA, 36 bp, Artificial Sequence
  Synthetic oligonucleotide
atccgtcaccacgtgctgccctctctctctactcaa

SEQ ID NO: 188089 - DNA, 36 bp, Artificial Sequence
  Synthetic oligonucleotide
gcacgggtgatgagtaccgcccgttccccatctcaa

SEQ ID NO: 188090 - DNA, 35 bp, Artificial Sequence
  Synthetic oligonucleotide
actcacccccccacactgtcgctatccaaactgaa

SEQ ID NO: 188091 - DNA, 36 bp, Artificial Sequence
  Synthetic oligonucleotide
gactcgccatcctggtcccctttgcctttcttctaa

SEQ ID NO: 188092 - DNA, 35 bp, Artificial Sequence
  Synthetic oligonucleotide
acaccgccctaccctgctcggtaaaacccttgtaa

SEQ ID NO: 188093 - DNA, 35 bp, Artificial Sequence
  Synthetic oligonucleotide
acgaccgacgcggtctgctcttattccccactaca

SEQ ID NO: 188094 - DNA, 35 bp, Artificial Sequence
  Synthetic oligonucleotide
gctcgcctacattgcatatgtcagcattccgccca

SEQ ID NO: 188095 - DNA, 36 bp, Artificial Sequence
  Synthetic oligonucleotide
gcctgttaccggggtgtcgttccgttccacttccca

SEQ ID NO: 188096 - DNA, 35 bp, Artificial Sequence
  Synthetic oligonucleotide
tgaacccacctcgccaccttgccatcgcgacgcca

SEQ ID NO: 188097 - DNA, 35 bp, Artificial Sequence
  Synthetic oligonucleotide
gccctcaccatcaacacttcgcgcgttctgttcca

SEQ ID NO: 188098 - DNA, 36 bp, Artificial Sequence
  Synthetic oligonucleotide
gctccgcacctctccatcgcgattagtacctggtca

SEQ ID NO: 188099 - DNA, 36 bp, Artificial Sequence
  Synthetic oligonucleotide
tgttgttgtcagccttgtcttacccctgccgattca

SEQ ID NO: 188100 - DNA, 36 bp, Artificial Sequence
  Synthetic oligonucleotide
tcaccgtgtgtgctccatcaacgccctatcagttca

SEQ ID NO: 188101 - DNA, 36 bp, Artificial Sequence
  Synthetic oligonucleotide
actagctcgcgcccattcgtccaggcacctttttca

SEQ ID NO: 188102 - DNA, 34 bp, Artificial Sequence
  Synthetic oligonucleotide
tttccccgccctcatactcctgttcctaagaaga

SEQ ID NO: 188103 - DNA, 37 bp, Artificial Sequence
  Synthetic oligonucleotide
tcgatccccccgcacagctccacaacgacctcgaaga

SEQ ID NO: 188104 - DNA, 37 bp, Artificial Sequence
  Synthetic oligonucleotide
gtgcgcaatggtggggggggatggctcgcgggagaga

SEQ ID NO: 188105 - DNA, 37 bp, Artificial Sequence
  Synthetic oligonucleotide
tgcctcgcccggtacactgctccctcgctacgtgaga

SEQ ID NO: 188106 - DNA, 36 bp, Artificial Sequence
  Synthetic oligonucleotide
gataccctcgccttgttgtcgccaactccacttaga

SEQ ID NO: 188107 - DNA, 37 bp, Artificial Sequence
  Synthetic oligonucleotide
tcaccgacgatatttagctacctccgccctaacacga

SEQ ID NO: 188108 - DNA, 37 bp, Artificial Sequence
  Synthetic oligonucleotide
gagatgtaggcacaggggagaggagaaggggtgacga

SEQ ID NO: 188109 - DNA, 37 bp, Artificial Sequence
  Synthetic oligonucleotide
gcatcccgcccaccaccgtatagcgtcaaacttacga

SEQ ID NO: 188110 - DNA, 37 bp, Artificial Sequence
  Synthetic oligonucleotide
acccccaatcgtccgtcgtactacactgccctgccga

SEQ ID NO: 188111 - DNA, 37 bp, Artificial Sequence
  Synthetic oligonucleotide
tttgcacgtcctgctcctgcatgttcattctttccga

SEQ ID NO: 188112 - DNA, 35 bp, Artificial Sequence
  Synthetic oligonucleotide
acaccgctttcgacgctacgaccccttttccgcga

SEQ ID NO: 188113 - DNA, 36 bp, Artificial Sequence
  Synthetic oligonucleotide
gggggagcaatagggtgggtttgggctctccaagga

SEQ ID NO: 188114 - DNA, 37 bp, Artificial Sequence
  Synthetic oligonucleotide
gtgagagcgtggaaggagcgggccgcagaggggagga

SEQ ID NO: 188115 - DNA, 37 bp, Artificial Sequence
  Synthetic oligonucleotide
taagggggatgcgaaagggagggcaaggtcaaaggga

SEQ ID NO: 188116 - DNA, 37 bp, Artificial Sequence
  Synthetic oligonucleotide
tatggagggaggtactggggaggtggcataggaggga

SEQ ID NO: 188117 - DNA, 35 bp, Artificial Sequence
  Synthetic oligonucleotide
tacggggtacgcgagggtagctgggcggggaggga

SEQ ID NO: 188118 - DNA, 36 bp, Artificial Sequence
  Synthetic oligonucleotide
acaggagggggcggtgtaggttatacaaggagggga

SEQ ID NO: 188119 - DNA, 37 bp, Artificial Sequence
  Synthetic oligonucleotide
gtatcaacagggagtgagatgaacggtggggagggga

SEQ ID NO: 188120 - DNA, 37 bp, Artificial Sequence
  Synthetic oligonucleotide
gaaaggcgggataggagggaaatatgcatgtggggga

SEQ ID NO: 188121 - DNA, 37 bp, Artificial Sequence
  Synthetic oligonucleotide
tcatgatggaggaaggaaaaggtacggtgtggatgga

SEQ ID NO: 188122 - DNA, 37 bp, Artificial Sequence
  Synthetic oligonucleotide
ggtgggggagggtagtgcggaataagctagctgtgga

SEQ ID NO: 188123 - DNA, 38 bp, Artificial Sequence
  Synthetic oligonucleotide
tctccctccgacgttatgcgcccctgacatctccatga

SEQ ID NO: 188124 - DNA, 37 bp, Artificial Sequence
  Synthetic oligonucleotide
tctgggggcggacggaggggaaaaatgttaaggatga

SEQ ID NO: 188125 - DNA, 35 bp, Artificial Sequence
  Synthetic oligonucleotide
tcccgccgtgatcctatatggcctctctcctatga

SEQ ID NO: 188126 - DNA, 35 bp, Artificial Sequence
  Synthetic oligonucleotide
tgtgtagtgcatcttgctatccgcctgttacctga

SEQ ID NO: 188127 - DNA, 38 bp, Artificial Sequence
  Synthetic oligonucleotide
acccctcgccaattctttccttatcgcaggtaccctga

SEQ ID NO: 188128 - DNA, 37 bp, Artificial Sequence
  Synthetic oligonucleotide
gacacccgcactccccgaacccagtatggaatcctga

SEQ ID NO: 188129 - DNA, 38 bp, Artificial Sequence
  Synthetic oligonucleotide
gcagacctaccgccgttacccgttgccagtactcctga

SEQ ID NO: 188130 - DNA, 37 bp, Artificial Sequence
  Synthetic oligonucleotide
tcatgccgctgcatcgttggcctcccattttctctga

SEQ ID NO: 188131 - DNA, 38 bp, Artificial Sequence
  Synthetic oligonucleotide
acccgcgcccgacccgcttattcttctcagtcttctga

SEQ ID NO: 188132 - DNA, 38 bp, Artificial Sequence
  Synthetic oligonucleotide
ttttgcccaactgcgctatcctgccccccaccaagtga

SEQ ID NO: 188133 - DNA, 37 bp, Artificial Sequence
  Synthetic oligonucleotide
gagagtggaatagggtaaagcggggtcaggacagtga

SEQ ID NO: 188134 - DNA, 38 bp, Artificial Sequence
  Synthetic oligonucleotide
tacccatccgcccagggtaaaaaacccttccttcgtga

SEQ ID NO: 188135 - DNA, 38 bp, Artificial Sequence
  Synthetic oligonucleotide
gccccccgttctatctcacccgttgtcacttgcggtga

SEQ ID NO: 188136 - DNA, 37 bp, Artificial Sequence
  Synthetic oligonucleotide
actttcctgcccctcgttgttttgtccacgcacttga

SEQ ID NO: 188137 - DNA, 35 bp, Artificial Sequence
  Synthetic oligonucleotide
gcatgcacaaccgcggtcctcagccaccaccttga

SEQ ID NO: 188138 - DNA, 37 bp, Artificial Sequence
  Synthetic oligonucleotide
gcaccatctatacatcccctttcgcagccgcccttga

SEQ ID NO: 188139 - DNA, 37 bp, Artificial Sequence
  Synthetic oligonucleotide
tgtgggctgtcgagttccgttccctcgcctatcttga

SEQ ID NO: 188140 - DNA, 38 bp, Artificial Sequence
  Synthetic oligonucleotide
ggtgggacgggagggatctggattaggtggcgcgttga

SEQ ID NO: 188141 - DNA, 37 bp, Artificial Sequence
  Synthetic oligonucleotide
attggcaggggcggcggtgtgggagggggagatttga

SEQ ID NO: 188142 - DNA, 37 bp, Artificial Sequence
  Synthetic oligonucleotide
aaggggttcggcacggtggggcggaggtaggatttga

SEQ ID NO: 188143 - DNA, 38 bp, Artificial Sequence
  Synthetic oligonucleotide
gcaaccgccctggccctcattgcgataccacattttga

SEQ ID NO: 188144 - DNA, 36 bp, Artificial Sequence
  Synthetic oligonucleotide
tgcaccaacctcgtgctctctcaactgttctcaata

SEQ ID NO: 188145 - DNA, 36 bp, Artificial Sequence
  Synthetic oligonucleotide
gtcccgagccgtgcgcttttcctgtaccgaacccta

SEQ ID NO: 188146 - DNA, 35 bp, Artificial Sequence
  Synthetic oligonucleotide
atacaccacttgcctgatatcgagcgttcccccta

SEQ ID NO: 188147 - DNA, 36 bp, Artificial Sequence
  Synthetic oligonucleotide
gactggcgtcgttcgacctgtacgcccaccatccta

SEQ ID NO: 188148 - DNA, 35 bp, Artificial Sequence
  Synthetic oligonucleotide
tatcaccacacccaaattttcgtacacgagtccta

SEQ ID NO: 188149 - DNA, 35 bp, Artificial Sequence
  Synthetic oligonucleotide
acacgccgagtttatcgcctcaagacccctctcta

SEQ ID NO: 188150 - DNA, 35 bp, Artificial Sequence
  Synthetic oligonucleotide
atgggacaaactagcgggtgggtagagggggcgta

SEQ ID NO: 188151 - DNA, 35 bp, Artificial Sequence
  Synthetic oligonucleotide
gtggtccaccgttgtcactctttgccgtatctaac

SEQ ID NO: 188152 - DNA, 35 bp, Artificial Sequence
  Synthetic oligonucleotide
gagtcgctccccgttttttgtcattcctcgctcac

SEQ ID NO: 188153 - DNA, 35 bp, Artificial Sequence
  Synthetic oligonucleotide
gcatgccggttcttgactcacgcccacttcttgac

SEQ ID NO: 188154 - DNA, 35 bp, Artificial Sequence
  Synthetic oligonucleotide
tcccactcacgcggtcagctgccattgccaacccc

SEQ ID NO: 188155 - DNA, 35 bp, Artificial Sequence
  Synthetic oligonucleotide
tcaagcgcctcgttccgggcccctctccttccccc

SEQ ID NO: 188156 - DNA, 35 bp, Artificial Sequence
  Synthetic oligonucleotide
atgcgcacattttgcatgtattacccgttggcccc

SEQ ID NO: 188157 - DNA, 35 bp, Artificial Sequence
  Synthetic oligonucleotide
gagccccgcactacctaacagccgtaatagtcccc

SEQ ID NO: 188158 - DNA, 34 bp, Artificial Sequence
  Synthetic oligonucleotide
gaacccgagcctttgtttccatatcatgctagcc

SEQ ID NO: 188159 - DNA, 35 bp, Artificial Sequence
  Synthetic oligonucleotide
gtcgaaggtcgcattgacttagtctcgcccatgcc

SEQ ID NO: 188160 - DNA, 35 bp, Artificial Sequence
  Synthetic oligonucleotide
tcacctttcccgagtttttgggtcctgaccctgcc

SEQ ID NO: 188161 - DNA, 35 bp, Artificial Sequence
  Synthetic oligonucleotide
tccggccagagcctctgcaagccgtggcccactcc

SEQ ID NO: 188162 - DNA, 35 bp, Artificial Sequence
  Synthetic oligonucleotide
gtggcgttccttcatgccttttcgtattgcgttcc

SEQ ID NO: 188163 - DNA, 35 bp, Artificial Sequence
  Synthetic oligonucleotide
tcctaccggacggagcccatgccctcttctcaagc

SEQ ID NO: 188164 - DNA, 35 bp, Artificial Sequence
  Synthetic oligonucleotide
ccacactcatcttgcgcgatctcgccggtccacgc

SEQ ID NO: 188165 - DNA, 35 bp, Artificial Sequence
  Synthetic oligonucleotide
gtcgacgccccatatcctcggacatatagccccgc

SEQ ID NO: 188166 - DNA, 34 bp, Artificial Sequence
  Synthetic oligonucleotide
ttgcggctgcaggccgtttccgttccattcccgc

SEQ ID NO: 188167 - DNA, 35 bp, Artificial Sequence
  Synthetic oligonucleotide
ccagagggagggtgctcgggtggggccttcctcgc

SEQ ID NO: 188168 - DNA, 35 bp, Artificial Sequence
  Synthetic oligonucleotide
gtgtccctccaagtcgatcccgtccgtagcctggc

SEQ ID NO: 188169 - DNA, 35 bp, Artificial Sequence
  Synthetic oligonucleotide
agttacgcccctccgtattgttcatgtactcctgc

SEQ ID NO: 188170 - DNA, 35 bp, Artificial Sequence
  Synthetic oligonucleotide
ggactgcaccattgaattgcttcctaccaccttgc

SEQ ID NO: 188171 - DNA, 35 bp, Artificial Sequence
  Synthetic oligonucleotide
gtggtcaaatcccgctcgctccatcgccccgttgc

SEQ ID NO: 188172 - DNA, 35 bp, Artificial Sequence
  Synthetic oligonucleotide
ttgtacgaccattctccaagagatcccgctccatc

SEQ ID NO: 188173 - DNA, 35 bp, Artificial Sequence
  Synthetic oligonucleotide
tcaaaccgtactgtaactgctttaggtcgccactc

SEQ ID NO: 188174 - DNA, 35 bp, Artificial Sequence
  Synthetic oligonucleotide
tgcccgtcgttgcccttcactgggacttatacctc

SEQ ID NO: 188175 - DNA, 35 bp, Artificial Sequence
  Synthetic oligonucleotide
gtggacctctttaccctgatgccagtagtttcctc

SEQ ID NO: 188176 - DNA, 35 bp, Artificial Sequence
  Synthetic oligonucleotide
gcccttaccgcagcgatcccgaacgtcgaactctc

SEQ ID NO: 188177 - DNA, 35 bp, Artificial Sequence
  Synthetic oligonucleotide
aagtgtatctccgctgcttgactcgccccgctctc

SEQ ID NO: 188178 - DNA, 35 bp, Artificial Sequence
  Synthetic oligonucleotide
gtcccgaccgttacttgtgcccgcctagccttctc

SEQ ID NO: 188179 - DNA, 35 bp, Artificial Sequence
  Synthetic oligonucleotide
actgccgggtaggcctgactcgtacactgtttctc

SEQ ID NO: 188180 - DNA, 35 bp, Artificial Sequence
  Synthetic oligonucleotide
ttcgtaaccgtccggagccactatccccctacgtc

SEQ ID NO: 188181 - DNA, 35 bp, Artificial Sequence
  Synthetic oligonucleotide
actacccgccttctgctcttttcgctaagcgattc

SEQ ID NO: 188182 - DNA, 35 bp, Artificial Sequence
  Synthetic oligonucleotide
atccgaccaccgcctctgtcctagccccgggcttc

SEQ ID NO: 188183 - DNA, 35 bp, Artificial Sequence
  Synthetic oligonucleotide
gcaccctcagacctccccccggtcctaaaccgaag

SEQ ID NO: 188184 - DNA, 35 bp, Artificial Sequence
  Synthetic oligonucleotide
tttcgccacaactctgcctttttcgcccgccccag

SEQ ID NO: 188185 - DNA, 35 bp, Artificial Sequence
  Synthetic oligonucleotide
tgtccatcacaacctcctagttccgcacacttgag

SEQ ID NO: 188186 - DNA, 35 bp, Artificial Sequence
  Synthetic oligonucleotide
tttacgctcctctgacccgccacgccctcccttag

SEQ ID NO: 188187 - DNA, 35 bp, Artificial Sequence
  Synthetic oligonucleotide
ttagcggcgggacgggtgggggcagggcatcgacg

SEQ ID NO: 188188 - DNA, 35 bp, Artificial Sequence
  Synthetic oligonucleotide
acatgcgatgattgtcttgcctccccacacgcccg

SEQ ID NO: 188189 - DNA, 35 bp, Artificial Sequence
  Synthetic oligonucleotide
gactgccttcgcatcgccccacgcccgggtgcccg

SEQ ID NO: 188190 - DNA, 35 bp, Artificial Sequence
  Synthetic oligonucleotide
acgcagagccgtcggtccacgcctccccgttctcg

SEQ ID NO: 188191 - DNA, 35 bp, Artificial Sequence
  Synthetic oligonucleotide
tcactcaggccatgatgcccggccgttcctcttcg

SEQ ID NO: 188192 - DNA, 35 bp, Artificial Sequence
  Synthetic oligonucleotide
tacaccgatccttcccccaaatgcaaatttgttcg

SEQ ID NO: 188193 - DNA, 35 bp, Artificial Sequence
  Synthetic oligonucleotide
gcccacttcgctgtcaatcacccataccttcaagg

SEQ ID NO: 188194 - DNA, 35 bp, Artificial Sequence
  Synthetic oligonucleotide
gacccgaggggagggagtggattgagcgtcaaggg

SEQ ID NO: 188195 - DNA, 36 bp, Artificial Sequence
  Synthetic oligonucleotide
gttctcaccagtcccgtattgctcctctgatgtatg

SEQ ID NO: 188196 - DNA, 35 bp, Artificial Sequence
  Synthetic oligonucleotide
accgctgctccgttctcgtccgtcacctagccctg

SEQ ID NO: 188197 - DNA, 35 bp, Artificial Sequence
  Synthetic oligonucleotide
acactccgcagcaggtttcgcgtttctacctcgtg

SEQ ID NO: 188198 - DNA, 35 bp, Artificial Sequence
  Synthetic oligonucleotide
ggtatcgtgcggtggcggtgggggaggggacggtg

SEQ ID NO: 188199 - DNA, 35 bp, Artificial Sequence
  Synthetic oligonucleotide
gcatgactccgtggtcaaatcacgctcccccgttg

SEQ ID NO: 188200 - DNA, 35 bp, Artificial Sequence
  Synthetic oligonucleotide
tgctacgcaccttcaccgcgctatcacgatctaat

SEQ ID NO: 188201 - DNA, 35 bp, Artificial Sequence
  Synthetic oligonucleotide
gcaagagaagggtgagaagggggtgcgaacgatat

SEQ ID NO: 188202 - DNA, 35 bp, Artificial Sequence
  Synthetic oligonucleotide
tacatgccgccacattgcctatcatattattctat

SEQ ID NO: 188203 - DNA, 35 bp, Artificial Sequence
  Synthetic oligonucleotide
ggagcgcatcaccctgtcatttcggtctgctaact

SEQ ID NO: 188204 - DNA, 35 bp, Artificial Sequence
  Synthetic oligonucleotide
ttgaggtggcatccggtttcttctacttctgcact

SEQ ID NO: 188205 - DNA, 35 bp, Artificial Sequence
  Synthetic oligonucleotide
tgtgtgacggaactgctaataccgatactccccct

SEQ ID NO: 188206 - DNA, 35 bp, Artificial Sequence
  Synthetic oligonucleotide
tgttggtcggttatttacatctgcctggggcccct

SEQ ID NO: 188207 - DNA, 34 bp, Artificial Sequence
  Synthetic oligonucleotide
gcactcggccgccacgtgtcgtcagtctcgccct

SEQ ID NO: 188208 - DNA, 35 bp, Artificial Sequence
  Synthetic oligonucleotide
aattcaccgccgtaagcagtacactgtcttgccct

SEQ ID NO: 188209 - DNA, 35 bp, Artificial Sequence
  Synthetic oligonucleotide
gccgccgtcacgccatttctgtttcgctctctcct

SEQ ID NO: 188210 - DNA, 35 bp, Artificial Sequence
  Synthetic oligonucleotide
atccacgggcagacgcatggtttcgccattactct

SEQ ID NO: 188211 - DNA, 35 bp, Artificial Sequence
  Synthetic oligonucleotide
ccatccagccacatgcggccccctcgcccaattct

SEQ ID NO: 188212 - DNA, 31 bp, Artificial Sequence
  Synthetic oligonucleotide
tacgcaccccactcaagccacggtcgattct

SEQ ID NO: 188213 - DNA, 35 bp, Artificial Sequence
  Synthetic oligonucleotide
aaaatggccggggggggtgaggaaaggtgtcgtgt

SEQ ID NO: 188214 - DNA, 35 bp, Artificial Sequence
  Synthetic oligonucleotide
gacagggccaaaaacgctgcgctcgacccccttgt

SEQ ID NO: 188215 - DNA, 35 bp, Artificial Sequence
  Synthetic oligonucleotide
gtatcaccagccgggcaaaccccccgccctacatt

SEQ ID NO: 188216 - DNA, 35 bp, Artificial Sequence
  Synthetic oligonucleotide
acctccctgtccttggttgtcgacttcaccgcatt

SEQ ID NO: 188217 - DNA, 35 bp, Artificial Sequence
  Synthetic oligonucleotide
gtgcgcccctgttctgtcctttcctcgcattactt

SEQ ID NO: 188218 - DNA, 35 bp, Artificial Sequence
  Synthetic oligonucleotide
gtctcatcccgttctccctgtagttaccgaacctt

SEQ ID NO: 188219 - DNA, 35 bp, Artificial Sequence
  Synthetic oligonucleotide
gttacgcacgcgccttcttaccgtacggcaccctt

SEQ ID NO: 188220 - DNA, 35 bp, Artificial Sequence
  Synthetic oligonucleotide
acccgttgcatccattgaatgaatatctctgcctt

SEQ ID NO: 188221 - DNA, 35 bp, Artificial Sequence
  Synthetic oligonucleotide
taatcgctgctgcctccacctggactcacgctctt

SEQ ID NO: 188222 - DNA, 35 bp, Artificial Sequence
  Synthetic oligonucleotide
gtgacccactgtatgcgtacttgaccccccctgtt

SEQ ID NO: 188223 - DNA, 34 bp, Artificial Sequence
  Synthetic oligonucleotide
gtacgaagatcagccgctcccagccccccgattt

SEQ ID NO: 188224 - DNA, 35 bp, Artificial Sequence
  Synthetic oligonucleotide
tgtagcgtgagctcgttaccggatcctcgcccttt

SEQ ID NO: 188225 - DNA, 35 bp, Artificial Sequence
  Synthetic oligonucleotide
gagagccggatagtctttcagtcccctcctcgttt

SEQ ID NO: 188226 - DNA, 36 bp, Artificial Sequence
  Synthetic oligonucleotide
gcccactccgcgtgtcttgactctgcctcactgaaa

SEQ ID NO: 188227 - DNA, 35 bp, Artificial Sequence
  Synthetic oligonucleotide
tgttccactccctcgctaccccatcgagacctaaa

SEQ ID NO: 188228 - DNA, 35 bp, Artificial Sequence
  Synthetic oligonucleotide
gacctgcccgagcttccgtaattccccttggtaaa

SEQ ID NO: 188229 - DNA, 35 bp, Artificial Sequence
  Synthetic oligonucleotide
aacatcaccgctattggttcaaattgtctttccaa

SEQ ID NO: 188230 - DNA, 36 bp, Artificial Sequence
  Synthetic oligonucleotide
agggcataggggagcggggacattgaggtggggcaa

SEQ ID NO: 188231 - DNA, 35 bp, Artificial Sequence
  Synthetic oligonucleotide
gaggggtagatgtaactaggatgggaggggaggaa

SEQ ID NO: 188232 - DNA, 35 bp, Artificial Sequence
  Synthetic oligonucleotide
ttgggggagggtgggccttgttcggggactgtgaa

SEQ ID NO: 188233 - DNA, 35 bp, Artificial Sequence
  Synthetic oligonucleotide
tccactctgaccgttgttcccggtcccagttctaa

SEQ ID NO: 188234 - DNA, 35 bp, Artificial Sequence
  Synthetic oligonucleotide
atgctgccacctttgctgtccttctccatccgtaa

SEQ ID NO: 188235 - DNA, 36 bp, Artificial Sequence
  Synthetic oligonucleotide
ggaggggtggggtgggcgttacacaggcggtagaca

SEQ ID NO: 188236 - DNA, 35 bp, Artificial Sequence
  Synthetic oligonucleotide
aatgctgcgggtgggtagggcggagggtcggtaca

SEQ ID NO: 188237 - DNA, 35 bp, Artificial Sequence
  Synthetic oligonucleotide
acgtacacccgcaactgtagccgccgtagcttaca

SEQ ID NO: 188238 - DNA, 36 bp, Artificial Sequence
  Synthetic oligonucleotide
tcacggtccggacctctcctcgcgtagtctccacca

SEQ ID NO: 188239 - DNA, 36 bp, Artificial Sequence
  Synthetic oligonucleotide
tacccgatgtctgtatccgttatgcccccataccca

SEQ ID NO: 188240 - DNA, 35 bp, Artificial Sequence
  Synthetic oligonucleotide
gccccagacgggtctgtctgcaattcattatccca

SEQ ID NO: 188241 - DNA, 36 bp, Artificial Sequence
  Synthetic oligonucleotide
gtcatctgtcagcctgccttcttacattacacgcca

SEQ ID NO: 188242 - DNA, 36 bp, Artificial Sequence
  Synthetic oligonucleotide
tacgatgcgtttcaggtcttccctgcttttgcgcca

SEQ ID NO: 188243 - DNA, 36 bp, Artificial Sequence
  Synthetic oligonucleotide
tgagtcgatcctgttgtaattcacctcacccctcca

SEQ ID NO: 188244 - DNA, 36 bp, Artificial Sequence
  Synthetic oligonucleotide
taatcaccactcccgcttgtccagccacacgctcca

SEQ ID NO: 188245 - DNA, 35 bp, Artificial Sequence
  Synthetic oligonucleotide
gcttcgcgaccctgttctggcccatcccacgcgca

SEQ ID NO: 188246 - DNA, 35 bp, Artificial Sequence
  Synthetic oligonucleotide
tgccaactcacatctcgccgttcccgcgtgcatca

SEQ ID NO: 188247 - DNA, 36 bp, Artificial Sequence
  Synthetic oligonucleotide
gttccccgctctgaatgcatccaacctccgcactca

SEQ ID NO: 188248 - DNA, 36 bp, Artificial Sequence
  Synthetic oligonucleotide
gctggagccacccgaatgtcctaacgccctccgtca

SEQ ID NO: 188249 - DNA, 36 bp, Artificial Sequence
  Synthetic oligonucleotide
acgccacctcccccgttcaaggccctttttcgttca

SEQ ID NO: 188250 - DNA, 35 bp, Artificial Sequence
  Synthetic oligonucleotide
gacaaacgtctgcccatgtctctttggtttgttca

SEQ ID NO: 188251 - DNA, 37 bp, Artificial Sequence
  Synthetic oligonucleotide
gtcagacacagggggatataggagggaggtggagaga

SEQ ID NO: 188252 - DNA, 37 bp, Artificial Sequence
  Synthetic oligonucleotide
aagatgcggagaggggatagggcatcgtaggttgaga

SEQ ID NO: 188253 - DNA, 37 bp, Artificial Sequence
  Synthetic oligonucleotide
gtggacatgggggggatacggagtgggcatttttaga

SEQ ID NO: 188254 - DNA, 36 bp, Artificial Sequence
  Synthetic oligonucleotide
tccgccgaacgacagcagccccccttactccgccga

SEQ ID NO: 188255 - DNA, 37 bp, Artificial Sequence
  Synthetic oligonucleotide
tgcccacccgctactgctcgttcaaacacctcgccga

SEQ ID NO: 188256 - DNA, 37 bp, Artificial Sequence
  Synthetic oligonucleotide
gaagtagggtcgggtggtgcggatagaggtgggccga

SEQ ID NO: 188257 - DNA, 37 bp, Artificial Sequence
  Synthetic oligonucleotide
gacgccccggacccagttaccatcgtcactcctccga

SEQ ID NO: 188258 - DNA, 37 bp, Artificial Sequence
  Synthetic oligonucleotide
acgcccgacctcctcttgtaacgatttgatccctcga

SEQ ID NO: 188259 - DNA, 36 bp, Artificial Sequence
  Synthetic oligonucleotide
gtgtgccggccccgagctctcttgcatctcccagga

SEQ ID NO: 188260 - DNA, 36 bp, Artificial Sequence
  Synthetic oligonucleotide
gtttgctcccctgccctcgcccctatcactccagga

SEQ ID NO: 188261 - DNA, 37 bp, Artificial Sequence
  Synthetic oligonucleotide
ttcacaagcgaaagggttggtagggaagggaggagga

SEQ ID NO: 188262 - DNA, 37 bp, Artificial Sequence
  Synthetic oligonucleotide
aacgctaacggggaaaggggcggtaatttgaacggga

SEQ ID NO: 188263 - DNA, 37 bp, Artificial Sequence
  Synthetic oligonucleotide
atggtggggcggaattaggtagggctgggatcgggga

SEQ ID NO: 188264 - DNA, 37 bp, Artificial Sequence
  Synthetic oligonucleotide
atcgtagtggggggcataaaggcgggcgtggctggga

SEQ ID NO: 188265 - DNA, 37 bp, Artificial Sequence
  Synthetic oligonucleotide
gagggcccctgaactcgataattacttcgcccctgga

SEQ ID NO: 188266 - DNA, 37 bp, Artificial Sequence
  Synthetic oligonucleotide
gacacccccctgttgcgtttcctaaccgacctctgga

SEQ ID NO: 188267 - DNA, 36 bp, Artificial Sequence
  Synthetic oligonucleotide
gaccactccagatcttactgcctacctcgaccatga

SEQ ID NO: 188268 - DNA, 38 bp, Artificial Sequence
  Synthetic oligonucleotide
gtgacagtgccgggacaaagggggaggtggtgaactga

SEQ ID NO: 188269 - DNA, 38 bp, Artificial Sequence
  Synthetic oligonucleotide
accgcacccgcttccgatttacgcctcctctccactga

SEQ ID NO: 188270 - DNA, 38 bp, Artificial Sequence
  Synthetic oligonucleotide
gccgatccgtcaattctcttcccgcagcttttacctga

SEQ ID NO: 188271 - DNA, 36 bp, Artificial Sequence
  Synthetic oligonucleotide
acatcccctcatactgctcaatagctcccccggtga

SEQ ID NO: 188272 - DNA, 38 bp, Artificial Sequence
  Synthetic oligonucleotide
gtggatggatgtgcgaggagggggagggcatggggtga

SEQ ID NO: 188273 - DNA, 38 bp, Artificial Sequence
  Synthetic oligonucleotide
atcaccctcagttactgcccaaaaacgcccccatgtga

SEQ ID NO: 188274 - DNA, 38 bp, Artificial Sequence
  Synthetic oligonucleotide
gctgggtgtcagggtgggggggctaataaaaactgtga

SEQ ID NO: 188275 - DNA, 38 bp, Artificial Sequence
  Synthetic oligonucleotide
gcgccactccatttttctccagcgcctgcctgacttga

SEQ ID NO: 188276 - DNA, 37 bp, Artificial Sequence
  Synthetic oligonucleotide
gcccgggtcgctctggggtgggagggttgtaccttga

SEQ ID NO: 188277 - DNA, 37 bp, Artificial Sequence
  Synthetic oligonucleotide
aatccgcccacatccacgtagggactcctgtccttga

SEQ ID NO: 188278 - DNA, 37 bp, Artificial Sequence
  Synthetic oligonucleotide
ttcgctcctcttccgctgtcttattttctctgcttga

SEQ ID NO: 188279 - DNA, 37 bp, Artificial Sequence
  Synthetic oligonucleotide
tccactgcccgatgcgcccttcgtattcccccgttga

SEQ ID NO: 188280 - DNA, 37 bp, Artificial Sequence
  Synthetic oligonucleotide
tgaggtggtggggtggacttatggcggtacctgttga

SEQ ID NO: 188281 - DNA, 37 bp, Artificial Sequence
  Synthetic oligonucleotide
acccatattccagatcacgcctcgccatccttgttga

SEQ ID NO: 188282 - DNA, 37 bp, Artificial Sequence
  Synthetic oligonucleotide
taccccgccactctgacagacgcgccctctattttga

SEQ ID NO: 188283 - DNA, 37 bp, Artificial Sequence
  Synthetic oligonucleotide
gaccaccctccccccgaccggtagacagtctttttga

SEQ ID NO: 188284 - DNA, 36 bp, Artificial Sequence
  Synthetic oligonucleotide
gctggacgccgccagtatcctgtccgtcctccgata

SEQ ID NO: 188285 - DNA, 36 bp, Artificial Sequence
  Synthetic oligonucleotide
ataccgactcagctctattacgcctgatctcctata

SEQ ID NO: 188286 - DNA, 36 bp, Artificial Sequence
  Synthetic oligonucleotide
gacacactgatcgctttcttgggtccccctcaccta

SEQ ID NO: 188287 - DNA, 36 bp, Artificial Sequence
  Synthetic oligonucleotide
tccgcccactcctctggtatgtccccccgcacgcta

SEQ ID NO: 188288 - DNA, 35 bp, Artificial Sequence
  Synthetic oligonucleotide
gtacccccacctggttaaactgcgtttcttccgta

SEQ ID NO: 188289 - DNA, 36 bp, Artificial Sequence
  Synthetic oligonucleotide
atcggggtggagtgcgagatgcagggaggggtggta

SEQ ID NO: 188290 - DNA, 36 bp, Artificial Sequence
  Synthetic oligonucleotide
ggtcacccgcctccattatagttattcctcgctgta

SEQ ID NO: 188291 - DNA, 36 bp, Artificial Sequence
  Synthetic oligonucleotide
acttcacctcatgagtcgatctggcacccccttgta

SEQ ID NO: 188292 - DNA, 36 bp, Artificial Sequence
  Synthetic oligonucleotide
tccgatccatgtccttatgcctttaaccccccatta

SEQ ID NO: 188293 - DNA, 35 bp, Artificial Sequence
  Synthetic oligonucleotide
gaccgatcctcgccaccatggtaagttgtaactta

SEQ ID NO: 188294 - DNA, 35 bp, Artificial Sequence
  Synthetic oligonucleotide
aattgcgtccacgtctttaacttacccgtccctta

SEQ ID NO: 188295 - DNA, 35 bp, Artificial Sequence
  Synthetic oligonucleotide
tcctccgacttcaggcgcgcctcgaccctctgtta

SEQ ID NO: 188296 - DNA, 35 bp, Artificial Sequence
  Synthetic oligonucleotide
acccaagctactgtattcctgtctcttcacaccac

SEQ ID NO: 188297 - DNA, 35 bp, Artificial Sequence
  Synthetic oligonucleotide
gtcaagaaccggcatacctctgcctgcattccacc

SEQ ID NO: 188298 - DNA, 35 bp, Artificial Sequence
  Synthetic oligonucleotide
ttgctctacacggtttggatctgccccctcttacc

SEQ ID NO: 188299 - DNA, 35 bp, Artificial Sequence
  Synthetic oligonucleotide
acaaccaccttcgttgaacatatctcacttgcccc

SEQ ID NO: 188300 - DNA, 35 bp, Artificial Sequence
  Synthetic oligonucleotide
tgtctctccgcttcccgtgtgctgcactgctcccc

SEQ ID NO: 188301 - DNA, 35 bp, Artificial Sequence
  Synthetic oligonucleotide
gagctccacgctcgcgtatatggttttccgttccc

SEQ ID NO: 188302 - DNA, 35 bp, Artificial Sequence
  Synthetic oligonucleotide
aacgccccagtcgcccgcttcccttaattcaagcc

SEQ ID NO: 188303 - DNA, 35 bp, Artificial Sequence
  Synthetic oligonucleotide
gtctacgactgttacacaatactccctggtctgcc

SEQ ID NO: 188304 - DNA, 35 bp, Artificial Sequence
  Synthetic oligonucleotide
tccgacaaccctcctcacgccgctaggtccttgcc

SEQ ID NO: 188305 - DNA, 35 bp, Artificial Sequence
  Synthetic oligonucleotide
gctgcctggcgtaactgcccttcacacgtgattcc

SEQ ID NO: 188306 - DNA, 35 bp, Artificial Sequence
  Synthetic oligonucleotide
tgcacctgcctaggtggtaaccattcgccccttcc

SEQ ID NO: 188307 - DNA, 35 bp, Artificial Sequence
  Synthetic oligonucleotide
ccgaccctccgatcaatccactcgtctcgccaagc

SEQ ID NO: 188308 - DNA, 35 bp, Artificial Sequence
  Synthetic oligonucleotide
acttccatgctgatcccttatacctgagtccccgc

SEQ ID NO: 188309 - DNA, 35 bp, Artificial Sequence
  Synthetic oligonucleotide
gctgagctgtgccgaataatcgtcgctttccccgc

SEQ ID NO: 188310 - DNA, 34 bp, Artificial Sequence
  Synthetic oligonucleotide
acgcacctccacttttatccgcccctctcacggc

SEQ ID NO: 188311 - DNA, 35 bp, Artificial Sequence
  Synthetic oligonucleotide
gagcgccacgctgaattctctacctccgactcggc

SEQ ID NO: 188312 - DNA, 35 bp, Artificial Sequence
  Synthetic oligonucleotide
acatgtactgtgccaccctgtatggtttcacctgc

SEQ ID NO: 188313 - DNA, 35 bp, Artificial Sequence
  Synthetic oligonucleotide
acacgactactgtccatcacgctattcctaacatc

SEQ ID NO: 188314 - DNA, 33 bp, Artificial Sequence
  Synthetic oligonucleotide
aacgcctatcggtatagttttgcctcttccatc

SEQ ID NO: 188315 - DNA, 35 bp, Artificial Sequence
  Synthetic oligonucleotide
tgtgtcggcccccaatgcgcttaaacatcccgatc

SEQ ID NO: 188316 - DNA, 35 bp, Artificial Sequence
  Synthetic oligonucleotide
agtgcatcccctatgagctatccttctggtcactc

SEQ ID NO: 188317 - DNA, 35 bp, Artificial Sequence
  Synthetic oligonucleotide
atcgtacttgcagccgcgttatcgcattgtacctc

SEQ ID NO: 188318 - DNA, 35 bp, Artificial Sequence
  Synthetic oligonucleotide
actgccacaccaatgttcttttttgcctttgtctc

SEQ ID NO: 188319 - DNA, 35 bp, Artificial Sequence
  Synthetic oligonucleotide
tcgagatccaactggtgaaactgcccgtacctttc

SEQ ID NO: 188320 - DNA, 35 bp, Artificial Sequence
  Synthetic oligonucleotide
tcaccgcccaagggagtactctatgttctgctttc

SEQ ID NO: 188321 - DNA, 35 bp, Artificial Sequence
  Synthetic oligonucleotide
atcagatgccgccgccctgtttctgttaatctttc

SEQ ID NO: 188322 - DNA, 35 bp, Artificial Sequence
  Synthetic oligonucleotide
gactccgtccttccaaccgtggcctgtcctgtttc

SEQ ID NO: 188323 - DNA, 35 bp, Artificial Sequence
  Synthetic oligonucleotide
ttcgtgccgcccctccgcgtccagtcccctttttc

SEQ ID NO: 188324 - DNA, 35 bp, Artificial Sequence
  Synthetic oligonucleotide
tcccacgcgcccttccgtcctgttttgattttttc

SEQ ID NO: 188325 - DNA, 35 bp, Artificial Sequence
  Synthetic oligonucleotide
tgtcgagcatcacagtcccccccgctatctacaag

SEQ ID NO: 188326 - DNA, 35 bp, Artificial Sequence
  Synthetic oligonucleotide
gaggaccagtagggaacatgatgcgggtagggaag

SEQ ID NO: 188327 - DNA, 35 bp, Artificial Sequence
  Synthetic oligonucleotide
ttagaccgccgctcctatttgcctctcgtcccacg

SEQ ID NO: 188328 - DNA, 35 bp, Artificial Sequence
  Synthetic oligonucleotide
ttggccgtcattgcttatttttttgcccctcgccg

SEQ ID NO: 188329 - DNA, 35 bp, Artificial Sequence
  Synthetic oligonucleotide
tacggtaagggtgggtgggagagggtcggcatccg

SEQ ID NO: 188330 - DNA, 35 bp, Artificial Sequence
  Synthetic oligonucleotide
accagactccatcgtcccgctccccacatgctccg

SEQ ID NO: 188331 - DNA, 35 bp, Artificial Sequence
  Synthetic oligonucleotide
tccatccgcagggtggtgatagaaccatcctctcg

SEQ ID NO: 188332 - DNA, 35 bp, Artificial Sequence
  Synthetic oligonucleotide
tctcgccttccagccgaccacgttgccccttttcg

SEQ ID NO: 188333 - DNA, 35 bp, Artificial Sequence
  Synthetic oligonucleotide
gctgtcccgccaccgcttgcaatatgtgccctcgg

SEQ ID NO: 188334 - DNA, 35 bp, Artificial Sequence
  Synthetic oligonucleotide
tgtgtagggatagtggagggtggagtgcaagatgg

SEQ ID NO: 188335 - DNA, 35 bp, Artificial Sequence
  Synthetic oligonucleotide
atagccctccctccggttccttccagcatcttatg

SEQ ID NO: 188336 - DNA, 35 bp, Artificial Sequence
  Synthetic oligonucleotide
tcaacgtatagtacagggggagtggtggaaaggtg

SEQ ID NO: 188337 - DNA, 35 bp, Artificial Sequence
  Synthetic oligonucleotide
gatccccctcctttttactcgtccactcgctggtg

SEQ ID NO: 188338 - DNA, 35 bp, Artificial Sequence
  Synthetic oligonucleotide
gagaagccatcatccgtccaatcctccctccattg

SEQ ID NO: 188339 - DNA, 35 bp, Artificial Sequence
  Synthetic oligonucleotide
tccacctgctccgctgacttaacctgcctatcttg

SEQ ID NO: 188340 - DNA, 35 bp, Artificial Sequence
  Synthetic oligonucleotide
gctcgcacgttactgttcgcggtctccaccaccat

SEQ ID NO: 188341 - DNA, 35 bp, Artificial Sequence
  Synthetic oligonucleotide
tgaagagcgcacactctgttttttccagctgctat

SEQ ID NO: 188342 - DNA, 35 bp, Artificial Sequence
  Synthetic oligonucleotide
actccagaccgcatcgcgctttaaatactagccct

SEQ ID NO: 188343 - DNA, 35 bp, Artificial Sequence
  Synthetic oligonucleotide
atcacgagtgtatacatcatcgctcgtccttccct

SEQ ID NO: 188344 - DNA, 35 bp, Artificial Sequence
  Synthetic oligonucleotide
gaggcatccccgcccgttctcctgacgcaattcct

SEQ ID NO: 188345 - DNA, 35 bp, Artificial Sequence
  Synthetic oligonucleotide
tcccttccctcccacgtttcccaagagagcaatct

SEQ ID NO: 188346 - DNA, 35 bp, Artificial Sequence
  Synthetic oligonucleotide
gacacggacctcttggcactggacactccccatct

SEQ ID NO: 188347 - DNA, 35 bp, Artificial Sequence
  Synthetic oligonucleotide
tgatcccccgaaggttcacattccttgttgcctct

SEQ ID NO: 188348 - DNA, 35 bp, Artificial Sequence
  Synthetic oligonucleotide
ttgcgaacgacagtttttcgtcacatatcccttct

SEQ ID NO: 188349 - DNA, 36 bp, Artificial Sequence
  Synthetic oligonucleotide
gtagcaacccacgtgtgccatcgccccccccctagt

SEQ ID NO: 188350 - DNA, 35 bp, Artificial Sequence
  Synthetic oligonucleotide
atccacacccccgcagcaccgcgtacacacgaggt

SEQ ID NO: 188351 - DNA, 35 bp, Artificial Sequence
  Synthetic oligonucleotide
atgtaccgagcgaagagggggtagtgaaagtaggt

SEQ ID NO: 188352 - DNA, 35 bp, Artificial Sequence
  Synthetic oligonucleotide
ttcggtccgtccgcttactccccccgtcccttggt

SEQ ID NO: 188353 - DNA, 35 bp, Artificial Sequence
  Synthetic oligonucleotide
aatccctgcgcccatttatagtcacccgcccctgt

SEQ ID NO: 188354 - DNA, 35 bp, Artificial Sequence
  Synthetic oligonucleotide
attacgccaccgctcttcgtgtgccacaccccatt

SEQ ID NO: 188355 - DNA, 35 bp, Artificial Sequence
  Synthetic oligonucleotide
gcctcacacattgtagtcgtcctaattccgtcctt

SEQ ID NO: 188356 - DNA, 35 bp, Artificial Sequence
  Synthetic oligonucleotide
atgccacgaacctcccatgctgtccacttgtcctt

SEQ ID NO: 188357 - DNA, 35 bp, Artificial Sequence
  Synthetic oligonucleotide
gatctgccctctccgatcgtgcccactgcgttctt

SEQ ID NO: 188358 - DNA, 35 bp, Artificial Sequence
  Synthetic oligonucleotide
tgcccccccatagcattaccgctccttcctgggtt

SEQ ID NO: 188359 - DNA, 35 bp, Artificial Sequence
  Synthetic oligonucleotide
actacgcacctggctcgtaccggatactccctgtt

SEQ ID NO: 188360 - DNA, 35 bp, Artificial Sequence
  Synthetic oligonucleotide
tcagccatggtatcccgtgtgccccttcccttgtt

SEQ ID NO: 188361 - DNA, 35 bp, Artificial Sequence
  Synthetic oligonucleotide
gagtcctgccacccgaattgcctactttgcccttt

SEQ ID NO: 188362 - DNA, 35 bp, Artificial Sequence
  Synthetic oligonucleotide
atcgcatctgctccatctttctctgtgttctcttt

SEQ ID NO: 188363 - DNA, 35 bp, Artificial Sequence
  Synthetic oligonucleotide
aatttgggcctcgtgactcgcctgttctgcctttt

SEQ ID NO: 188364 - DNA, 36 bp, Artificial Sequence
  Synthetic oligonucleotide
agtccacaggagggaagggttggacgggtgaacaaa

SEQ ID NO: 188365 - DNA, 36 bp, Artificial Sequence
  Synthetic oligonucleotide
tcagtgtcgttgtactcccttctcgctgtccgccaa

SEQ ID NO: 188366 - DNA, 36 bp, Artificial Sequence
  Synthetic oligonucleotide
gggggagggtggggcgtaatcgtgaagggtgacgaa

SEQ ID NO: 188367 - DNA, 36 bp, Artificial Sequence
  Synthetic oligonucleotide
gtaacaccatccggcgtcgaaactgccactcccgaa

SEQ ID NO: 188368 - DNA, 36 bp, Artificial Sequence
  Synthetic oligonucleotide
ggtggacacagggggggaatagctaaggttagggaa

SEQ ID NO: 188369 - DNA, 35 bp, Artificial Sequence
  Synthetic oligonucleotide
attgcacgggggggtggactgtagggtattgggaa

SEQ ID NO: 188370 - DNA, 35 bp, Artificial Sequence
  Synthetic oligonucleotide
acgatgccccgcccgttactcaatttcgttatgaa

SEQ ID NO: 188371 - DNA, 36 bp, Artificial Sequence
  Synthetic oligonucleotide
gccacgacggccggttgcgcattattaccgcctgaa

SEQ ID NO: 188372 - DNA, 35 bp, Artificial Sequence
  Synthetic oligonucleotide
actccactccctcgttagcgttttcgccgttctaa

SEQ ID NO: 188373 - DNA, 36 bp, Artificial Sequence
  Synthetic oligonucleotide
tcgacgtacacagcgggtggggggggaggatggtaa

SEQ ID NO: 188374 - DNA, 36 bp, Artificial Sequence
  Synthetic oligonucleotide
aacgagggaaagagcggcgaaagcgagaagtggtaa

SEQ ID NO: 188375 - DNA, 32 bp, Artificial Sequence
  Synthetic oligonucleotide
gccacgctcctggccgctgtatctgcaccaca

SEQ ID NO: 188376 - DNA, 36 bp, Artificial Sequence
  Synthetic oligonucleotide
aatcgccacatccctcatatagctgcattgaccaca

SEQ ID NO: 188377 - DNA, 36 bp, Artificial Sequence
  Synthetic oligonucleotide
gatcgcgcccagcatccatccttttcacatgccaca

SEQ ID NO: 188378 - DNA, 36 bp, Artificial Sequence
  Synthetic oligonucleotide
tatccccacctctcaatatgtgtattcatgaataca

SEQ ID NO: 188379 - DNA, 36 bp, Artificial Sequence
  Synthetic oligonucleotide
gtacactgcctcacctgatatctatggttccataca

SEQ ID NO: 188380 - DNA, 35 bp, Artificial Sequence
  Synthetic oligonucleotide
tgccaccacgccatctaaggtgtcaggcctctaca

SEQ ID NO: 188381 - DNA, 35 bp, Artificial Sequence
  Synthetic oligonucleotide
tgtctccctctggcttgaactatccgcagtaccca

SEQ ID NO: 188382 - DNA, 36 bp, Artificial Sequence
  Synthetic oligonucleotide
tcctcactcaacgctattgacttgccttacgcccca

SEQ ID NO: 188383 - DNA, 36 bp, Artificial Sequence
  Synthetic oligonucleotide
gggtgtgctccgccgatatatgctcccaccgtgcca

SEQ ID NO: 188384 - DNA, 35 bp, Artificial Sequence
  Synthetic oligonucleotide
ttgggcccgtagcttccctcccatcccatttgcca

SEQ ID NO: 188385 - DNA, 35 bp, Artificial Sequence
  Synthetic oligonucleotide
tcacccctgtgtgcttgccaacaatttaatctcca

SEQ ID NO: 188386 - DNA, 36 bp, Artificial Sequence
  Synthetic oligonucleotide
tggtcgctctgttctgccctaccgcgcctgcttcca

SEQ ID NO: 188387 - DNA, 36 bp, Artificial Sequence
  Synthetic oligonucleotide
tgtacctccaatgctttcccgctcgttctatacgca

SEQ ID NO: 188388 - DNA, 35 bp, Artificial Sequence
  Synthetic oligonucleotide
gtgcgttgctctattcgtgattcctccgccccgca

SEQ ID NO: 188389 - DNA, 36 bp, Artificial Sequence
  Synthetic oligonucleotide
gcgccctgcccccccgtgcgacattggtcagttgca

SEQ ID NO: 188390 - DNA, 35 bp, Artificial Sequence
  Synthetic oligonucleotide
atcccgtacatcggaagcgcattgtcgctccatca

SEQ ID NO: 188391 - DNA, 29 bp, Artificial Sequence
  Synthetic oligonucleotide
tttcgccctcaccctgtcgcccttactca

SEQ ID NO: 188392 - DNA, 36 bp, Artificial Sequence
  Synthetic oligonucleotide
gcagaccccagtcctttgaattccgtggctccctca

SEQ ID NO: 188393 - DNA, 36 bp, Artificial Sequence
  Synthetic oligonucleotide
actccactcagcgtggttactggtcccgttccctca

SEQ ID NO: 188394 - DNA, 35 bp, Artificial Sequence
  Synthetic oligonucleotide
gccctcccgacattgatcgcccgttaccttagtca

SEQ ID NO: 188395 - DNA, 35 bp, Artificial Sequence
  Synthetic oligonucleotide
tcccatgctcggagcgtctctccatcacacattca

SEQ ID NO: 188396 - DNA, 35 bp, Artificial Sequence
  Synthetic oligonucleotide
actcccccgactttcaatgctctccaagggattca

SEQ ID NO: 188397 - DNA, 36 bp, Artificial Sequence
  Synthetic oligonucleotide
tatgcccgctcggtctctcactatctagcctcttca

SEQ ID NO: 188398 - DNA, 37 bp, Artificial Sequence
  Synthetic oligonucleotide
gtcactgggagtagggcaggaaggagagttgggcaga

SEQ ID NO: 188399 - DNA, 37 bp, Artificial Sequence
  Synthetic oligonucleotide
tccccacactcctctgcacattccagttccccagaga

SEQ ID NO: 188400 - DNA, 37 bp, Artificial Sequence
  Synthetic oligonucleotide
ttggggctacgaagtcagggaggaagggatggggaga

SEQ ID NO: 188401 - DNA, 37 bp, Artificial Sequence
  Synthetic oligonucleotide
ttgacacccttcccatcgagcttttgaccggtcccga

SEQ ID NO: 188402 - DNA, 37 bp, Artificial Sequence
  Synthetic oligonucleotide
gggtgggaaaggcgatgtaagggggaagcggagccga

SEQ ID NO: 188403 - DNA, 37 bp, Artificial Sequence
  Synthetic oligonucleotide
tctaactctcgcccgtgcttcctgctcgccacctcga

SEQ ID NO: 188404 - DNA, 37 bp, Artificial Sequence
  Synthetic oligonucleotide
gaccctcctccgcctgcattcactgttcacacttcga

SEQ ID NO: 188405 - DNA, 37 bp, Artificial Sequence
  Synthetic oligonucleotide
acacccaccgctcacctttccttgctccacagttcga

SEQ ID NO: 188406 - DNA, 36 bp, Artificial Sequence
  Synthetic oligonucleotide
gttacacccgcctccttgtcctactggttttcagga

SEQ ID NO: 188407 - DNA, 37 bp, Artificial Sequence
  Synthetic oligonucleotide
aaatgtaggtgtaagggggggcacagaggacagcgga

SEQ ID NO: 188408 - DNA, 37 bp, Artificial Sequence
  Synthetic oligonucleotide
gagggaggcgaaggctttgtagcggggggggagggga

SEQ ID NO: 188409 - DNA, 36 bp, Artificial Sequence
  Synthetic oligonucleotide
gccgagagggggggtacggtggagtgaggcggggga

SEQ ID NO: 188410 - DNA, 37 bp, Artificial Sequence
  Synthetic oligonucleotide
acagtcccaattttcatatcgcccccgttccctggga

SEQ ID NO: 188411 - DNA, 36 bp, Artificial Sequence
  Synthetic oligonucleotide
tgctgcacgcgcgacgtttaccctctcctttttgga

SEQ ID NO: 188412 - DNA, 38 bp, Artificial Sequence
  Synthetic oligonucleotide
aacgtcaccttccctgcccgatattgttacgtctatga

SEQ ID NO: 188413 - DNA, 38 bp, Artificial Sequence
  Synthetic oligonucleotide
ttcacgcacgtagaatgggtcgggatgggtgggactga

SEQ ID NO: 188414 - DNA, 38 bp, Artificial Sequence
  Synthetic oligonucleotide
gcctcgcccctggtacacatatacttctgacttactga

SEQ ID NO: 188415 - DNA, 38 bp, Artificial Sequence
  Synthetic oligonucleotide
acgttcgcccaccatcgtaattcggatcctccacctga

SEQ ID NO: 188416 - DNA, 38 bp, Artificial Sequence
  Synthetic oligonucleotide
acccccgcccaattgtaacagctctattttggccctga

SEQ ID NO: 188417 - DNA, 38 bp, Artificial Sequence
  Synthetic oligonucleotide
tacgtgccatgggaggagggggggagctggttccctga

SEQ ID NO: 188418 - DNA, 38 bp, Artificial Sequence
  Synthetic oligonucleotide
gtagcaacctcctgcgctctgtttcttctctggcctga

SEQ ID NO: 188419 - DNA, 37 bp, Artificial Sequence
  Synthetic oligonucleotide
gccacgccccatgcctttgcttcacacgacctcctga

SEQ ID NO: 188420 - DNA, 38 bp, Artificial Sequence
  Synthetic oligonucleotide
aatctcgcgttcgagttcattactgcccttcctcctga

SEQ ID NO: 188421 - DNA, 37 bp, Artificial Sequence
  Synthetic oligonucleotide
atcctccgacggtataccgtgacctctccgctcctga

SEQ ID NO: 188422 - DNA, 37 bp, Artificial Sequence
  Synthetic oligonucleotide
tcgcaatcgccatccatgcgtcacccttcccatctga

SEQ ID NO: 188423 - DNA, 37 bp, Artificial Sequence
  Synthetic oligonucleotide
tcctcaccagatcgatctgtcttctcttctcctctga

SEQ ID NO: 188424 - DNA, 37 bp, Artificial Sequence
  Synthetic oligonucleotide
cactgcccacccactgcctacgtccaggccctcgtga

SEQ ID NO: 188425 - DNA, 38 bp, Artificial Sequence
  Synthetic oligonucleotide
gtctgacgccactcctccgaccttccgttaattcgtga

SEQ ID NO: 188426 - DNA, 38 bp, Artificial Sequence
  Synthetic oligonucleotide
tgttctcgcctgtacgcttacgttttcgccccctgtga

SEQ ID NO: 188427 - DNA, 38 bp, Artificial Sequence
  Synthetic oligonucleotide
tatggcgccgactgccggtacccttgcctttcctgtga

SEQ ID NO: 188428 - DNA, 38 bp, Artificial Sequence
  Synthetic oligonucleotide
aacgatcggagggtgggctttggggcgagaacttgtga

SEQ ID NO: 188429 - DNA, 37 bp, Artificial Sequence
  Synthetic oligonucleotide
acctcagccctcaatcctcgtaatcagttccccttga

SEQ ID NO: 188430 - DNA, 38 bp, Artificial Sequence
  Synthetic oligonucleotide
gcatgtcgcgcttctcgtgctcgtactaccccatttga

SEQ ID NO: 188431 - DNA, 36 bp, Artificial Sequence
  Synthetic oligonucleotide
attcactcccctccagcgtctcctcgtacggtttga

SEQ ID NO: 188432 - DNA, 35 bp, Artificial Sequence
  Synthetic oligonucleotide
gacaccccgtcgcctggcgtacacccacctccata

SEQ ID NO: 188433 - DNA, 36 bp, Artificial Sequence
  Synthetic oligonucleotide
tccgtcccctctgaccatcattgtttcacgtccata

SEQ ID NO: 188434 - DNA, 36 bp, Artificial Sequence
  Synthetic oligonucleotide
gtccgccccaagcctccgaactttcccactggtata

SEQ ID NO: 188435 - DNA, 35 bp, Artificial Sequence
  Synthetic oligonucleotide
gagacgctctccgccctcacctcctagagttccta

SEQ ID NO: 188436 - DNA, 36 bp, Artificial Sequence
  Synthetic oligonucleotide
ttgcgctatctttctgcatcttgctctgtacctcta

SEQ ID NO: 188437 - DNA, 36 bp, Artificial Sequence
  Synthetic oligonucleotide
gtggtgctgccgcccctggtttttgattgccccgta

SEQ ID NO: 188438 - DNA, 36 bp, Artificial Sequence
  Synthetic oligonucleotide
gatgagagaggtggtggaggtcgggatcgtagcgta

SEQ ID NO: 188439 - DNA, 34 bp, Artificial Sequence
  Synthetic oligonucleotide
gccccgcccgccttgagttcgtctaacgtgcgta

SEQ ID NO: 188440 - DNA, 35 bp, Artificial Sequence
  Synthetic oligonucleotide
tttacagacggagagagggagagggatagggggta

SEQ ID NO: 188441 - DNA, 36 bp, Artificial Sequence
  Synthetic oligonucleotide
tcactctcgcgcccctatgcacacgctgtaaactta

SEQ ID NO: 188442 - DNA, 35 bp, Artificial Sequence
  Synthetic oligonucleotide
ttgcccttcgccttatacccgtctgcagtccctta

SEQ ID NO: 188443 - DNA, 36 bp, Artificial Sequence
  Synthetic oligonucleotide
gccagtcgccagcatccatacgtaacaccttcctta

SEQ ID NO: 188444 - DNA, 35 bp, Artificial Sequence
  Synthetic oligonucleotide
gccaaccactactctcatcaactcgacgtgcaaac

SEQ ID NO: 188445 - DNA, 35 bp, Artificial Sequence
  Synthetic oligonucleotide
tctagactcgtaccgcatcctgtctacctaccaac

SEQ ID NO: 188446 - DNA, 35 bp, Artificial Sequence
  Synthetic oligonucleotide
actaccaggagggtgggagggacctggtaggacac

SEQ ID NO: 188447 - DNA, 35 bp, Artificial Sequence
  Synthetic oligonucleotide
ttggtcgatcgtgcccctgtaataccgaaacccac

SEQ ID NO: 188448 - DNA, 35 bp, Artificial Sequence
  Synthetic oligonucleotide
gccgaagccgcctatttccacttccataccttgac

SEQ ID NO: 188449 - DNA, 35 bp, Artificial Sequence
  Synthetic oligonucleotide
aacccgttcgcgcccaaaatcacggcctccagtac

SEQ ID NO: 188450 - DNA, 35 bp, Artificial Sequence
  Synthetic oligonucleotide
ttgacggcccagggcgcaacctgaatcctcgttac

SEQ ID NO: 188451 - DNA, 35 bp, Artificial Sequence
  Synthetic oligonucleotide
ttccacctcgggcagttgtactcctgccactttac

SEQ ID NO: 188452 - DNA, 35 bp, Artificial Sequence
  Synthetic oligonucleotide
agaccctcgtcctaaatgttcggcgcctcttcacc

SEQ ID NO: 188453 - DNA, 35 bp, Artificial Sequence
  Synthetic oligonucleotide
acttaccgccgtagtttgtcccccgttgctctacc

SEQ ID NO: 188454 - DNA, 35 bp, Artificial Sequence
  Synthetic oligonucleotide
ggccaacgcccgctctgccattttacttttctacc

SEQ ID NO: 188455 - DNA, 35 bp, Artificial Sequence
  Synthetic oligonucleotide
gaatgccgtcgcatcgtaatcacctcgaccgtacc

SEQ ID NO: 188456 - DNA, 35 bp, Artificial Sequence
  Synthetic oligonucleotide
tatggtctcgccctctccactttatcaagcttacc

SEQ ID NO: 188457 - DNA, 35 bp, Artificial Sequence
  Synthetic oligonucleotide
acagcgcacctgctcgccccttattggattttacc

SEQ ID NO: 188458 - DNA, 35 bp, Artificial Sequence
  Synthetic oligonucleotide
aatatcatccctgcgcataccacaggctgccaccc

SEQ ID NO: 188459 - DNA, 35 bp, Artificial Sequence
  Synthetic oligonucleotide
acgctatccctcatccgttgttccttgaatcaccc

SEQ ID NO: 188460 - DNA, 34 bp, Artificial Sequence
  Synthetic oligonucleotide
acgacacggctcagttccatctccagtgcccccc

SEQ ID NO: 188461 - DNA, 35 bp, Artificial Sequence
  Synthetic oligonucleotide
tgtcacctttcacactagcccgtttatccgccccc

SEQ ID NO: 188462 - DNA, 35 bp, Artificial Sequence
  Synthetic oligonucleotide
gaagttgtacgtccgtcccggttcttatcgccccc

SEQ ID NO: 188463 - DNA, 34 bp, Artificial Sequence
  Synthetic oligonucleotide
tctatcggtcatgattccggctctctcctgcccc

SEQ ID NO: 188464 - DNA, 35 bp, Artificial Sequence
  Synthetic oligonucleotide
gcctggctacccgcgctcgcgaccttctcacgccc

SEQ ID NO: 188465 - DNA, 36 bp, Artificial Sequence
  Synthetic oligonucleotide
ggacccctgtacgctgactaaaaactgatgccgccc

SEQ ID NO: 188466 - DNA, 35 bp, Artificial Sequence
  Synthetic oligonucleotide
cccaacgtaacgttacacctcgcacaccccggccc

SEQ ID NO: 188467 - DNA, 35 bp, Artificial Sequence
  Synthetic oligonucleotide
atgcatatcgctgtctaacggtccttttccatccc

SEQ ID NO: 188468 - DNA, 36 bp, Artificial Sequence
  Synthetic oligonucleotide
agtggcagtccttgattcagccggtcccttctctcc

SEQ ID NO: 188469 - DNA, 35 bp, Artificial Sequence
  Synthetic oligonucleotide
ttccaacctgtcctcagcccttatactcctagtcc

SEQ ID NO: 188470 - DNA, 35 bp, Artificial Sequence
  Synthetic oligonucleotide
gcgcccatagtgccgtttatcttcccccagggtcc

SEQ ID NO: 188471 - DNA, 35 bp, Artificial Sequence
  Synthetic oligonucleotide
gcacctaggtctgtgctggcgtttctccctcttcc

SEQ ID NO: 188472 - DNA, 35 bp, Artificial Sequence
  Synthetic oligonucleotide
ggtgagtggtctcctcgcttttatacggttcttcc

SEQ ID NO: 188473 - DNA, 35 bp, Artificial Sequence
  Synthetic oligonucleotide
gtggcctcaccctccttccgcatgtaatccgttcc

SEQ ID NO: 188474 - DNA, 35 bp, Artificial Sequence
  Synthetic oligonucleotide
tcacactccccatatttcaccaacgcctgctatgc

SEQ ID NO: 188475 - DNA, 35 bp, Artificial Sequence
  Synthetic oligonucleotide
gtcacagtgtagtactaccctaacccgcctgttgc

SEQ ID NO: 188476 - DNA, 35 bp, Artificial Sequence
  Synthetic oligonucleotide
tgtaccatctcgctatgttcacaccttgtcgaatc

SEQ ID NO: 188477 - DNA, 35 bp, Artificial Sequence
  Synthetic oligonucleotide
tcctaccgctacccctcattgtcatggcattaatc

SEQ ID NO: 188478 - DNA, 34 bp, Artificial Sequence
  Synthetic oligonucleotide
ggcccaaacccgcccgccacgccctaaggccatc

SEQ ID NO: 188479 - DNA, 35 bp, Artificial Sequence
  Synthetic oligonucleotide
actgttcgccctctatgtcccgccttcccctgatc

SEQ ID NO: 188480 - DNA, 35 bp, Artificial Sequence
  Synthetic oligonucleotide
ttgtcatccgccgtgctaatcgagccccgccactc

SEQ ID NO: 188481 - DNA, 35 bp, Artificial Sequence
  Synthetic oligonucleotide
gactttgtcctgatgtcacgtctatccaccacctc

SEQ ID NO: 188482 - DNA, 35 bp, Artificial Sequence
  Synthetic oligonucleotide
tgttccaccgccgcattttaatccttcatcgcctc

SEQ ID NO: 188483 - DNA, 35 bp, Artificial Sequence
  Synthetic oligonucleotide
gtctgccccaaaaccgtggatcgtgcctcccgctc

SEQ ID NO: 188484 - DNA, 35 bp, Artificial Sequence
  Synthetic oligonucleotide
acgacttgcgctcccatacacctcatcctcggctc

SEQ ID NO: 188485 - DNA, 35 bp, Artificial Sequence
  Synthetic oligonucleotide
tcgacgatctgtcaaggctacgtacatccactctc

SEQ ID NO: 188486 - DNA, 34 bp, Artificial Sequence
  Synthetic oligonucleotide
gtccctggcgcctcaacacgcgttaccacaattc

SEQ ID NO: 188487 - DNA, 35 bp, Artificial Sequence
  Synthetic oligonucleotide
aacagatccgctatgcgctttaccccacaccattc

SEQ ID NO: 188488 - DNA, 35 bp, Artificial Sequence
  Synthetic oligonucleotide
gttgccgcccccgaattatatgcccctcttacttc

SEQ ID NO: 188489 - DNA, 35 bp, Artificial Sequence
  Synthetic oligonucleotide
tacccatctgttcgctcccttgtgactgtaccttc

SEQ ID NO: 188490 - DNA, 35 bp, Artificial Sequence
  Synthetic oligonucleotide
tccgttgcaacctgttcagcttccattgcctgttc

SEQ ID NO: 188491 - DNA, 35 bp, Artificial Sequence
  Synthetic oligonucleotide
aataccgctccctctgagtgtttcacctgtatttc

SEQ ID NO: 188492 - DNA, 35 bp, Artificial Sequence
  Synthetic oligonucleotide
ttcgtccttccgccatcgagttgcatgatcttttc

SEQ ID NO: 188493 - DNA, 35 bp, Artificial Sequence
  Synthetic oligonucleotide
gatccgttcactggcatctcgcccatcgccctacg

SEQ ID NO: 188494 - DNA, 35 bp, Artificial Sequence
  Synthetic oligonucleotide
gcctccccccagttcgcctcaattggttccctccg

SEQ ID NO: 188495 - DNA, 35 bp, Artificial Sequence
  Synthetic oligonucleotide
ggtcgccacgcctccgtccatttaagcttaccgcg

SEQ ID NO: 188496 - DNA, 35 bp, Artificial Sequence
  Synthetic oligonucleotide
atcgccccatctgggcttgacctcctgccttcgcg

SEQ ID NO: 188497 - DNA, 35 bp, Artificial Sequence
  Synthetic oligonucleotide
agatgcgggtagggtgggcccagagcggggtggcg

SEQ ID NO: 188498 - DNA, 35 bp, Artificial Sequence
  Synthetic oligonucleotide
tgtccctcgcctctccatctgtcgtacagtgatcg

SEQ ID NO: 188499 - DNA, 35 bp, Artificial Sequence
  Synthetic oligonucleotide
gactgtatccccgctggacccttctccgttggtcg

SEQ ID NO: 188500 - DNA, 35 bp, Artificial Sequence
  Synthetic oligonucleotide
tacggagtgggggggggaggctccgacgggatagg

SEQ ID NO: 188501 - DNA, 35 bp, Artificial Sequence
  Synthetic oligonucleotide
taacaatcctaagctgtacggtgggggggaaaggg

SEQ ID NO: 188502 - DNA, 35 bp, Artificial Sequence
  Synthetic oligonucleotide
gcacacgttcatcccgcctccttttgtgcttttgg

SEQ ID NO: 188503 - DNA, 34 bp, Artificial Sequence
  Synthetic oligonucleotide
gctcgaaccgtctcgctcctcgtaaaaccccatg

SEQ ID NO: 188504 - DNA, 35 bp, Artificial Sequence
  Synthetic oligonucleotide
gattgaggagaaggggctgggatcggtgcagcatg

SEQ ID NO: 188505 - DNA, 35 bp, Artificial Sequence
  Synthetic oligonucleotide
atcaacgcacggcacctctctttcttcgacacctg

SEQ ID NO: 188506 - DNA, 35 bp, Artificial Sequence
  Synthetic oligonucleotide
agctccccgtcttgttttctctcatccgccgcctg

SEQ ID NO: 188507 - DNA, 36 bp, Artificial Sequence
  Synthetic oligonucleotide
taggcggaaggtgaggggtgccgggtggtggtagtg

SEQ ID NO: 188508 - DNA, 36 bp, Artificial Sequence
  Synthetic oligonucleotide
tgatggggagacggtcgtgttgcgggggaggaggtg

SEQ ID NO: 188509 - DNA, 35 bp, Artificial Sequence
  Synthetic oligonucleotide
tgaccacttctcctgtacttcctctccgtgatgtg

SEQ ID NO: 188510 - DNA, 35 bp, Artificial Sequence
  Synthetic oligonucleotide
tttcagccgcattttagtacgcccatccattattg

SEQ ID NO: 188511 - DNA, 35 bp, Artificial Sequence
  Synthetic oligonucleotide
acatgttgcgccgccgttatcgctccgacttgaat

SEQ ID NO: 188512 - DNA, 35 bp, Artificial Sequence
  Synthetic oligonucleotide
gtcacacgctttccacctcgcctgccaactttgat

SEQ ID NO: 188513 - DNA, 35 bp, Artificial Sequence
  Synthetic oligonucleotide
gccaaacccatatgctttttcgtactgatccacct

SEQ ID NO: 188514 - DNA, 35 bp, Artificial Sequence
  Synthetic oligonucleotide
gcgtgcgtgcccgttcaatgcccactttgtcacct

SEQ ID NO: 188515 - DNA, 35 bp, Artificial Sequence
  Synthetic oligonucleotide
atacgttgcagagcaccgcctcgcctttcgatcct

SEQ ID NO: 188516 - DNA, 35 bp, Artificial Sequence
  Synthetic oligonucleotide
tttggcgaccacacggttcaaactgattctctcct

SEQ ID NO: 188517 - DNA, 35 bp, Artificial Sequence
  Synthetic oligonucleotide
gtcaccggcacgttatactcccacattcttgtcct

SEQ ID NO: 188518 - DNA, 35 bp, Artificial Sequence
  Synthetic oligonucleotide
gcagtccgcgcgggcctgctgtttatcaaacctct

SEQ ID NO: 188519 - DNA, 35 bp, Artificial Sequence
  Synthetic oligonucleotide
tcgtgggcacctcccttcagcttaagacctcctct

SEQ ID NO: 188520 - DNA, 35 bp, Artificial Sequence
  Synthetic oligonucleotide
tccaccttgatgattcagtcgattcgctaccttct

SEQ ID NO: 188521 - DNA, 35 bp, Artificial Sequence
  Synthetic oligonucleotide
gaggacggttcggggggctacgggattacagttct

SEQ ID NO: 188522 - DNA, 35 bp, Artificial Sequence
  Synthetic oligonucleotide
atcccactcgcatgcgaaatatatacctgtccagt

SEQ ID NO: 188523 - DNA, 35 bp, Artificial Sequence
  Synthetic oligonucleotide
ttacgtaggggcggtcgaaaggggtggtagggggt

SEQ ID NO: 188524 - DNA, 35 bp, Artificial Sequence
  Synthetic oligonucleotide
tcacgaccaccctcttatgctcccggcggagtatt

SEQ ID NO: 188525 - DNA, 35 bp, Artificial Sequence
  Synthetic oligonucleotide
gacgcgtgcctgtcgttgcccccccttatcgactt

SEQ ID NO: 188526 - DNA, 35 bp, Artificial Sequence
  Synthetic oligonucleotide
atgtcagatcgtccttagcctgccccactgtactt

SEQ ID NO: 188527 - DNA, 35 bp, Artificial Sequence
  Synthetic oligonucleotide
ttcccccccagcttgtcccgccgtaaattatcctt

SEQ ID NO: 188528 - DNA, 29 bp, Artificial Sequence
  Synthetic oligonucleotide
gcatccaccctgttgttcttggattcctt

SEQ ID NO: 188529 - DNA, 35 bp, Artificial Sequence
  Synthetic oligonucleotide
tgtggcacgctgtgggcattcgtctcccctgcttt

SEQ ID NO: 188530 - DNA, 35 bp, Artificial Sequence
  Synthetic oligonucleotide
tctacatgccctgcactccgagttttgtctcgttt

SEQ ID NO: 188531 - DNA, 35 bp, Artificial Sequence
  Synthetic oligonucleotide
tgcaccgccttgcggttactcctacttactggttt

SEQ ID NO: 188532 - DNA, 36 bp, Artificial Sequence
  Synthetic oligonucleotide
accaatccgacccttggtgtctagcctttgtcccaa

SEQ ID NO: 188533 - DNA, 35 bp, Artificial Sequence
  Synthetic oligonucleotide
gattctaccgccctttctttttggagacctcgcaa

SEQ ID NO: 188534 - DNA, 35 bp, Artificial Sequence
  Synthetic oligonucleotide
ggtgtgtagaaggcgagggaggaggggtgtgggaa

SEQ ID NO: 188535 - DNA, 35 bp, Artificial Sequence
  Synthetic oligonucleotide
tcacagccggttgctccctgctatctgcccactaa

SEQ ID NO: 188536 - DNA, 36 bp, Artificial Sequence
  Synthetic oligonucleotide
aaatcgggggaggggcactaggggttagggtggtaa

SEQ ID NO: 188537 - DNA, 36 bp, Artificial Sequence
  Synthetic oligonucleotide
gccccgccatctcgtacactgggtctccctgaaaca

SEQ ID NO: 188538 - DNA, 36 bp, Artificial Sequence
  Synthetic oligonucleotide
gtcggatctgcgttgatctacccccctcgccgcaca

SEQ ID NO: 188539 - DNA, 36 bp, Artificial Sequence
  Synthetic oligonucleotide
ttcgcactacctgcgtgtcccctttcgccacggaca

SEQ ID NO: 188540 - DNA, 34 bp, Artificial Sequence
  Synthetic oligonucleotide
tgatggatgccgtttcgtcgttttattgccccca

SEQ ID NO: 188541 - DNA, 36 bp, Artificial Sequence
  Synthetic oligonucleotide
tcacatccactccgccaggcccgtaattcgtgccca

SEQ ID NO: 188542 - DNA, 35 bp, Artificial Sequence
  Synthetic oligonucleotide
ttacgcgggtgggcttgagcctgggtgggatccca

SEQ ID NO: 188543 - DNA, 36 bp, Artificial Sequence
  Synthetic oligonucleotide
gttcgatccagcgccctctctctgtctgttgtccca

SEQ ID NO: 188544 - DNA, 35 bp, Artificial Sequence
  Synthetic oligonucleotide
ggtcacacgcgtacatagccgttttcctgttccca

SEQ ID NO: 188545 - DNA, 36 bp, Artificial Sequence
  Synthetic oligonucleotide
tgtcacctgtctgctctttcgtaccgattatcgcca

SEQ ID NO: 188546 - DNA, 36 bp, Artificial Sequence
  Synthetic oligonucleotide
gtgagcagacaccgcattcagtcctttggccctcca

SEQ ID NO: 188547 - DNA, 36 bp, Artificial Sequence
  Synthetic oligonucleotide
tccgccgtaacgcggtgtccaagttccatcaacgca

SEQ ID NO: 188548 - DNA, 35 bp, Artificial Sequence
  Synthetic oligonucleotide
actgttaccctgttcgcccttagtcgctttacgca

SEQ ID NO: 188549 - DNA, 35 bp, Artificial Sequence
  Synthetic oligonucleotide
gttcacacagccgagtactccgctcccgttctgca

SEQ ID NO: 188550 - DNA, 36 bp, Artificial Sequence
  Synthetic oligonucleotide
aatgtccctgccgattttctgtagaacgccctctca

SEQ ID NO: 188551 - DNA, 36 bp, Artificial Sequence
  Synthetic oligonucleotide
gcacctgcctatgtccattaatctcagtcaccttca

SEQ ID NO: 188552 - DNA, 35 bp, Artificial Sequence
  Synthetic oligonucleotide
ggactgccctcgccctgttcgttcctgtcatttca

SEQ ID NO: 188553 - DNA, 37 bp, Artificial Sequence
  Synthetic oligonucleotide
gagtgccccacatgtccgcctatgttacttcccaaga

SEQ ID NO: 188554 - DNA, 37 bp, Artificial Sequence
  Synthetic oligonucleotide
agaacaggaggggagagggaaggataggcggaacaga

SEQ ID NO: 188555 - DNA, 36 bp, Artificial Sequence
  Synthetic oligonucleotide
ggaaggaaggggccaagagggggtggatgtagcaga

SEQ ID NO: 188556 - DNA, 37 bp, Artificial Sequence
  Synthetic oligonucleotide
gtgacctcctgctatctatacagtgtcctttcataga

SEQ ID NO: 188557 - DNA, 36 bp, Artificial Sequence
  Synthetic oligonucleotide
acgtgaccggcctcgatatccgttcgttcccctaga

SEQ ID NO: 188558 - DNA, 37 bp, Artificial Sequence
  Synthetic oligonucleotide
gggtggggtgggaggacgacatgtggggggctgacga

SEQ ID NO: 188559 - DNA, 36 bp, Artificial Sequence
  Synthetic oligonucleotide
gctccctcgcctctctgactcgcttcgtaggtacga

SEQ ID NO: 188560 - DNA, 37 bp, Artificial Sequence
  Synthetic oligonucleotide
atccgctgcttggtatcgttccatcatccgcccccga

SEQ ID NO: 188561 - DNA, 37 bp, Artificial Sequence
  Synthetic oligonucleotide
ttgcgccttcgcctatcgagttaatcgttcttcccga

SEQ ID NO: 188562 - DNA, 37 bp, Artificial Sequence
  Synthetic oligonucleotide
accacctgctacatccctccgttcggccggacgccga

SEQ ID NO: 188563 - DNA, 35 bp, Artificial Sequence
  Synthetic oligonucleotide
tgcacgcattcctatcgctatgagtccccctccga

SEQ ID NO: 188564 - DNA, 37 bp, Artificial Sequence
  Synthetic oligonucleotide
gtaggaagggggcggaagggatagacgaaaatagcga

SEQ ID NO: 188565 - DNA, 37 bp, Artificial Sequence
  Synthetic oligonucleotide
tcctcatccgccaacatcttacaaccactgccatcga

SEQ ID NO: 188566 - DNA, 37 bp, Artificial Sequence
  Synthetic oligonucleotide
aacccgactccgtgttgcgcaccccctcctagctcga

SEQ ID NO: 188567 - DNA, 37 bp, Artificial Sequence
  Synthetic oligonucleotide
agaagtgggacgggagtgggaaaccgggatggtagga

SEQ ID NO: 188568 - DNA, 37 bp, Artificial Sequence
  Synthetic oligonucleotide
gtgtgacaagatggaaagggaggtagtacggggggga

SEQ ID NO: 188569 - DNA, 36 bp, Artificial Sequence
  Synthetic oligonucleotide
gacgggtggaggggttaagctacgatagtgggggga

SEQ ID NO: 188570 - DNA, 37 bp, Artificial Sequence
  Synthetic oligonucleotide
agccggggaggacacggggatgggggtgcagttggga

SEQ ID NO: 188571 - DNA, 36 bp, Artificial Sequence
  Synthetic oligonucleotide
ttcacgtacggcggggggggaaggacggaccctgga

SEQ ID NO: 188572 - DNA, 37 bp, Artificial Sequence
  Synthetic oligonucleotide
gcgatatcgggagggaggctgggggaaatcacgtgga

SEQ ID NO: 188573 - DNA, 38 bp, Artificial Sequence
  Synthetic oligonucleotide
gatcgagtgaaggaaaaagggggggagagcgacaatga

SEQ ID NO: 188574 - DNA, 36 bp, Artificial Sequence
  Synthetic oligonucleotide
gcaggggacaaggctagtaggtcagggggaggatga

SEQ ID NO: 188575 - DNA, 36 bp, Artificial Sequence
  Synthetic oligonucleotide
ggtgcgaggacgggggggggacaaagggcgggatga

SEQ ID NO: 188576 - DNA, 38 bp, Artificial Sequence
  Synthetic oligonucleotide
ttgctggtcaggacctgccctatcacctcacccactga

SEQ ID NO: 188577 - DNA, 38 bp, Artificial Sequence
  Synthetic oligonucleotide
tagatgtcatacagcccccctcgtccatccttgactga

SEQ ID NO: 188578 - DNA, 38 bp, Artificial Sequence
  Synthetic oligonucleotide
tgagtactgggagggtgggaccagggggtgaaacctga

SEQ ID NO: 188579 - DNA, 38 bp, Artificial Sequence
  Synthetic oligonucleotide
atcgcccccctctaaatgttaccacaggacggtggtga

SEQ ID NO: 188580 - DNA, 36 bp, Artificial Sequence
  Synthetic oligonucleotide
tacgacgatgtagaaggtagaggggggcgggtgtga

SEQ ID NO: 188581 - DNA, 38 bp, Artificial Sequence
  Synthetic oligonucleotide
atcccgccccgagggatgttctcttatgctatccttga

SEQ ID NO: 188582 - DNA, 36 bp, Artificial Sequence
  Synthetic oligonucleotide
gtcatgtatcagccgttcccagccctctgtccttga

SEQ ID NO: 188583 - DNA, 38 bp, Artificial Sequence
  Synthetic oligonucleotide
tcaatccccccctggttctccttatgtacagttcttga

SEQ ID NO: 188584 - DNA, 38 bp, Artificial Sequence
  Synthetic oligonucleotide
tagttgaggggggagggtgcggaaaggtgcacagttga

SEQ ID NO: 188585 - DNA, 35 bp, Artificial Sequence
  Synthetic oligonucleotide
gttcaccgtaccgttgctgcccttccactgtacta

SEQ ID NO: 188586 - DNA, 36 bp, Artificial Sequence
  Synthetic oligonucleotide
taacccatgcccatcttgcgaacaaggctttgccta

SEQ ID NO: 188587 - DNA, 35 bp, Artificial Sequence
  Synthetic oligonucleotide
gtcaccagaatctccgcagcctgccatcctgctta

SEQ ID NO: 188588 - DNA, 36 bp, Artificial Sequence
  Synthetic oligonucleotide
ggggaggggctgaagaatggggcggttaaggggtta

SEQ ID NO: 188589 - DNA, 36 bp, Artificial Sequence
  Synthetic oligonucleotide
agccggcctacaattgcctttcgtgtctcaccttta

SEQ ID NO: 188590 - DNA, 36 bp, Artificial Sequence
  Synthetic oligonucleotide
tccacctcctggtcgattccctgcccctcgtgttta

SEQ ID NO: 188591 - DNA, 35 bp, Artificial Sequence
  Synthetic oligonucleotide
ttccctccgccccaagtacacgatccgttttgaac

SEQ ID NO: 188592 - DNA, 35 bp, Artificial Sequence
  Synthetic oligonucleotide
tgttgaacacgcggcctcacatatccatcgcgcac

SEQ ID NO: 188593 - DNA, 35 bp, Artificial Sequence
  Synthetic oligonucleotide
acatcctgcccattgatcgggctcatatacacgac

SEQ ID NO: 188594 - DNA, 35 bp, Artificial Sequence
  Synthetic oligonucleotide
accctgcgtaccgggccctatttgactactacacc

SEQ ID NO: 188595 - DNA, 35 bp, Artificial Sequence
  Synthetic oligonucleotide
ttagccggtctcccttggctcgtagtgatccaccc

SEQ ID NO: 188596 - DNA, 36 bp, Artificial Sequence
  Synthetic oligonucleotide
ttgcccctgtagtggtatctcgattaactcgccccc

SEQ ID NO: 188597 - DNA, 35 bp, Artificial Sequence
  Synthetic oligonucleotide
actcaggcccggtttcgagtatcccctctcatccc

SEQ ID NO: 188598 - DNA, 35 bp, Artificial Sequence
  Synthetic oligonucleotide
gaccctccctggcttgtgacttgctcggcttcgcc

SEQ ID NO: 188599 - DNA, 35 bp, Artificial Sequence
  Synthetic oligonucleotide
gaacccactcccgcccgatttatacagtttaatcc

SEQ ID NO: 188600 - DNA, 35 bp, Artificial Sequence
  Synthetic oligonucleotide
acccactcagcgatccgtattcaaactgcccctcc

SEQ ID NO: 188601 - DNA, 35 bp, Artificial Sequence
  Synthetic oligonucleotide
agacctcagtggaactatagcctctattcccctcc

SEQ ID NO: 188602 - DNA, 35 bp, Artificial Sequence
  Synthetic oligonucleotide
gaccattccgctagcctgctttctctcacccaggc

SEQ ID NO: 188603 - DNA, 35 bp, Artificial Sequence
  Synthetic oligonucleotide
tctgttgcgctccctatctcttttgtgctcccggc

SEQ ID NO: 188604 - DNA, 35 bp, Artificial Sequence
  Synthetic oligonucleotide
atacgctcgacctaatggcttccctggccccctgc

SEQ ID NO: 188605 - DNA, 35 bp, Artificial Sequence
  Synthetic oligonucleotide
gtgtgtcgccgagtcatctcgtacaatttttctgc

SEQ ID NO: 188606 - DNA, 35 bp, Artificial Sequence
  Synthetic oligonucleotide
ttgcgcccatcccggcccggcgcacgattaccatc

SEQ ID NO: 188607 - DNA, 35 bp, Artificial Sequence
  Synthetic oligonucleotide
tacacggtccatcttctttcgggtcttcacgcatc

SEQ ID NO: 188608 - DNA, 35 bp, Artificial Sequence
  Synthetic oligonucleotide
tgtacccccacgttaacgtataaccccgttctatc

SEQ ID NO: 188609 - DNA, 35 bp, Artificial Sequence
  Synthetic oligonucleotide
attgacgaagcgcagacctctacattcgcccactc

SEQ ID NO: 188610 - DNA, 35 bp, Artificial Sequence
  Synthetic oligonucleotide
gagagctatagtgcgcgccctttgtctactacctc

SEQ ID NO: 188611 - DNA, 36 bp, Artificial Sequence
  Synthetic oligonucleotide
tatgcccgccatccgtttacgggtctgcgaatcctc

SEQ ID NO: 188612 - DNA, 35 bp, Artificial Sequence
  Synthetic oligonucleotide
gtttgcccacgtatgtactatccgacgtccggctc

SEQ ID NO: 188613 - DNA, 35 bp, Artificial Sequence
  Synthetic oligonucleotide
gtcgagccagccacaattcctcaacgccccaagtc

SEQ ID NO: 188614 - DNA, 35 bp, Artificial Sequence
  Synthetic oligonucleotide
tacttgctcgtgcccactgcgtcttctcgttcgtc

SEQ ID NO: 188615 - DNA, 35 bp, Artificial Sequence
  Synthetic oligonucleotide
gaaacctgtcgccgatccatccgatacttttcgtc

SEQ ID NO: 188616 - DNA, 35 bp, Artificial Sequence
  Synthetic oligonucleotide
ggtacaactgccgcccatactattctcccaatgtc

SEQ ID NO: 188617 - DNA, 36 bp, Artificial Sequence
  Synthetic oligonucleotide
acccatctgcccagacccctccccgtcagtattgag

SEQ ID NO: 188618 - DNA, 35 bp, Artificial Sequence
  Synthetic oligonucleotide
tgggcggggcacgggagggggtgtgatgcacgtag

SEQ ID NO: 188619 - DNA, 35 bp, Artificial Sequence
  Synthetic oligonucleotide
accgggacaagggcaagggagggccatacaattag

SEQ ID NO: 188620 - DNA, 35 bp, Artificial Sequence
  Synthetic oligonucleotide
atgcaccatccgacatctcggacctcttcccttag

SEQ ID NO: 188621 - DNA, 35 bp, Artificial Sequence
  Synthetic oligonucleotide
tgaaacccaggcccttcatctcgaatatcgacccg

SEQ ID NO: 188622 - DNA, 35 bp, Artificial Sequence
  Synthetic oligonucleotide
acgcctctcatgctcattagtttcttgtctcgccg

SEQ ID NO: 188623 - DNA, 35 bp, Artificial Sequence
  Synthetic oligonucleotide
gatgaagcggcggaaggtggagtggaatgatgccg

SEQ ID NO: 188624 - DNA, 35 bp, Artificial Sequence
  Synthetic oligonucleotide
gagctcatcgaactgttcatcctgcccatcctccg

SEQ ID NO: 188625 - DNA, 35 bp, Artificial Sequence
  Synthetic oligonucleotide
ttgctcacacccacattcttaaacgccctgctccg

SEQ ID NO: 188626 - DNA, 35 bp, Artificial Sequence
  Synthetic oligonucleotide
ttggccacgcaacttctttaaaagcctcactctcg

SEQ ID NO: 188627 - DNA, 35 bp, Artificial Sequence
  Synthetic oligonucleotide
agcgcgggaaggcagggtgaaggaaaaaaggcagg

SEQ ID NO: 188628 - DNA, 35 bp, Artificial Sequence
  Synthetic oligonucleotide
ggggggaggtgtgacagaaggcgtagaggggtggg

SEQ ID NO: 188629 - DNA, 35 bp, Artificial Sequence
  Synthetic oligonucleotide
accccgctcacaagtcctcctctcgctttgattgg

SEQ ID NO: 188630 - DNA, 35 bp, Artificial Sequence
  Synthetic oligonucleotide
gcgtgacacgccctcgttgcccttttcccttcatg

SEQ ID NO: 188631 - DNA, 35 bp, Artificial Sequence
  Synthetic oligonucleotide
atcccctacaggggcacctgctccccatacacctg

SEQ ID NO: 188632 - DNA, 34 bp, Artificial Sequence
  Synthetic oligonucleotide
tgtacacgttcacccggccccgttcttccccctg

SEQ ID NO: 188633 - DNA, 35 bp, Artificial Sequence
  Synthetic oligonucleotide
cccccgccctcgttcctgccatttggccgtgcctg

SEQ ID NO: 188634 - DNA, 35 bp, Artificial Sequence
  Synthetic oligonucleotide
aatcgtgacaggcgggggggctgggataggctttg

SEQ ID NO: 188635 - DNA, 35 bp, Artificial Sequence
  Synthetic oligonucleotide
gaagtgaggacgcattagggggaggggacataaat

SEQ ID NO: 188636 - DNA, 35 bp, Artificial Sequence
  Synthetic oligonucleotide
aggagctacggggagggggggcgaggaacggaact

SEQ ID NO: 188637 - DNA, 35 bp, Artificial Sequence
  Synthetic oligonucleotide
tcctccggccaaacctgcaaacaccaaggtaccct

SEQ ID NO: 188638 - DNA, 35 bp, Artificial Sequence
  Synthetic oligonucleotide
tgggacgcacctggtcctccactcttagatcgcct

SEQ ID NO: 188639 - DNA, 35 bp, Artificial Sequence
  Synthetic oligonucleotide
tcacgccggtctgcttttcctgcatacttatgcct

SEQ ID NO: 188640 - DNA, 35 bp, Artificial Sequence
  Synthetic oligonucleotide
gttgcgcaccacactggcttttggaacttcctcct

SEQ ID NO: 188641 - DNA, 35 bp, Artificial Sequence
  Synthetic oligonucleotide
ttggtggcctatgaatgtctcgctctcgccgtcct

SEQ ID NO: 188642 - DNA, 35 bp, Artificial Sequence
  Synthetic oligonucleotide
atgttcgtgacaccgccggccacacattcgttcct

SEQ ID NO: 188643 - DNA, 35 bp, Artificial Sequence
  Synthetic oligonucleotide
gtcattccgccacacttcgccttccacccgatgct

SEQ ID NO: 188644 - DNA, 35 bp, Artificial Sequence
  Synthetic oligonucleotide
agacctctcgccctgcctatttgcaattaactgct

SEQ ID NO: 188645 - DNA, 35 bp, Artificial Sequence
  Synthetic oligonucleotide
acttacccccgcattatatttacgatcgccttgct

SEQ ID NO: 188646 - DNA, 35 bp, Artificial Sequence
  Synthetic oligonucleotide
tcttggagccgttccgtgcccgttacctctgttct

SEQ ID NO: 188647 - DNA, 35 bp, Artificial Sequence
  Synthetic oligonucleotide
ttgccacgcgcccgcgctgctataccatcctccgt

SEQ ID NO: 188648 - DNA, 35 bp, Artificial Sequence
  Synthetic oligonucleotide
acttgacgcacgtagtctccccttcctctctgatt

SEQ ID NO: 188649 - DNA, 35 bp, Artificial Sequence
  Synthetic oligonucleotide
gttagcgtggctatgtttttcctctccgttacctt

SEQ ID NO: 188650 - DNA, 35 bp, Artificial Sequence
  Synthetic oligonucleotide
ttcctccccagcttgtcccgccgtaaattatcctt

SEQ ID NO: 188651 - DNA, 35 bp, Artificial Sequence
  Synthetic oligonucleotide
acgcgcctccttccgttatcgccgacaaatcgctt

SEQ ID NO: 188652 - DNA, 35 bp, Artificial Sequence
  Synthetic oligonucleotide
gatcacgtagctaaactttgctctaccctgttctt

SEQ ID NO: 188653 - DNA, 35 bp, Artificial Sequence
  Synthetic oligonucleotide
gttcacttcctcctgctttaccgctcgtcgacttt

SEQ ID NO: 188654 - DNA, 35 bp, Artificial Sequence
  Synthetic oligonucleotide
tccatctcatccggacgtgagctcgtggccctttt

SEQ ID NO: 188655 - DNA, 35 bp, Artificial Sequence
  Synthetic oligonucleotide
gttacaccacacgccgccacagccgtgcgattttt

SEQ ID NO: 188656 - DNA, 36 bp, Artificial Sequence
  Synthetic oligonucleotide
tatcacatccgcctatagggtatcactccgctccaa

SEQ ID NO: 188657 - DNA, 35 bp, Artificial Sequence
  Synthetic oligonucleotide
tgatatgacgctatctgcctggaccacctttccaa

SEQ ID NO: 188658 - DNA, 36 bp, Artificial Sequence
  Synthetic oligonucleotide
ttggagggggggacgggttgagctcgttgttagcaa

SEQ ID NO: 188659 - DNA, 35 bp, Artificial Sequence
  Synthetic oligonucleotide
tgatgggtcgggggacggagcaggggggcatgcaa

SEQ ID NO: 188660 - DNA, 36 bp, Artificial Sequence
  Synthetic oligonucleotide
gcgatcaccggtctcgcctcctagtctctgctttaa

SEQ ID NO: 188661 - DNA, 36 bp, Artificial Sequence
  Synthetic oligonucleotide
ttgcactcgggctgggcgggcggggagtagtccaca

SEQ ID NO: 188662 - DNA, 36 bp, Artificial Sequence
  Synthetic oligonucleotide
gcacccgccatcagttttcgtctctgtccgttcaca

SEQ ID NO: 188663 - DNA, 36 bp, Artificial Sequence
  Synthetic oligonucleotide
acttgtcctcctgtatagcgccgacctcctactaca

SEQ ID NO: 188664 - DNA, 36 bp, Artificial Sequence
  Synthetic oligonucleotide
ttgtgtactccggttgtatcgccactcgccttccca

SEQ ID NO: 188665 - DNA, 35 bp, Artificial Sequence
  Synthetic oligonucleotide
tgcagattcgatcctcccttcgccccgcggtgcca

SEQ ID NO: 188666 - DNA, 36 bp, Artificial Sequence
  Synthetic oligonucleotide
tccgtacgccctccctgctacatgcttgaatgtcca

SEQ ID NO: 188667 - DNA, 36 bp, Artificial Sequence
  Synthetic oligonucleotide
tccgtaaggccccctctgccccttagtgaggttcca

SEQ ID NO: 188668 - DNA, 36 bp, Artificial Sequence
  Synthetic oligonucleotide
aattgcccggccttctcatgccacaccgtgtttcca

SEQ ID NO: 188669 - DNA, 35 bp, Artificial Sequence
  Synthetic oligonucleotide
tgctccatcgacacggtcctctctactactgtgca

SEQ ID NO: 188670 - DNA, 36 bp, Artificial Sequence
  Synthetic oligonucleotide
gtgagcctcccgactttctatctgtgctgcttatca

SEQ ID NO: 188671 - DNA, 35 bp, Artificial Sequence
  Synthetic oligonucleotide
atacgcatggctttggtgctcccctcgtttcctca

SEQ ID NO: 188672 - DNA, 37 bp, Artificial Sequence
  Synthetic oligonucleotide
gcgggggacggaggaggaaatgcgggtaagtgaaaga

SEQ ID NO: 188673 - DNA, 37 bp, Artificial Sequence
  Synthetic oligonucleotide
ggtatggggaggataagagggcggtggggaggcgaga

SEQ ID NO: 188674 - DNA, 36 bp, Artificial Sequence
  Synthetic oligonucleotide
gaccaccatccagccctcgctccacttgacatgaga

SEQ ID NO: 188675 - DNA, 37 bp, Artificial Sequence
  Synthetic oligonucleotide
tgacgccttaaccgtgtctcccccgctttccttgaga

SEQ ID NO: 188676 - DNA, 36 bp, Artificial Sequence
  Synthetic oligonucleotide
gaagagaagggcaggagaggacacgcaagcaataga

SEQ ID NO: 188677 - DNA, 37 bp, Artificial Sequence
  Synthetic oligonucleotide
gcctccgcacgatcctttttgccgttaacactcacga

SEQ ID NO: 188678 - DNA, 37 bp, Artificial Sequence
  Synthetic oligonucleotide
taaataagagcgaagagcgggaggagaaggtggacga

SEQ ID NO: 188679 - DNA, 37 bp, Artificial Sequence
  Synthetic oligonucleotide
gtccctcacaatgtctttctctcccggtcgcatacga

SEQ ID NO: 188680 - DNA, 37 bp, Artificial Sequence
  Synthetic oligonucleotide
gcattgcacgtcttcccatggctaccttctgttacga

SEQ ID NO: 188681 - DNA, 37 bp, Artificial Sequence
  Synthetic oligonucleotide
tcatccccacaaactctgttacgacagcccgtgccga

SEQ ID NO: 188682 - DNA, 37 bp, Artificial Sequence
  Synthetic oligonucleotide
gcaccgccacctgcctctgaaacgcaatcgttgccga

SEQ ID NO: 188683 - DNA, 37 bp, Artificial Sequence
  Synthetic oligonucleotide
gttacgcctctccgtcagtttgcttcctctcatccga

SEQ ID NO: 188684 - DNA, 36 bp, Artificial Sequence
  Synthetic oligonucleotide
tccgccgaacgacagcagccccccgtactcctccga

SEQ ID NO: 188685 - DNA, 37 bp, Artificial Sequence
  Synthetic oligonucleotide
gtctcgacgacgactactaagtatttcccctctccga

SEQ ID NO: 188686 - DNA, 35 bp, Artificial Sequence
  Synthetic oligonucleotide
acgttcctccgccgcaatcctctcgagtcacgcga

SEQ ID NO: 188687 - DNA, 37 bp, Artificial Sequence
  Synthetic oligonucleotide
ggggagtacatggggggagcagggacatcgagcgcga

SEQ ID NO: 188688 - DNA, 37 bp, Artificial Sequence
  Synthetic oligonucleotide
acaaccccggccactaacttcacagccgtccactcga

SEQ ID NO: 188689 - DNA, 35 bp, Artificial Sequence
  Synthetic oligonucleotide
actcccctactgaacgctttaccgatgccattcga

SEQ ID NO: 188690 - DNA, 37 bp, Artificial Sequence
  Synthetic oligonucleotide
ttaccctcagaggtttccctgccccgctctccacgga

SEQ ID NO: 188691 - DNA, 36 bp, Artificial Sequence
  Synthetic oligonucleotide
tcccattcctctctgtcgtgacccgtatactacgga

SEQ ID NO: 188692 - DNA, 37 bp, Artificial Sequence
  Synthetic oligonucleotide
acccttcgcgccttcctttttatctgtgcaccccgga

SEQ ID NO: 188693 - DNA, 37 bp, Artificial Sequence
  Synthetic oligonucleotide
gaacccccccgccgccagggcaccttcccattgggga

SEQ ID NO: 188694 - DNA, 37 bp, Artificial Sequence
  Synthetic oligonucleotide
gagagcgggaagaggggaggcatcggtggcttgggga

SEQ ID NO: 188695 - DNA, 37 bp, Artificial Sequence
  Synthetic oligonucleotide
tttaagccgtgggcgggtgggtgagagccatatggga

SEQ ID NO: 188696 - DNA, 36 bp, Artificial Sequence
  Synthetic oligonucleotide
acccgtcacgcaaaaggtcactgccccccctctgga

SEQ ID NO: 188697 - DNA, 35 bp, Artificial Sequence
  Synthetic oligonucleotide
gcacaaggggacgggaaatggatcaagcaggtgga

SEQ ID NO: 188698 - DNA, 37 bp, Artificial Sequence
  Synthetic oligonucleotide
atccacagcggtctgctctttatccccggttccatga

SEQ ID NO: 188699 - DNA, 38 bp, Artificial Sequence
  Synthetic oligonucleotide
aatgtggtggaggagggaggtaggtagcagagggatga

SEQ ID NO: 188700 - DNA, 38 bp, Artificial Sequence
  Synthetic oligonucleotide
gccgcgctaaccgtctattgcctccctctacacactga

SEQ ID NO: 188701 - DNA, 38 bp, Artificial Sequence
  Synthetic oligonucleotide
tccccatcccgacttttctcgcgccgtcactcgactga

SEQ ID NO: 188702 - DNA, 38 bp, Artificial Sequence
  Synthetic oligonucleotide
tcgccccatccgctgtctactgggcccccgacacctga

SEQ ID NO: 188703 - DNA, 37 bp, Artificial Sequence
  Synthetic oligonucleotide
acacccgcctctgttccaggcgaaacatgtcccctga

SEQ ID NO: 188704 - DNA, 38 bp, Artificial Sequence
  Synthetic oligonucleotide
ttcgtgtagcattccctcgttctgtacccgttgcctga

SEQ ID NO: 188705 - DNA, 37 bp, Artificial Sequence
  Synthetic oligonucleotide
gcgctgaggggggggttgggagggacacaacggctga

SEQ ID NO: 188706 - DNA, 35 bp, Artificial Sequence
  Synthetic oligonucleotide
gatcaccacctcctagtgcacgtcgctacctctga

SEQ ID NO: 188707 - DNA, 36 bp, Artificial Sequence
  Synthetic oligonucleotide
gcaccgattattgaccatctgcgcctgcccctgtga

SEQ ID NO: 188708 - DNA, 38 bp, Artificial Sequence
  Synthetic oligonucleotide
tactgcaccacagcgtaatcctcttcggccctctgtga

SEQ ID NO: 188709 - DNA, 37 bp, Artificial Sequence
  Synthetic oligonucleotide
tgtacttctcccgcccgttttatcacatgtccattga

SEQ ID NO: 188710 - DNA, 38 bp, Artificial Sequence
  Synthetic oligonucleotide
acagtaggggcggaggagcaggggatacccaaagttga

SEQ ID NO: 188711 - DNA, 38 bp, Artificial Sequence
  Synthetic oligonucleotide
gcacagtccctcgtgcccttatccccgcttatcgttga

SEQ ID NO: 188712 - DNA, 38 bp, Artificial Sequence
  Synthetic oligonucleotide
atgtacagcacaagggggtggtttggggcggtggttga

SEQ ID NO: 188713 - DNA, 38 bp, Artificial Sequence
  Synthetic oligonucleotide
ggaccgtcgttcgaatagcataccccgccgccgtttga

SEQ ID NO: 188714 - DNA, 35 bp, Artificial Sequence
  Synthetic oligonucleotide
gaacctccctctcgccttattggagacacccgata

SEQ ID NO: 188715 - DNA, 36 bp, Artificial Sequence
  Synthetic oligonucleotide
gaccgacgctcaccatgtccctcgccatcgcgacta

SEQ ID NO: 188716 - DNA, 35 bp, Artificial Sequence
  Synthetic oligonucleotide
tacaacccgtactcccactcatcgctatgtgacta

SEQ ID NO: 188717 - DNA, 36 bp, Artificial Sequence
  Synthetic oligonucleotide
ggggcgaggctcgctagtttccggccctacttcgta

SEQ ID NO: 188718 - DNA, 36 bp, Artificial Sequence
  Synthetic oligonucleotide
gacacgcacataactgtttctcttctggtctctgta

SEQ ID NO: 188719 - DNA, 36 bp, Artificial Sequence
  Synthetic oligonucleotide
taacccacccgtcccgtaggatctagcccctactta

SEQ ID NO: 188720 - DNA, 36 bp, Artificial Sequence
  Synthetic oligonucleotide
atccgacggaggggtaggtggagggggtggaggtta

SEQ ID NO: 188721 - DNA, 35 bp, Artificial Sequence
  Synthetic oligonucleotide
accctcctctgactagttttctcaggtcgccaaac

SEQ ID NO: 188722 - DNA, 35 bp, Artificial Sequence
  Synthetic oligonucleotide
tctcatcctagtttcgcctattgccctcgtgacac

SEQ ID NO: 188723 - DNA, 35 bp, Artificial Sequence
  Synthetic oligonucleotide
gaacccgtcccgatctcggtcttatcttgctacac

SEQ ID NO: 188724 - DNA, 35 bp, Artificial Sequence
  Synthetic oligonucleotide
gaacccggcgcagctccccgcgacttaaagcccac

SEQ ID NO: 188725 - DNA, 35 bp, Artificial Sequence
  Synthetic oligonucleotide
gtcacctgctagctcgctctcgccacctaatccac

SEQ ID NO: 188726 - DNA, 35 bp, Artificial Sequence
  Synthetic oligonucleotide
gtccccatccgcctaacgtaccactccactttgac

SEQ ID NO: 188727 - DNA, 35 bp, Artificial Sequence
  Synthetic oligonucleotide
gccccccgactacggctacatgacatcatctatac

SEQ ID NO: 188728 - DNA, 35 bp, Artificial Sequence
  Synthetic oligonucleotide
agtcaccccaatttccggctcttcgcacgtactac

SEQ ID NO: 188729 - DNA, 35 bp, Artificial Sequence
  Synthetic oligonucleotide
gatgagcacgggggagctggggaagaatgccgtac

SEQ ID NO: 188730 - DNA, 35 bp, Artificial Sequence
  Synthetic oligonucleotide
agaccctcactcatcctcacgagccagctttaacc

SEQ ID NO: 188731 - DNA, 35 bp, Artificial Sequence
  Synthetic oligonucleotide
tgttccatcattcggttcgcagacagaatcccacc

SEQ ID NO: 188732 - DNA, 35 bp, Artificial Sequence
  Synthetic oligonucleotide
tcgcaacacacttatttccgccttgctgctcgacc

SEQ ID NO: 188733 - DNA, 35 bp, Artificial Sequence
  Synthetic oligonucleotide
atgaacagccggcacattaattgcggccatctacc

SEQ ID NO: 188734 - DNA, 35 bp, Artificial Sequence
  Synthetic oligonucleotide
actacttctgctccacactcgtctaacactgaccc

SEQ ID NO: 188735 - DNA, 34 bp, Artificial Sequence
  Synthetic oligonucleotide
gttatcgccgcctaacctcctgagtacatacccc

SEQ ID NO: 188736 - DNA, 35 bp, Artificial Sequence
  Synthetic oligonucleotide
accacctatcagcgttgctccggtaacctaccccc

SEQ ID NO: 188737 - DNA, 35 bp, Artificial Sequence
  Synthetic oligonucleotide
acattacgcccgcgcgtcatctaattaggcccccc

SEQ ID NO: 188738 - DNA, 35 bp, Artificial Sequence
  Synthetic oligonucleotide
aatcctgtccgaatgttcttgcattgcccttcccc

SEQ ID NO: 188739 - DNA, 35 bp, Artificial Sequence
  Synthetic oligonucleotide
ggggtggtcatatacgatcttccgctgtcccgccc

SEQ ID NO: 188740 - DNA, 35 bp, Artificial Sequence
  Synthetic oligonucleotide
gttatcatcgccgcactgtgctggtactcgcgccc

SEQ ID NO: 188741 - DNA, 35 bp, Artificial Sequence
  Synthetic oligonucleotide
gccatcccccgacatattaatccttgttcatgccc

SEQ ID NO: 188742 - DNA, 35 bp, Artificial Sequence
  Synthetic oligonucleotide
gacgaaccgttgccgttcggtgaatcccgcttccc

SEQ ID NO: 188743 - DNA, 35 bp, Artificial Sequence
  Synthetic oligonucleotide
gaccaaaccctgctatcttgaacaaggtgaacgcc

SEQ ID NO: 188744 - DNA, 35 bp, Artificial Sequence
  Synthetic oligonucleotide
atgtacgcagtccttagttttttcatcgtcccgcc

SEQ ID NO: 188745 - DNA, 35 bp, Artificial Sequence
  Synthetic oligonucleotide
gcacacgccctacattcccgtcactataacaggcc

SEQ ID NO: 188746 - DNA, 35 bp, Artificial Sequence
  Synthetic oligonucleotide
acgctcagggggcgagggggtggggaagagttgcc

SEQ ID NO: 188747 - DNA, 35 bp, Artificial Sequence
  Synthetic oligonucleotide
aatgtatcgccgccacctatgccaagcttgttgcc

SEQ ID NO: 188748 - DNA, 35 bp, Artificial Sequence
  Synthetic oligonucleotide
acaccaccctccacccgtaaccaacacagagatcc

SEQ ID NO: 188749 - DNA, 35 bp, Artificial Sequence
  Synthetic oligonucleotide
gtcaccccccctatgtcttttaacgtactgactcc

SEQ ID NO: 188750 - DNA, 35 bp, Artificial Sequence
  Synthetic oligonucleotide
tcatgcccgacattttactcttcccttgctgttcc

SEQ ID NO: 188751 - DNA, 35 bp, Artificial Sequence
  Synthetic oligonucleotide
tctatcgcctcccatctcccatgagttctgaaagc

SEQ ID NO: 188752 - DNA, 35 bp, Artificial Sequence
  Synthetic oligonucleotide
tacaggacacctgcctcttaatacacttcccaagc

SEQ ID NO: 188753 - DNA, 35 bp, Artificial Sequence
  Synthetic oligonucleotide
gacgatccactagactatgcttatctgcccaccgc

SEQ ID NO: 188754 - DNA, 35 bp, Artificial Sequence
  Synthetic oligonucleotide
tgctggagtccccgtccgcatttccctggcccggc

SEQ ID NO: 188755 - DNA, 35 bp, Artificial Sequence
  Synthetic oligonucleotide
tcgcgtgcacgatccttcctactgtcctatctggc

SEQ ID NO: 188756 - DNA, 35 bp, Artificial Sequence
  Synthetic oligonucleotide
gcctgcacgcctatctactatcgcactaccttggc

SEQ ID NO: 188757 - DNA, 35 bp, Artificial Sequence
  Synthetic oligonucleotide
atggtccccccgctatattatctccggtttcgtgc

SEQ ID NO: 188758 - DNA, 35 bp, Artificial Sequence
  Synthetic oligonucleotide
ttgcgcgctgtccaacctccatctgtgccttttgc

SEQ ID NO: 188759 - DNA, 35 bp, Artificial Sequence
  Synthetic oligonucleotide
aattaccgtcagatctctccccccctggaatcatc

SEQ ID NO: 188760 - DNA, 35 bp, Artificial Sequence
  Synthetic oligonucleotide
agactagtcggcccgatccctgttctcctgctatc

SEQ ID NO: 188761 - DNA, 35 bp, Artificial Sequence
  Synthetic oligonucleotide
acacatggcaagagtttcagctccacccagttatc

SEQ ID NO: 188762 - DNA, 36 bp, Artificial Sequence
  Synthetic oligonucleotide
tgccaatcacctgtgctctgtctacgctcttcactc

SEQ ID NO: 188763 - DNA, 35 bp, Artificial Sequence
  Synthetic oligonucleotide
gccatcccccgcttgttccggttccctgtttactc

SEQ ID NO: 188764 - DNA, 35 bp, Artificial Sequence
  Synthetic oligonucleotide
tttggcctcaccctttcatttgcctatgtaccctc

SEQ ID NO: 188765 - DNA, 35 bp, Artificial Sequence
  Synthetic oligonucleotide
agtgcgctcctgcactgcccgtttctgtacccctc

SEQ ID NO: 188766 - DNA, 35 bp, Artificial Sequence
  Synthetic oligonucleotide
gtacggcactttcgcgttctgcaccaccacgcctc

SEQ ID NO: 188767 - DNA, 35 bp, Artificial Sequence
  Synthetic oligonucleotide
tcaacgaaagtacccccttgccagagttgctcctc

SEQ ID NO: 188768 - DNA, 35 bp, Artificial Sequence
  Synthetic oligonucleotide
atatcgcgccccgcctcacctcacaatgaaagctc

SEQ ID NO: 188769 - DNA, 35 bp, Artificial Sequence
  Synthetic oligonucleotide
gctgctctggtcttctgcaccctacgacaccgctc

SEQ ID NO: 188770 - DNA, 35 bp, Artificial Sequence
  Synthetic oligonucleotide
acgcctgacacatgtaaggcatccaaatccctctc

SEQ ID NO: 188771 - DNA, 35 bp, Artificial Sequence
  Synthetic oligonucleotide
tgcataccaggtcgtttcatgcacctgttcttctc

SEQ ID NO: 188772 - DNA, 35 bp, Artificial Sequence
  Synthetic oligonucleotide
gagcgccccctcctgttgacacctcgctgtaattc

SEQ ID NO: 188773 - DNA, 35 bp, Artificial Sequence
  Synthetic oligonucleotide
gcaatgtggcccttccctcgcctgagtcccacttc

SEQ ID NO: 188774 - DNA, 35 bp, Artificial Sequence
  Synthetic oligonucleotide
attccacgccttagacctgccggagccaccccttc

SEQ ID NO: 188775 - DNA, 35 bp, Artificial Sequence
  Synthetic oligonucleotide
gaggacgcccactttgaatatcggccgtttctttc

SEQ ID NO: 188776 - DNA, 35 bp, Artificial Sequence
  Synthetic oligonucleotide
tccgcctgcctgacttcgaacagtcacctccttag

SEQ ID NO: 188777 - DNA, 35 bp, Artificial Sequence
  Synthetic oligonucleotide
atcatcctcctccgcagtacttggaccactagacg

SEQ ID NO: 188778 - DNA, 35 bp, Artificial Sequence
  Synthetic oligonucleotide
tgccccccctcgagatcccttgttgcacacacccg

SEQ ID NO: 188779 - DNA, 35 bp, Artificial Sequence
  Synthetic oligonucleotide
ttgcgcacctatttagtctatttgacctcactccg

SEQ ID NO: 188780 - DNA, 35 bp, Artificial Sequence
  Synthetic oligonucleotide
tccgcacaatcgccccatgttctccgcaccacgcg

SEQ ID NO: 188781 - DNA, 35 bp, Artificial Sequence
  Synthetic oligonucleotide
gtcccaatcgttgtcttcattctgcttttcacgcg

SEQ ID NO: 188782 - DNA, 35 bp, Artificial Sequence
  Synthetic oligonucleotide
tgttagcccctccccaccccgccgttacattggcg

SEQ ID NO: 188783 - DNA, 35 bp, Artificial Sequence
  Synthetic oligonucleotide
gagtccatcgctgtgctacatcttacctcttatcg

SEQ ID NO: 188784 - DNA, 35 bp, Artificial Sequence
  Synthetic oligonucleotide
gggggcctgggggaagagagagtctggggtaaggg

SEQ ID NO: 188785 - DNA, 35 bp, Artificial Sequence
  Synthetic oligonucleotide
gataagtccgtggaggggtagacgggggggtactg

SEQ ID NO: 188786 - DNA, 35 bp, Artificial Sequence
  Synthetic oligonucleotide
tcaccccatcctaatctggatcatcgatccccctg

SEQ ID NO: 188787 - DNA, 35 bp, Artificial Sequence
  Synthetic oligonucleotide
tgatgccgtcatggccccccacccggtttcgtttg

SEQ ID NO: 188788 - DNA, 34 bp, Artificial Sequence
  Synthetic oligonucleotide
tcccccgactcgtgacccgttgtttgcgatccat

SEQ ID NO: 188789 - DNA, 35 bp, Artificial Sequence
  Synthetic oligonucleotide
ttgtcaggcctctatgtccgtcttttcttttgcat

SEQ ID NO: 188790 - DNA, 35 bp, Artificial Sequence
  Synthetic oligonucleotide
tgaggtcacccccaggctttagacgcccttctcat

SEQ ID NO: 188791 - DNA, 35 bp, Artificial Sequence
  Synthetic oligonucleotide
actcacccgttgccgataatgccatctcatgtgat

SEQ ID NO: 188792 - DNA, 35 bp, Artificial Sequence
  Synthetic oligonucleotide
gtgccctctggcaactgatacgcttacctctctat

SEQ ID NO: 188793 - DNA, 35 bp, Artificial Sequence
  Synthetic oligonucleotide
gccacgcccgagttctactgccgccccgaagccct

SEQ ID NO: 188794 - DNA, 35 bp, Artificial Sequence
  Synthetic oligonucleotide
gacgccctatgcgttttcctccttggtaccatcct

SEQ ID NO: 188795 - DNA, 35 bp, Artificial Sequence
  Synthetic oligonucleotide
actccacccgctcacccgaagttcattgtcgtcct

SEQ ID NO: 188796 - DNA, 35 bp, Artificial Sequence
  Synthetic oligonucleotide
actgcatcggccctccatcgtcctgaagccttcct

SEQ ID NO: 188797 - DNA, 33 bp, Artificial Sequence
  Synthetic oligonucleotide
tactgctgatgagcctaccgttttcaccccgct

SEQ ID NO: 188798 - DNA, 35 bp, Artificial Sequence
  Synthetic oligonucleotide
ttcaaccccgctaccgttctactccgatgacttct

SEQ ID NO: 188799 - DNA, 35 bp, Artificial Sequence
  Synthetic oligonucleotide
aaggggcgatgggacgaggggatggggcatggggt

SEQ ID NO: 188800 - DNA, 35 bp, Artificial Sequence
  Synthetic oligonucleotide
tgttgccggacccttggtatttctctctatcctgt

SEQ ID NO: 188801 - DNA, 35 bp, Artificial Sequence
  Synthetic oligonucleotide
tcatttcgtacaggtccgccctcgcctcacgctgt

SEQ ID NO: 188802 - DNA, 35 bp, Artificial Sequence
  Synthetic oligonucleotide
ataccacgcctccctacgcaataccctgcttttgt

SEQ ID NO: 188803 - DNA, 35 bp, Artificial Sequence
  Synthetic oligonucleotide
taacattcgccggtggttaccctggtccctcactt

SEQ ID NO: 188804 - DNA, 35 bp, Artificial Sequence
  Synthetic oligonucleotide
tttactgtcgcggcatttgctatgcgctccccctt

SEQ ID NO: 188805 - DNA, 35 bp, Artificial Sequence
  Synthetic oligonucleotide
atcacccatagggtgcacattattgctcgctcctt

SEQ ID NO: 188806 - DNA, 35 bp, Artificial Sequence
  Synthetic oligonucleotide
acttaagtgtccgcgctctcgtccgttccccgctt

SEQ ID NO: 188807 - DNA, 35 bp, Artificial Sequence
  Synthetic oligonucleotide
taatgcaccacctcgacagcgaacaagggcatctt

SEQ ID NO: 188808 - DNA, 35 bp, Artificial Sequence
  Synthetic oligonucleotide
tcgccccgtagccctatccgtcatgtccctaggtt

SEQ ID NO: 188809 - DNA, 31 bp, Artificial Sequence
  Synthetic oligonucleotide
accgaccgcccctatgtagttcctctctgtt

SEQ ID NO: 188810 - DNA, 35 bp, Artificial Sequence
  Synthetic oligonucleotide
ttacccattccgccctgagtttaccgtaccccttt

SEQ ID NO: 188811 - DNA, 35 bp, Artificial Sequence
  Synthetic oligonucleotide
gaatcacgccctgcctttcgggtcccgctcctttt

SEQ ID NO: 188812 - DNA, 36 bp, Artificial Sequence
  Synthetic oligonucleotide
gagagagggccaaaggggtcgcgagctacagggaaa

SEQ ID NO: 188813 - DNA, 36 bp, Artificial Sequence
  Synthetic oligonucleotide
gctcgccgggaaaggaaggggtgaggagcggaccaa

SEQ ID NO: 188814 - DNA, 35 bp, Artificial Sequence
  Synthetic oligonucleotide
gactgccaccttccctgtgtttgcctagtcgccaa

SEQ ID NO: 188815 - DNA, 35 bp, Artificial Sequence
  Synthetic oligonucleotide
tccgtcacccggccggccttcaggatcttcctgaa

SEQ ID NO: 188816 - DNA, 35 bp, Artificial Sequence
  Synthetic oligonucleotide
gacgccctcctcagcatcgacttgatacccttgaa

SEQ ID NO: 188817 - DNA, 36 bp, Artificial Sequence
  Synthetic oligonucleotide
aatcagtgtccctgcgttcttcatcccagcacctaa

SEQ ID NO: 188818 - DNA, 35 bp, Artificial Sequence
  Synthetic oligonucleotide
gatcaacccgcctccgcatcactcaaccctggtaa

SEQ ID NO: 188819 - DNA, 36 bp, Artificial Sequence
  Synthetic oligonucleotide
ttcggctccaccactgcatgtacgctactaccacca

SEQ ID NO: 188820 - DNA, 36 bp, Artificial Sequence
  Synthetic oligonucleotide
gtctactgtcagcctacttattttgaccatccccca

SEQ ID NO: 188821 - DNA, 36 bp, Artificial Sequence
  Synthetic oligonucleotide
ttcacagcacactattttgttttactcccgttccca

SEQ ID NO: 188822 - DNA, 36 bp, Artificial Sequence
  Synthetic oligonucleotide
tcgcacgcccatttttactgcccctgtcttgagcca

SEQ ID NO: 188823 - DNA, 35 bp, Artificial Sequence
  Synthetic oligonucleotide
gtcctcctgtacggttcgcccccacttacgctcca

SEQ ID NO: 188824 - DNA, 36 bp, Artificial Sequence
  Synthetic oligonucleotide
gcacatcccgcagatttatacttctttatcgctcca

SEQ ID NO: 188825 - DNA, 35 bp, Artificial Sequence
  Synthetic oligonucleotide
gccccccaccgtgactatctgtcatactgattcca

SEQ ID NO: 188826 - DNA, 36 bp, Artificial Sequence
  Synthetic oligonucleotide
ttggaaacgccacgctgccctcctgtcgaccttcca

SEQ ID NO: 188827 - DNA, 35 bp, Artificial Sequence
  Synthetic oligonucleotide
acctcaccatcttattgtccacctggcgttaagca

SEQ ID NO: 188828 - DNA, 35 bp, Artificial Sequence
  Synthetic oligonucleotide
ttgtcgccacccggttcttccccattctcgacgca

SEQ ID NO: 188829 - DNA, 35 bp, Artificial Sequence
  Synthetic oligonucleotide
ttggccccggaacggtctgtttctctcaccctgca

SEQ ID NO: 188830 - DNA, 36 bp, Artificial Sequence
  Synthetic oligonucleotide
atctccacccgccctggtccgcattacctgcctgca

SEQ ID NO: 188831 - DNA, 35 bp, Artificial Sequence
  Synthetic oligonucleotide
gcttccagctagcgacgttaacatgcaccacctca

SEQ ID NO: 188832 - DNA, 36 bp, Artificial Sequence
  Synthetic oligonucleotide
gctcacctggagattcgatttttcgccactgcctca

SEQ ID NO: 188833 - DNA, 35 bp, Artificial Sequence
  Synthetic oligonucleotide
ggtcggactccgtgtgtagtcgtccctctctctca

SEQ ID NO: 188834 - DNA, 36 bp, Artificial Sequence
  Synthetic oligonucleotide
gcccgaacccctgggaaattgcgctcctgtctctca

SEQ ID NO: 188835 - DNA, 36 bp, Artificial Sequence
  Synthetic oligonucleotide
tgccgtcgcacatcgtacctctcatcttccttgtca

SEQ ID NO: 188836 - DNA, 35 bp, Artificial Sequence
  Synthetic oligonucleotide
tccccgcaccagagaaatctcagcgtgcctcttca

SEQ ID NO: 188837 - DNA, 35 bp, Artificial Sequence
  Synthetic oligonucleotide
acacacctctacggtaagttgctccttgttcttca

SEQ ID NO: 188838 - DNA, 37 bp, Artificial Sequence
  Synthetic oligonucleotide
gggggggtgaggggagatataaccaaaaaagtataga

SEQ ID NO: 188839 - DNA, 37 bp, Artificial Sequence
  Synthetic oligonucleotide
gatcgccacagatcgctcccttaatctacaccctaga

SEQ ID NO: 188840 - DNA, 37 bp, Artificial Sequence
  Synthetic oligonucleotide
gaagcggaaaaacagggaaagacggcatggctgtaga

SEQ ID NO: 188841 - DNA, 37 bp, Artificial Sequence
  Synthetic oligonucleotide
tgagcctccacccctttgtcgctgtccactacttaga

SEQ ID NO: 188842 - DNA, 37 bp, Artificial Sequence
  Synthetic oligonucleotide
gcgagggggggcggggccggggacgtaataggtacga

SEQ ID NO: 188843 - DNA, 37 bp, Artificial Sequence
  Synthetic oligonucleotide
atgacacccgcaggctaacacacttctcgcacaccga

SEQ ID NO: 188844 - DNA, 37 bp, Artificial Sequence
  Synthetic oligonucleotide
gcgacgcctgcacgtgtttgaacccccgcacccccga

SEQ ID NO: 188845 - DNA, 37 bp, Artificial Sequence
  Synthetic oligonucleotide
tctacgtgccgcaggtcaccgcttcctcccctgccga

SEQ ID NO: 188846 - DNA, 37 bp, Artificial Sequence
  Synthetic oligonucleotide
atcagcccctctcctcagccccttcgcatctacgcga

SEQ ID NO: 188847 - DNA, 36 bp, Artificial Sequence
  Synthetic oligonucleotide
gccaccctgcacacgtatcctcgcctcctgaatcga

SEQ ID NO: 188848 - DNA, 37 bp, Artificial Sequence
  Synthetic oligonucleotide
gagcggggtagggtacgaaatcatgggaagggctcga

SEQ ID NO: 188849 - DNA, 35 bp, Artificial Sequence
  Synthetic oligonucleotide
ttacctcccgcaccaccactagacacttttgtcga

SEQ ID NO: 188850 - DNA, 37 bp, Artificial Sequence
  Synthetic oligonucleotide
tgccataccgcctcgctacccgtttcatctgtttcga

SEQ ID NO: 188851 - DNA, 37 bp, Artificial Sequence
  Synthetic oligonucleotide
gtggtgggggaagagttatgggggagcccagggagga

SEQ ID NO: 188852 - DNA, 35 bp, Artificial Sequence
  Synthetic oligonucleotide
gagggggtaaggggatatgggatgggagtgtagga

SEQ ID NO: 188853 - DNA, 37 bp, Artificial Sequence
  Synthetic oligonucleotide
ttccactacaatctgctatcctcgtcaccggtacgga

SEQ ID NO: 188854 - DNA, 37 bp, Artificial Sequence
  Synthetic oligonucleotide
ttgcaccgcactcactgcattgtcctcctcgtccgga

SEQ ID NO: 188855 - DNA, 36 bp, Artificial Sequence
  Synthetic oligonucleotide
taccccccccatgctacttggaccccccagtaggga

SEQ ID NO: 188856 - DNA, 36 bp, Artificial Sequence
  Synthetic oligonucleotide
gacgagtagacgggatttggtcggggacgggcggga

SEQ ID NO: 188857 - DNA, 37 bp, Artificial Sequence
  Synthetic oligonucleotide
agaccgattgacggggtggatagcaggaggacgggga

SEQ ID NO: 188858 - DNA, 37 bp, Artificial Sequence
  Synthetic oligonucleotide
gaccggtgaggaacagggtgggtggagcgctggggga

SEQ ID NO: 188859 - DNA, 37 bp, Artificial Sequence
  Synthetic oligonucleotide
tctgtaccgccgccattagcctgtcccccgagctgga

SEQ ID NO: 188860 - DNA, 36 bp, Artificial Sequence
  Synthetic oligonucleotide
gtgactggtacatgtagctacccacctccccttgga

SEQ ID NO: 188861 - DNA, 38 bp, Artificial Sequence
  Synthetic oligonucleotide
gccccgcccccacctgttattttttgcctttgacatga

SEQ ID NO: 188862 - DNA, 38 bp, Artificial Sequence
  Synthetic oligonucleotide
gaagagtgagggagggcggggtattggagaggccatga

SEQ ID NO: 188863 - DNA, 38 bp, Artificial Sequence
  Synthetic oligonucleotide
gcgaggtgtcgacgcctggtacactcccccccttatga

SEQ ID NO: 188864 - DNA, 37 bp, Artificial Sequence
  Synthetic oligonucleotide
gcccgagcccctcccgaggtaatattcaccaacctga

SEQ ID NO: 188865 - DNA, 37 bp, Artificial Sequence
  Synthetic oligonucleotide
gccaccccacctggcccttgtctgcctgcaatcctga

SEQ ID NO: 188866 - DNA, 38 bp, Artificial Sequence
  Synthetic oligonucleotide
aaccccgctcccagcatgactctagtcatctctcctga

SEQ ID NO: 188867 - DNA, 38 bp, Artificial Sequence
  Synthetic oligonucleotide
tgctccatcctcacttcgcatttgtcagaacctgctga

SEQ ID NO: 188868 - DNA, 38 bp, Artificial Sequence
  Synthetic oligonucleotide
gacacgtgaggaagggattagcatgggaaaaggagtga

SEQ ID NO: 188869 - DNA, 38 bp, Artificial Sequence
  Synthetic oligonucleotide
tcaggggagggcgcaacggggaggggggaacggagtga

SEQ ID NO: 188870 - DNA, 38 bp, Artificial Sequence
  Synthetic oligonucleotide
tgacgaccttccggcgcgtttccgtaacatcctagtga

SEQ ID NO: 188871 - DNA, 38 bp, Artificial Sequence
  Synthetic oligonucleotide
gacgtgggaggagggggtagtacgaagctcaagggtga

SEQ ID NO: 188872 - DNA, 37 bp, Artificial Sequence
  Synthetic oligonucleotide
ggagcggggggaagaggggtgaggattaagcgggtga

SEQ ID NO: 188873 - DNA, 38 bp, Artificial Sequence
  Synthetic oligonucleotide
ataggaacgggacaagtgggggcaagttggaggggtga

SEQ ID NO: 188874 - DNA, 38 bp, Artificial Sequence
  Synthetic oligonucleotide
tcgacgcctcaccgtccgctaccgatgccctcctgtga

SEQ ID NO: 188875 - DNA, 38 bp, Artificial Sequence
  Synthetic oligonucleotide
gagacacgcaaagtgaagggggttggtagtatgtgtga

SEQ ID NO: 188876 - DNA, 37 bp, Artificial Sequence
  Synthetic oligonucleotide
gagtgcgaaacacatgactctacgcccatccaattga

SEQ ID NO: 188877 - DNA, 38 bp, Artificial Sequence
  Synthetic oligonucleotide
ggagccacgccgggtactaccatccgtcctgcaattga

SEQ ID NO: 188878 - DNA, 38 bp, Artificial Sequence
  Synthetic oligonucleotide
aatagctgccccctgtccttctacgtgtcgtcacttga

SEQ ID NO: 188879 - DNA, 38 bp, Artificial Sequence
  Synthetic oligonucleotide
gtggctgagcttatgactttccctgccactcaccttga

SEQ ID NO: 188880 - DNA, 38 bp, Artificial Sequence
  Synthetic oligonucleotide
acaccctcacggtgcgtaaatccgctcaccccccttga

SEQ ID NO: 188881 - DNA, 37 bp, Artificial Sequence
  Synthetic oligonucleotide
ttgcgccgccctcctactgctcttagcgttctcttga

SEQ ID NO: 188882 - DNA, 38 bp, Artificial Sequence
  Synthetic oligonucleotide
gtctgcccccacgtgatagggctcctcgcttactttga

SEQ ID NO: 188883 - DNA, 38 bp, Artificial Sequence
  Synthetic oligonucleotide
gtcacccattgctcctttcacacagccacagcttttga

SEQ ID NO: 188884 - DNA, 38 bp, Artificial Sequence
  Synthetic oligonucleotide
ttccgcccccccctttgcactaatatagcatgttttga

SEQ ID NO: 188885 - DNA, 38 bp, Artificial Sequence
  Synthetic oligonucleotide
gatctgcgctccctccggaatggctccaccctttttga

SEQ ID NO: 188886 - DNA, 34 bp, Artificial Sequence
  Synthetic oligonucleotide
tgcgctctctgccttccttatcgtacagcacata

SEQ ID NO: 188887 - DNA, 36 bp, Artificial Sequence
  Synthetic oligonucleotide
tgtacccctcatagttacgtagttcgtgctcccata

SEQ ID NO: 188888 - DNA, 36 bp, Artificial Sequence
  Synthetic oligonucleotide
atgcgcctccttgctcacatccgccgtcttatacta

SEQ ID NO: 188889 - DNA, 36 bp, Artificial Sequence
  Synthetic oligonucleotide
gccatccccttctgcgttactggtgcgcatcttcta

SEQ ID NO: 188890 - DNA, 35 bp, Artificial Sequence
  Synthetic oligonucleotide
gaacgggagggggcagggcaaaccggggaggagta

SEQ ID NO: 188891 - DNA, 35 bp, Artificial Sequence
  Synthetic oligonucleotide
ggtaccacagccccctttccgagcactttcctgta

SEQ ID NO: 188892 - DNA, 35 bp, Artificial Sequence
  Synthetic oligonucleotide
accagtcacatcgtgtgccttcccgtttccttgta

SEQ ID NO: 188893 - DNA, 35 bp, Artificial Sequence
  Synthetic oligonucleotide
tagcctcgggtcctttgtttcattcctccacctta

SEQ ID NO: 188894 - DNA, 36 bp, Artificial Sequence
  Synthetic oligonucleotide
gacgcgaccctgccctcgtagctttcgtgcccttta

SEQ ID NO: 188895 - DNA, 36 bp, Artificial Sequence
  Synthetic oligonucleotide
ttcgcgtgcacctcaacgattgccctgtctccttta

SEQ ID NO: 188896 - DNA, 35 bp, Artificial Sequence
  Synthetic oligonucleotide
ttcgggcggacaggaggggatagggattggcttta

SEQ ID NO: 188897 - DNA, 33 bp, Artificial Sequence
  Synthetic oligonucleotide
taagcccgatccctctcttcgcgccgttaccac

SEQ ID NO: 188898 - DNA, 35 bp, Artificial Sequence
  Synthetic oligonucleotide
acagaaccgcacaccttacctgctgactaccagac

SEQ ID NO: 188899 - DNA, 35 bp, Artificial Sequence
  Synthetic oligonucleotide
tatcccctcgcgtttccacccagctcattttagac

SEQ ID NO: 188900 - DNA, 35 bp, Artificial Sequence
  Synthetic oligonucleotide
tagatagctccaccacgttatacccttcttgcgac

SEQ ID NO: 188901 - DNA, 35 bp, Artificial Sequence
  Synthetic oligonucleotide
ttggagattccgaggggggagggtcggaggtggac

SEQ ID NO: 188902 - DNA, 35 bp, Artificial Sequence
  Synthetic oligonucleotide
actgccttcatctgtgtccgtcccctcactagtac

SEQ ID NO: 188903 - DNA, 35 bp, Artificial Sequence
  Synthetic oligonucleotide
gttgcgccctccccccagtcaggcctctccccacc

SEQ ID NO: 188904 - DNA, 35 bp, Artificial Sequence
  Synthetic oligonucleotide
tggacggcatactgtctcttcgcatctccgccccc

SEQ ID NO: 188905 - DNA, 35 bp, Artificial Sequence
  Synthetic oligonucleotide
gccatcgctagccgttatgaacatctgtcgcgccc

SEQ ID NO: 188906 - DNA, 35 bp, Artificial Sequence
  Synthetic oligonucleotide
accacccgtcctgcttatccgactcaccgcatccc

SEQ ID NO: 188907 - DNA, 35 bp, Artificial Sequence
  Synthetic oligonucleotide
gactgtgcccgcttcctctacctgttacgggtccc

SEQ ID NO: 188908 - DNA, 35 bp, Artificial Sequence
  Synthetic oligonucleotide
gttggtcattccgttattgcatctctctatcagcc

SEQ ID NO: 188909 - DNA, 35 bp, Artificial Sequence
  Synthetic oligonucleotide
tgctcagctgactccactgcacgttacttcacgcc

SEQ ID NO: 188910 - DNA, 36 bp, Artificial Sequence
  Synthetic oligonucleotide
tgtatgccccacgtgttgctcctattctccagggcc

SEQ ID NO: 188911 - DNA, 35 bp, Artificial Sequence
  Synthetic oligonucleotide
acaccccggctgtttcctttttgagttctctggcc

SEQ ID NO: 188912 - DNA, 35 bp, Artificial Sequence
  Synthetic oligonucleotide
tgcctccaccagagacgttcctttgaacccctgcc

SEQ ID NO: 188913 - DNA, 35 bp, Artificial Sequence
  Synthetic oligonucleotide
gtgcgtatgatggacacgccctggcccccttatcc

SEQ ID NO: 188914 - DNA, 35 bp, Artificial Sequence
  Synthetic oligonucleotide
accccatcgccaaaccgtctgccgattcctgctcc

SEQ ID NO: 188915 - DNA, 35 bp, Artificial Sequence
  Synthetic oligonucleotide
tcctccaccagtgatatctccccgacgccccgtcc

SEQ ID NO: 188916 - DNA, 35 bp, Artificial Sequence
  Synthetic oligonucleotide
tatgaccccagaccgccctatttgccgacacttcc

SEQ ID NO: 188917 - DNA, 35 bp, Artificial Sequence
  Synthetic oligonucleotide
acagctagggggacgaagggtggagggagcacagc

SEQ ID NO: 188918 - DNA, 35 bp, Artificial Sequence
  Synthetic oligonucleotide
tccatccactacgaggccccatgcaggataccagc

SEQ ID NO: 188919 - DNA, 35 bp, Artificial Sequence
  Synthetic oligonucleotide
gacatcatcattgcagtttcacccctgccgcgggc

SEQ ID NO: 188920 - DNA, 35 bp, Artificial Sequence
  Synthetic oligonucleotide
tcctccgccaccaaatgccgggcctagactattgc

SEQ ID NO: 188921 - DNA, 35 bp, Artificial Sequence
  Synthetic oligonucleotide
gtgccgtctcccgtggccctcccccgacgtattgc

SEQ ID NO: 188922 - DNA, 35 bp, Artificial Sequence
  Synthetic oligonucleotide
gaaccatgcaccttgccgcccgaacccttcggatc

SEQ ID NO: 188923 - DNA, 35 bp, Artificial Sequence
  Synthetic oligonucleotide
gtccgaccctccgctgcatcgatcgcttccctatc

SEQ ID NO: 188924 - DNA, 35 bp, Artificial Sequence
  Synthetic oligonucleotide
actgtcggaccgactgttctaattccggttacctc

SEQ ID NO: 188925 - DNA, 35 bp, Artificial Sequence
  Synthetic oligonucleotide
tagcctcccccaattgccaccggactccttccgtc

SEQ ID NO: 188926 - DNA, 35 bp, Artificial Sequence
  Synthetic oligonucleotide
tcgccctcagtgtaagttccccttttgtcccggtc

SEQ ID NO: 188927 - DNA, 35 bp, Artificial Sequence
  Synthetic oligonucleotide
ttgtaggttagtcatccccgttcgctgcccttgtc

SEQ ID NO: 188928 - DNA, 35 bp, Artificial Sequence
  Synthetic oligonucleotide
tcaccagggcctgcgaacgtcgcaaattcaccttc

SEQ ID NO: 188929 - DNA, 35 bp, Artificial Sequence
  Synthetic oligonucleotide
gctgctcggtcccttgtagtactctccaccgcttc

SEQ ID NO: 188930 - DNA, 35 bp, Artificial Sequence
  Synthetic oligonucleotide
aatgtccacgctgccctatccccacttgttcgttc

SEQ ID NO: 188931 - DNA, 35 bp, Artificial Sequence
  Synthetic oligonucleotide
gtgagccgtatcgtacccatctgcaataccatttc

SEQ ID NO: 188932 - DNA, 35 bp, Artificial Sequence
  Synthetic oligonucleotide
tcccgcacaccggtttttccgctccttctcatttc

SEQ ID NO: 188933 - DNA, 35 bp, Artificial Sequence
  Synthetic oligonucleotide
tgcacgcacgtgcttttcgtaacactccggcccag

SEQ ID NO: 188934 - DNA, 35 bp, Artificial Sequence
  Synthetic oligonucleotide
aaaccccctcacctctgaattcgtgcgctaactag

SEQ ID NO: 188935 - DNA, 35 bp, Artificial Sequence
  Synthetic oligonucleotide
aaacaggaggggtcatacgatcggggagggggacg

SEQ ID NO: 188936 - DNA, 35 bp, Artificial Sequence
  Synthetic oligonucleotide
acgccgggtcacacccattgatttagcaccccccg

SEQ ID NO: 188937 - DNA, 35 bp, Artificial Sequence
  Synthetic oligonucleotide
tcgctaacctacggctcattgcattttgtcccccg

SEQ ID NO: 188938 - DNA, 35 bp, Artificial Sequence
  Synthetic oligonucleotide
attgcgcgctgcccccgtcctattctttttctccg

SEQ ID NO: 188939 - DNA, 35 bp, Artificial Sequence
  Synthetic oligonucleotide
aatcgcgcaacactcaccggaccctccttacagcg

SEQ ID NO: 188940 - DNA, 35 bp, Artificial Sequence
  Synthetic oligonucleotide
ggtcgtagccctcatcacttgcctcccatttggcg

SEQ ID NO: 188941 - DNA, 35 bp, Artificial Sequence
  Synthetic oligonucleotide
gctgacgccttcacattagcgctcccctcgtgagg

SEQ ID NO: 188942 - DNA, 35 bp, Artificial Sequence
  Synthetic oligonucleotide
tgatcgtgagtggaggtgggggggcatgctaaggg

SEQ ID NO: 188943 - DNA, 35 bp, Artificial Sequence
  Synthetic oligonucleotide
ttggtgaggacaaaaatgagaggggtgggtaaggg

SEQ ID NO: 188944 - DNA, 35 bp, Artificial Sequence
  Synthetic oligonucleotide
gcaggtcatactggtttggtcccattctccttctg

SEQ ID NO: 188945 - DNA, 35 bp, Artificial Sequence
  Synthetic oligonucleotide
gtgctcagcgcattttcccacgttcatccgcgttg

SEQ ID NO: 188946 - DNA, 35 bp, Artificial Sequence
  Synthetic oligonucleotide
atcactcagctgggctcactcctgctttcataaat

SEQ ID NO: 188947 - DNA, 35 bp, Artificial Sequence
  Synthetic oligonucleotide
actatgcccccctgtgctctcttgatatcgctcat

SEQ ID NO: 188948 - DNA, 35 bp, Artificial Sequence
  Synthetic oligonucleotide
gagcccatctctggtagcattacaccgctctatat

SEQ ID NO: 188949 - DNA, 35 bp, Artificial Sequence
  Synthetic oligonucleotide
ggatgagcatcaccccactagtattcgcctgccct

SEQ ID NO: 188950 - DNA, 35 bp, Artificial Sequence
  Synthetic oligonucleotide
ttgcccctttcgagttgcacgacctggtttcgcct

SEQ ID NO: 188951 - DNA, 35 bp, Artificial Sequence
  Synthetic oligonucleotide
tctatgcgatcccgttttacgcgccactctgtcct

SEQ ID NO: 188952 - DNA, 34 bp, Artificial Sequence
  Synthetic oligonucleotide
acggtcgacaggggcggagatagagggggtcagt

SEQ ID NO: 188953 - DNA, 35 bp, Artificial Sequence
  Synthetic oligonucleotide
tcacagcacagcttcctcccgcacgccctagtagt

SEQ ID NO: 188954 - DNA, 35 bp, Artificial Sequence
  Synthetic oligonucleotide
gtcaaccaccatcttctgaagttcccgcccctcgt

SEQ ID NO: 188955 - DNA, 35 bp, Artificial Sequence
  Synthetic oligonucleotide
tcccacaccggtgcataccatccccacactagggt

SEQ ID NO: 188956 - DNA, 35 bp, Artificial Sequence
  Synthetic oligonucleotide
atgtccttgtccgtttcgagtcctgtccaccatgt

SEQ ID NO: 188957 - DNA, 35 bp, Artificial Sequence
  Synthetic oligonucleotide
tttcacgcctgtgcttcgccttgccttttaattgt

SEQ ID NO: 188958 - DNA, 35 bp, Artificial Sequence
  Synthetic oligonucleotide
gccaccatcatccatccttgcgtaagcagttgatt

SEQ ID NO: 188959 - DNA, 35 bp, Artificial Sequence
  Synthetic oligonucleotide
gcctatgcctccgttgtctgggcactgctccactt

SEQ ID NO: 188960 - DNA, 35 bp, Artificial Sequence
  Synthetic oligonucleotide
gacggggccgggtgaggcaacgagagggggagctt

SEQ ID NO: 188961 - DNA, 35 bp, Artificial Sequence
  Synthetic oligonucleotide
gcccacagtgcggtatcgtcccagttctgcctctt

SEQ ID NO: 188962 - DNA, 35 bp, Artificial Sequence
  Synthetic oligonucleotide
ttgcaccgcaatcggaccacctcgcctttcctgtt

SEQ ID NO: 188963 - DNA, 35 bp, Artificial Sequence
  Synthetic oligonucleotide
gaagccatcagctcactagcgccacacctctgttt

SEQ ID NO: 188964 - DNA, 36 bp, Artificial Sequence
  Synthetic oligonucleotide
gttgcatcctgagctgccctcgcctatacttggaaa

SEQ ID NO: 188965 - DNA, 36 bp, Artificial Sequence
  Synthetic oligonucleotide
tgtccacacgccatgccagcccatatagcccctaaa

SEQ ID NO: 188966 - DNA, 35 bp, Artificial Sequence
  Synthetic oligonucleotide
gggagggacgggtgaataagcttactcgggcacaa

SEQ ID NO: 188967 - DNA, 36 bp, Artificial Sequence
  Synthetic oligonucleotide
tgaatcctccgaagctgcccgtgctaccattgccaa

SEQ ID NO: 188968 - DNA, 36 bp, Artificial Sequence
  Synthetic oligonucleotide
tgtgaatcgccttttgtcctatccctgtgcacgcaa

SEQ ID NO: 188969 - DNA, 36 bp, Artificial Sequence
  Synthetic oligonucleotide
gccgtcgccccgttgcaatattctgtgtctcctcaa

SEQ ID NO: 188970 - DNA, 36 bp, Artificial Sequence
  Synthetic oligonucleotide
gttaaaggggagggagagaatcaggagacggaataa

SEQ ID NO: 188971 - DNA, 36 bp, Artificial Sequence
  Synthetic oligonucleotide
tacatcatcctgtgccgcctttatttactgccttaa

SEQ ID NO: 188972 - DNA, 35 bp, Artificial Sequence
  Synthetic oligonucleotide
taggcccttccgacgcccccctatgctccttttaa

SEQ ID NO: 188973 - DNA, 36 bp, Artificial Sequence
  Synthetic oligonucleotide
accgtcctcgccaattcactgataacatccagcaca

SEQ ID NO: 188974 - DNA, 35 bp, Artificial Sequence
  Synthetic oligonucleotide
acatctacctgtccaatccgatattagtcttacca

SEQ ID NO: 188975 - DNA, 36 bp, Artificial Sequence
  Synthetic oligonucleotide
tcgcaacccacagaagtttttgccccacgcccccca

SEQ ID NO: 188976 - DNA, 36 bp, Artificial Sequence
  Synthetic oligonucleotide
gccggatacgtcgtgacgtctcgctccttttgccca

SEQ ID NO: 188977 - DNA, 35 bp, Artificial Sequence
  Synthetic oligonucleotide
gtcctgcccccgtctcatgtagtgctatactccca

SEQ ID NO: 188978 - DNA, 35 bp, Artificial Sequence
  Synthetic oligonucleotide
tcccgccacatttgcgctcgaatgaaccgccgcca

SEQ ID NO: 188979 - DNA, 35 bp, Artificial Sequence
  Synthetic oligonucleotide
agggggggagggaggacgcgctaggaccaggggca

SEQ ID NO: 188980 - DNA, 36 bp, Artificial Sequence
  Synthetic oligonucleotide
gtccatcctctgcctgcccttaacgtctaccgttca

SEQ ID NO: 188981 - DNA, 36 bp, Artificial Sequence
  Synthetic oligonucleotide
atccgttgcgctgactctataccatgctccttttca

SEQ ID NO: 188982 - DNA, 37 bp, Artificial Sequence
  Synthetic oligonucleotide
gtcctccccctccgccattttctgcccgtctctgaga

SEQ ID NO: 188983 - DNA, 36 bp, Artificial Sequence
  Synthetic oligonucleotide
gactccgctttccattgcacatcatgattctgacga

SEQ ID NO: 188984 - DNA, 37 bp, Artificial Sequence
  Synthetic oligonucleotide
tcagctcacgcgtggtttcagccactcttcctcccga

SEQ ID NO: 188985 - DNA, 36 bp, Artificial Sequence
  Synthetic oligonucleotide
ttcagccgaacgccccaccgatcgtccattctccga

SEQ ID NO: 188986 - DNA, 37 bp, Artificial Sequence
  Synthetic oligonucleotide
gcgaggcgtggtgggtaaccggggaagagtggagcga

SEQ ID NO: 188987 - DNA, 37 bp, Artificial Sequence
  Synthetic oligonucleotide
tcacgctcctgttttttgctatgttgtcctcctgcga

SEQ ID NO: 188988 - DNA, 35 bp, Artificial Sequence
  Synthetic oligonucleotide
tccatcgcaactggcaccttcactttattgttcga

SEQ ID NO: 188989 - DNA, 36 bp, Artificial Sequence
  Synthetic oligonucleotide
ggaagaggaacggggtggtcgaacgggggctcagga

SEQ ID NO: 188990 - DNA, 36 bp, Artificial Sequence
  Synthetic oligonucleotide
ggggtgggcgcatgtcataatatagtgaaagaggga

SEQ ID NO: 188991 - DNA, 37 bp, Artificial Sequence
  Synthetic oligonucleotide
tccactcagctgggagggtgggagtaggacggaggga

SEQ ID NO: 188992 - DNA, 37 bp, Artificial Sequence
  Synthetic oligonucleotide
atgctacggaataaggaggggggctgggtggagggga

SEQ ID NO: 188993 - DNA, 37 bp, Artificial Sequence
  Synthetic oligonucleotide
gactggaaccccgatggggagagagggggggatggga

SEQ ID NO: 188994 - DNA, 36 bp, Artificial Sequence
  Synthetic oligonucleotide
gatccgccccacttacgcctagccctcacctctgga

SEQ ID NO: 188995 - DNA, 37 bp, Artificial Sequence
  Synthetic oligonucleotide
gtgagggctcagggagagtgaaggataatggggtgga

SEQ ID NO: 188996 - DNA, 37 bp, Artificial Sequence
  Synthetic oligonucleotide
atctcggagggaggaacgagggacggggtagtttgga

SEQ ID NO: 188997 - DNA, 37 bp, Artificial Sequence
  Synthetic oligonucleotide
tctccatccatctgcctccttgactctgcatacatga

SEQ ID NO: 188998 - DNA, 37 bp, Artificial Sequence
  Synthetic oligonucleotide
acagggtccagccgtgccttccccttcacttttatga

SEQ ID NO: 188999 - DNA, 38 bp, Artificial Sequence
  Synthetic oligonucleotide
gagccccccagaggtgtctatttccctcccggccctga

SEQ ID NO: 189000 - DNA, 38 bp, Artificial Sequence
  Synthetic oligonucleotide
agggcgggagtaagggcaagggagctgagcgagggtga

SEQ ID NO: 189001 - DNA, 38 bp, Artificial Sequence
  Synthetic oligonucleotide
acacacgcttaggcatgcgctcccttgcccgcccttga

SEQ ID NO: 189002 - DNA, 38 bp, Artificial Sequence
  Synthetic oligonucleotide
gcttcgccactgtacacaccattcttgcactcccttga

SEQ ID NO: 189003 - DNA, 38 bp, Artificial Sequence
  Synthetic oligonucleotide
gtccaccgccggctcccccccggccctcatttccttga

SEQ ID NO: 189004 - DNA, 38 bp, Artificial Sequence
  Synthetic oligonucleotide
actgaaccccccgccgtgcccctgtagtctagtcttga

SEQ ID NO: 189005 - DNA, 38 bp, Artificial Sequence
  Synthetic oligonucleotide
gtggagcccgccgccaccgctactgtcctacctgttga

SEQ ID NO: 189006 - DNA, 38 bp, Artificial Sequence
  Synthetic oligonucleotide
ttccagcccacggttcgcccgtcccaccgccctgttga

SEQ ID NO: 189007 - DNA, 38 bp, Artificial Sequence
  Synthetic oligonucleotide
tccgtccggacctcactgcttacaatgacccactttga

SEQ ID NO: 189008 - DNA, 38 bp, Artificial Sequence
  Synthetic oligonucleotide
ttgacccaccctcgggttggattaacccttcactttga

SEQ ID NO: 189009 - DNA, 38 bp, Artificial Sequence
  Synthetic oligonucleotide
tctgccccatctacttctcgcctcgcaggacagtttga

SEQ ID NO: 189010 - DNA, 35 bp, Artificial Sequence
  Synthetic oligonucleotide
tgcgctcgccttgcgcaatagcttgaccccccata

SEQ ID NO: 189011 - DNA, 36 bp, Artificial Sequence
  Synthetic oligonucleotide
gaagtgggcgggagggaacttgatggcagtaggata

SEQ ID NO: 189012 - DNA, 36 bp, Artificial Sequence
  Synthetic oligonucleotide
ttgggcctgccccagacagcccttcccgccactata

SEQ ID NO: 189013 - DNA, 36 bp, Artificial Sequence
  Synthetic oligonucleotide
accccgccacttgcgtctcatttggtcgccgcacta

SEQ ID NO: 189014 - DNA, 36 bp, Artificial Sequence
  Synthetic oligonucleotide
tccgaccgaccacaagtataatgtctgccttcccta

SEQ ID NO: 189015 - DNA, 36 bp, Artificial Sequence
  Synthetic oligonucleotide
tacgatccctgctttgctcccggtctaatgctccta

SEQ ID NO: 189016 - DNA, 36 bp, Artificial Sequence
  Synthetic oligonucleotide
gagttagccccacccgtccatgagctgtcatgtcta

SEQ ID NO: 189017 - DNA, 35 bp, Artificial Sequence
  Synthetic oligonucleotide
gaaccctacctgcttaccggctgtactacatagta

SEQ ID NO: 189018 - DNA, 36 bp, Artificial Sequence
  Synthetic oligonucleotide
atcccgtcacgccgaccctctaagtatcttcccgta

SEQ ID NO: 189019 - DNA, 36 bp, Artificial Sequence
  Synthetic oligonucleotide
agaatggaagtggtgcgagggcgaaggggagtggta

SEQ ID NO: 189020 - DNA, 35 bp, Artificial Sequence
  Synthetic oligonucleotide
acccaccacgggccgggcttctatctcacccatta

SEQ ID NO: 189021 - DNA, 36 bp, Artificial Sequence
  Synthetic oligonucleotide
gttgccccacatgctatggtcccccgttccgattta

SEQ ID NO: 189022 - DNA, 35 bp, Artificial Sequence
  Synthetic oligonucleotide
gacgcacctcatccgtccgcatccgtacacaccac

SEQ ID NO: 189023 - DNA, 35 bp, Artificial Sequence
  Synthetic oligonucleotide
accaactctcgatccggtcccaccacggtgaccac

SEQ ID NO: 189024 - DNA, 35 bp, Artificial Sequence
  Synthetic oligonucleotide
ttacccggccattcagacttccgcattctgtccac

SEQ ID NO: 189025 - DNA, 35 bp, Artificial Sequence
  Synthetic oligonucleotide
tacattcgccctcccagtgctcatagctgatttac

SEQ ID NO: 189026 - DNA, 35 bp, Artificial Sequence
  Synthetic oligonucleotide
gccgacctgagctatagtagctctgagcctccacc

SEQ ID NO: 189027 - DNA, 35 bp, Artificial Sequence
  Synthetic oligonucleotide
gcaacccgcctccctttaacgcggatcatgagacc

SEQ ID NO: 189028 - DNA, 35 bp, Artificial Sequence
  Synthetic oligonucleotide
tgacctgtgcggcaaagcttccctggttatctccc

SEQ ID NO: 189029 - DNA, 35 bp, Artificial Sequence
  Synthetic oligonucleotide
gcattgcccccccgcagacacatggttactttccc

SEQ ID NO: 189030 - DNA, 35 bp, Artificial Sequence
  Synthetic oligonucleotide
tgacccttagggatcgatagctccgccccctcgcc

SEQ ID NO: 189031 - DNA, 35 bp, Artificial Sequence
  Synthetic oligonucleotide
aggtcgccccatgcccaagacaacgcccgctctcc

SEQ ID NO: 189032 - DNA, 35 bp, Artificial Sequence
  Synthetic oligonucleotide
ggagcccacaagagcgcactctgactccaccttcc

SEQ ID NO: 189033 - DNA, 35 bp, Artificial Sequence
  Synthetic oligonucleotide
acgaccctcagcaaggtctccgagctacacgttcc

SEQ ID NO: 189034 - DNA, 35 bp, Artificial Sequence
  Synthetic oligonucleotide
aggtgctcgccgccctggccacacatgtacgttcc

SEQ ID NO: 189035 - DNA, 35 bp, Artificial Sequence
  Synthetic oligonucleotide
gcatcctcaagagagttgtcgccgtcctcttttcc

SEQ ID NO: 189036 - DNA, 35 bp, Artificial Sequence
  Synthetic oligonucleotide
tcagcggctaccacacacctcttgcccctccgcgc

SEQ ID NO: 189037 - DNA, 35 bp, Artificial Sequence
  Synthetic oligonucleotide
gtctactccccgctttgtttcttgaggactctggc

SEQ ID NO: 189038 - DNA, 35 bp, Artificial Sequence
  Synthetic oligonucleotide
gggtaccgtagtacgcctcccttctgctttgctgc

SEQ ID NO: 189039 - DNA, 35 bp, Artificial Sequence
  Synthetic oligonucleotide
tccacgttcgctccaactattacagctatgcttgc

SEQ ID NO: 189040 - DNA, 35 bp, Artificial Sequence
  Synthetic oligonucleotide
tctcgagataacgttctcgattctatttgtccctc

SEQ ID NO: 189041 - DNA, 35 bp, Artificial Sequence
  Synthetic oligonucleotide
gtcattgatgccggctacgtatccgtccacctctc

SEQ ID NO: 189042 - DNA, 35 bp, Artificial Sequence
  Synthetic oligonucleotide
tcaccagccaccgatacggctattgttctcctctc

SEQ ID NO: 189043 - DNA, 35 bp, Artificial Sequence
  Synthetic oligonucleotide
atgcctgtgccacccgacgccgtaccagacttctc

SEQ ID NO: 189044 - DNA, 35 bp, Artificial Sequence
  Synthetic oligonucleotide
tgacatccgtccgcagcccacgcctcactgccgtc

SEQ ID NO: 189045 - DNA, 34 bp, Artificial Sequence
  Synthetic oligonucleotide
gcttatcccggactgtcaccttgcgccactggtc

SEQ ID NO: 189046 - DNA, 35 bp, Artificial Sequence
  Synthetic oligonucleotide
gcctgcccttacgctgctatcagtctacagtcttc

SEQ ID NO: 189047 - DNA, 35 bp, Artificial Sequence
  Synthetic oligonucleotide
gtcccgtctcgctgctttccataatctccgtgttc

SEQ ID NO: 189048 - DNA, 35 bp, Artificial Sequence
  Synthetic oligonucleotide
gaaccgcccattggcattcatcttcctttgctttc

SEQ ID NO: 189049 - DNA, 35 bp, Artificial Sequence
  Synthetic oligonucleotide
agagggagtgggcagaagcaggataaatggggtag

SEQ ID NO: 189050 - DNA, 35 bp, Artificial Sequence
  Synthetic oligonucleotide
ggatcccccttcgctctttcttagattagctcccg

SEQ ID NO: 189051 - DNA, 35 bp, Artificial Sequence
  Synthetic oligonucleotide
tacgttaagcctgcagctgcccccgatcctatccg

SEQ ID NO: 189052 - DNA, 35 bp, Artificial Sequence
  Synthetic oligonucleotide
gtcactcgcagtattatcacacattcccttaggcg

SEQ ID NO: 189053 - DNA, 35 bp, Artificial Sequence
  Synthetic oligonucleotide
accggactacgggtgggtaggggatagatggggcg

SEQ ID NO: 189054 - DNA, 35 bp, Artificial Sequence
  Synthetic oligonucleotide
agactgggggcggaggtgggacggggagcgctgcg

SEQ ID NO: 189055 - DNA, 35 bp, Artificial Sequence
  Synthetic oligonucleotide
gcagacaatccccctcgcctacggtccatctccgg

SEQ ID NO: 189056 - DNA, 35 bp, Artificial Sequence
  Synthetic oligonucleotide
gcgaccacctcaatatgtctcctccacctaccggg

SEQ ID NO: 189057 - DNA, 35 bp, Artificial Sequence
  Synthetic oligonucleotide
gacgagggggacggccataggatcggaaattgatg

SEQ ID NO: 189058 - DNA, 35 bp, Artificial Sequence
  Synthetic oligonucleotide
gcacatcacatcctctctaacagcctggcgaactg

SEQ ID NO: 189059 - DNA, 35 bp, Artificial Sequence
  Synthetic oligonucleotide
ggagttagatgcgccgtcgcctcccgcccctagtg

SEQ ID NO: 189060 - DNA, 35 bp, Artificial Sequence
  Synthetic oligonucleotide
gcatgccgcccactccgtccagtcatatagttcat

SEQ ID NO: 189061 - DNA, 35 bp, Artificial Sequence
  Synthetic oligonucleotide
agagatgcgagggaaggtggggattgggggacgat

SEQ ID NO: 189062 - DNA, 35 bp, Artificial Sequence
  Synthetic oligonucleotide
cacgtcgcccggtcgcaattagcccagttttacct

SEQ ID NO: 189063 - DNA, 35 bp, Artificial Sequence
  Synthetic oligonucleotide
tccgacgcgctttgtctcttggtccactcccgcct

SEQ ID NO: 189064 - DNA, 35 bp, Artificial Sequence
  Synthetic oligonucleotide
gacatatcacattgtcctcaggttacccatcgcct

SEQ ID NO: 189065 - DNA, 35 bp, Artificial Sequence
  Synthetic oligonucleotide
atccccacgatccgtctgccagccactgacctcct

SEQ ID NO: 189066 - DNA, 35 bp, Artificial Sequence
  Synthetic oligonucleotide
aacgccgcattagttgcgctcttctatgctttcct

SEQ ID NO: 189067 - DNA, 35 bp, Artificial Sequence
  Synthetic oligonucleotide
gtcgaacttcaatggcccttcctgcatagcactct

SEQ ID NO: 189068 - DNA, 35 bp, Artificial Sequence
  Synthetic oligonucleotide
gcgatcgaccctccgctcccatccttaagacttct

SEQ ID NO: 189069 - DNA, 35 bp, Artificial Sequence
  Synthetic oligonucleotide
tcgacccttcccagccgcccctaagttgcccttct

SEQ ID NO: 189070 - DNA, 35 bp, Artificial Sequence
  Synthetic oligonucleotide
tccgatgcacacattgttgccctcttgcctcttct

SEQ ID NO: 189071 - DNA, 35 bp, Artificial Sequence
  Synthetic oligonucleotide
aatgcctacgcccccgtgttcacgcatacatttct

SEQ ID NO: 189072 - DNA, 35 bp, Artificial Sequence
  Synthetic oligonucleotide
atgcgagttgcaaataaaggaaggggggatggagt

SEQ ID NO: 189073 - DNA, 33 bp, Artificial Sequence
  Synthetic oligonucleotide
gcccgtacctcccccatgcgagagatccctggt

SEQ ID NO: 189074 - DNA, 35 bp, Artificial Sequence
  Synthetic oligonucleotide
tacatcctcagtaacccgccatgttttgcaccatt

SEQ ID NO: 189075 - DNA, 35 bp, Artificial Sequence
  Synthetic oligonucleotide
gttgcatcgcgactgtttcttggtcactttccttt

SEQ ID NO: 189076 - DNA, 35 bp, Artificial Sequence
  Synthetic oligonucleotide
atttccgcaaatgccgaccgcccctctctcggttt

SEQ ID NO: 189077 - DNA, 35 bp, Artificial Sequence
  Synthetic oligonucleotide
tgcattccctgttctgcctagctctgaaaattttt

SEQ ID NO: 189078 - DNA, 36 bp, Artificial Sequence
  Synthetic oligonucleotide
gccgccatccataccctgcctttcccccgtgtgaaa

SEQ ID NO: 189079 - DNA, 36 bp, Artificial Sequence
  Synthetic oligonucleotide
acaggagtggacggcggggggagcgctggaattaaa

SEQ ID NO: 189080 - DNA, 36 bp, Artificial Sequence
  Synthetic oligonucleotide
gacgcactagcccccgcacccatggcttccgcacaa

SEQ ID NO: 189081 - DNA, 36 bp, Artificial Sequence
  Synthetic oligonucleotide
ggaggggggagaggggggggtgggagtagggtgcaa

SEQ ID NO: 189082 - DNA, 36 bp, Artificial Sequence
  Synthetic oligonucleotide
gagcgagaaggagggaaataaatgacggggggtcaa

SEQ ID NO: 189083 - DNA, 36 bp, Artificial Sequence
  Synthetic oligonucleotide
tcgaagtgtcctgagcgtccggctttccctgttcaa

SEQ ID NO: 189084 - DNA, 36 bp, Artificial Sequence
  Synthetic oligonucleotide
acgctagcccacccatttctgcatgccactccggaa

SEQ ID NO: 189085 - DNA, 36 bp, Artificial Sequence
  Synthetic oligonucleotide
ggatcagcctgagggattattaggggcgggtgggaa

SEQ ID NO: 189086 - DNA, 36 bp, Artificial Sequence
  Synthetic oligonucleotide
tccccccctgcctgacccctgactacagctaactaa

SEQ ID NO: 189087 - DNA, 35 bp, Artificial Sequence
  Synthetic oligonucleotide
gagagagggaagggtcgggcgaattggcagtgtaa

SEQ ID NO: 189088 - DNA, 35 bp, Artificial Sequence
  Synthetic oligonucleotide
tgttacccggctccttgtgcacctacctcctttaa

SEQ ID NO: 189089 - DNA, 35 bp, Artificial Sequence
  Synthetic oligonucleotide
tcccaccatacactgtgactctccgaattcgcaca

SEQ ID NO: 189090 - DNA, 35 bp, Artificial Sequence
  Synthetic oligonucleotide
atacccccgcctgctcttttccatgtagtggcaca

SEQ ID NO: 189091 - DNA, 35 bp, Artificial Sequence
  Synthetic oligonucleotide
ttccgtgccccaccggttgcatgttatgcacccca

SEQ ID NO: 189092 - DNA, 36 bp, Artificial Sequence
  Synthetic oligonucleotide
atgatcctctgctgggcgttcccgtaacatccccca

SEQ ID NO: 189093 - DNA, 35 bp, Artificial Sequence
  Synthetic oligonucleotide
gtcgccatggagtgtctcgcctgctactaccgcca

SEQ ID NO: 189094 - DNA, 36 bp, Artificial Sequence
  Synthetic oligonucleotide
aatgttgccacactcgttcataaccccacggctcca

SEQ ID NO: 189095 - DNA, 36 bp, Artificial Sequence
  Synthetic oligonucleotide
tgaatcgccattgtccccctcgtagtacgcccagca

SEQ ID NO: 189096 - DNA, 36 bp, Artificial Sequence
  Synthetic oligonucleotide
tgcaacatcacattttgctttatgttctccaccgca

SEQ ID NO: 189097 - DNA, 36 bp, Artificial Sequence
  Synthetic oligonucleotide
aacgactcgaggaaagtaagggaggaacgaggcgca

SEQ ID NO: 189098 - DNA, 36 bp, Artificial Sequence
  Synthetic oligonucleotide
gtgacgcggtcagaagtccacccccctatgctcgca

SEQ ID NO: 189099 - DNA, 36 bp, Artificial Sequence
  Synthetic oligonucleotide
ttctccccgcctcatcgtccctgatcctagttcgca

SEQ ID NO: 189100 - DNA, 35 bp, Artificial Sequence
  Synthetic oligonucleotide
gtccaactccgcctgatcctacgcttaccatggca

SEQ ID NO: 189101 - DNA, 36 bp, Artificial Sequence
  Synthetic oligonucleotide
gactctcccgctcccatgcccctcgtgtgcaatgca

SEQ ID NO: 189102 - DNA, 36 bp, Artificial Sequence
  Synthetic oligonucleotide
gcacatcagagtaacatgtcttctggccctcttgca

SEQ ID NO: 189103 - DNA, 34 bp, Artificial Sequence
  Synthetic oligonucleotide
attgtcccatcacgccgtcttgcctcccgttgca

SEQ ID NO: 189104 - DNA, 36 bp, Artificial Sequence
  Synthetic oligonucleotide
gttgcatacctcagtgcattcagtttcccctcctca

SEQ ID NO: 189105 - DNA, 35 bp, Artificial Sequence
  Synthetic oligonucleotide
tcatctcatccagccgccctgcactttcttggtca

SEQ ID NO: 189106 - DNA, 35 bp, Artificial Sequence
  Synthetic oligonucleotide
agtggaaacagggcggagggcagcagggaaattca

SEQ ID NO: 189107 - DNA, 37 bp, Artificial Sequence
  Synthetic oligonucleotide
taccaacggccagggggcgaaatgagggggggtaaga

SEQ ID NO: 189108 - DNA, 37 bp, Artificial Sequence
  Synthetic oligonucleotide
tcgatattgtcccatcctaaagcccccgtcttccaga

SEQ ID NO: 189109 - DNA, 37 bp, Artificial Sequence
  Synthetic oligonucleotide
gtcgctccccgcctctgcgctatgacgcttcctgaga

SEQ ID NO: 189110 - DNA, 37 bp, Artificial Sequence
  Synthetic oligonucleotide
ttggccctccatctgctactgtgctgctccagctaga

SEQ ID NO: 189111 - DNA, 37 bp, Artificial Sequence
  Synthetic oligonucleotide
tagtgtaggggaggattgcaggaggtacgggcaacga

SEQ ID NO: 189112 - DNA, 37 bp, Artificial Sequence
  Synthetic oligonucleotide
tagccacccccccgtcaattagtttacaccagcgcga

SEQ ID NO: 189113 - DNA, 37 bp, Artificial Sequence
  Synthetic oligonucleotide
gcgcgtatgatcctgccttaatccaccccccatgcga

SEQ ID NO: 189114 - DNA, 37 bp, Artificial Sequence
  Synthetic oligonucleotide
tgcggctcgcctcgttccactgtaacactcccctcga

SEQ ID NO: 189115 - DNA, 37 bp, Artificial Sequence
  Synthetic oligonucleotide
gaagggagtggtgtctaggtagcaggggggggtagga

SEQ ID NO: 189116 - DNA, 37 bp, Artificial Sequence
  Synthetic oligonucleotide
gtgaggagagggggaactagtggattttaggggcgga

SEQ ID NO: 189117 - DNA, 37 bp, Artificial Sequence
  Synthetic oligonucleotide
gccctcccgtatatattgcgccccctccccactcgga

SEQ ID NO: 189118 - DNA, 37 bp, Artificial Sequence
  Synthetic oligonucleotide
gattgccccatcctgcaccgcaacttgacctccggga

SEQ ID NO: 189119 - DNA, 36 bp, Artificial Sequence
  Synthetic oligonucleotide
gtaccaccctgtgaccgccatccagtccctccggga

SEQ ID NO: 189120 - DNA, 34 bp, Artificial Sequence
  Synthetic oligonucleotide
gggagggaactagcatggtagtaaggggggggga

SEQ ID NO: 189121 - DNA, 36 bp, Artificial Sequence
  Synthetic oligonucleotide
gaaggttacgagcgtgaaagcggggagtggggggga

SEQ ID NO: 189122 - DNA, 37 bp, Artificial Sequence
  Synthetic oligonucleotide
ggggtacgtcctggggtcataaatttcgggtggggga

SEQ ID NO: 189123 - DNA, 37 bp, Artificial Sequence
  Synthetic oligonucleotide
gatggtgtggaaggcggggatggtgcagggaggtgga

SEQ ID NO: 189124 - DNA, 37 bp, Artificial Sequence
  Synthetic oligonucleotide
aaggcaaggggtgggtggtgggtcaaggttgggtgga

SEQ ID NO: 189125 - DNA, 38 bp, Artificial Sequence
  Synthetic oligonucleotide
gtcccagcccacactatcatgtactgctctatcaatga

SEQ ID NO: 189126 - DNA, 37 bp, Artificial Sequence
  Synthetic oligonucleotide
tcccgacgtatccgccgtctatttactacacacatga

SEQ ID NO: 189127 - DNA, 36 bp, Artificial Sequence
  Synthetic oligonucleotide
gtaccaccaccacttgttatgcactttatacgatga

SEQ ID NO: 189128 - DNA, 37 bp, Artificial Sequence
  Synthetic oligonucleotide
gttgctcgccgactcgccccatcctctagtcctatga

SEQ ID NO: 189129 - DNA, 38 bp, Artificial Sequence
  Synthetic oligonucleotide
aatgacgcccccgttgcctctctcgacttccgaactga

SEQ ID NO: 189130 - DNA, 38 bp, Artificial Sequence
  Synthetic oligonucleotide
acactgcccctcgtatgccgcgttacacgtttcactga

SEQ ID NO: 189131 - DNA, 38 bp, Artificial Sequence
  Synthetic oligonucleotide
tgcggtggagaggggtggaatggaatgtagacgactga

SEQ ID NO: 189132 - DNA, 38 bp, Artificial Sequence
  Synthetic oligonucleotide
gtgtcgcacctcctatatgctttgagtatctatcctga

SEQ ID NO: 189133 - DNA, 38 bp, Artificial Sequence
  Synthetic oligonucleotide
ttccccacagtatgcttatgggcccttctctctcctga

SEQ ID NO: 189134 - DNA, 38 bp, Artificial Sequence
  Synthetic oligonucleotide
tgacttgtgtagccccgtgcctccgtcgaccttcctga

SEQ ID NO: 189135 - DNA, 37 bp, Artificial Sequence
  Synthetic oligonucleotide
tcgccggtcgccttttccatcactctcagcgggctga

SEQ ID NO: 189136 - DNA, 38 bp, Artificial Sequence
  Synthetic oligonucleotide
gaagggtaggggccaatggggggggaagtacgtgctga

SEQ ID NO: 189137 - DNA, 36 bp, Artificial Sequence
  Synthetic oligonucleotide
tccccatccactcacgaccagaggctccccttctga

SEQ ID NO: 189138 - DNA, 38 bp, Artificial Sequence
  Synthetic oligonucleotide
atgtatgtgacatggggattggagagggagggacgtga

SEQ ID NO: 189139 - DNA, 38 bp, Artificial Sequence
  Synthetic oligonucleotide
gtccacccctaatgtctcattctcgattcactcggtga

SEQ ID NO: 189140 - DNA, 38 bp, Artificial Sequence
  Synthetic oligonucleotide
agatgggggaaggtgggcacatcagggagacgtggtga

SEQ ID NO: 189141 - DNA, 38 bp, Artificial Sequence
  Synthetic oligonucleotide
ggatcgggaaggtggggcgaacgagagggtgacgttga

SEQ ID NO: 189142 - DNA, 37 bp, Artificial Sequence
  Synthetic oligonucleotide
gctcgcctctccccctactgagccatcttttcgttga

SEQ ID NO: 189143 - DNA, 36 bp, Artificial Sequence
  Synthetic oligonucleotide
gtgtgcattaatgtttttacgcccgccccttccata

SEQ ID NO: 189144 - DNA, 35 bp, Artificial Sequence
  Synthetic oligonucleotide
gttctcctccagctctgtttacatccatctctata

SEQ ID NO: 189145 - DNA, 34 bp, Artificial Sequence
  Synthetic oligonucleotide
aagggagggggggggtgactcgggacgcggacta

SEQ ID NO: 189146 - DNA, 35 bp, Artificial Sequence
  Synthetic oligonucleotide
gagctcagccaacctgccccctttatctcgcccta

SEQ ID NO: 189147 - DNA, 36 bp, Artificial Sequence
  Synthetic oligonucleotide
gatgcctcagcgccgctttctgtctttcctgcagta

SEQ ID NO: 189148 - DNA, 36 bp, Artificial Sequence
  Synthetic oligonucleotide
accatcccaccgacatctgctggcctttttccggta

SEQ ID NO: 189149 - DNA, 35 bp, Artificial Sequence
  Synthetic oligonucleotide
agcacccgccccctgccctggaaacattgtcggta

SEQ ID NO: 189150 - DNA, 35 bp, Artificial Sequence
  Synthetic oligonucleotide
gggtagagaaggcatgggcggggatggagagggta

SEQ ID NO: 189151 - DNA, 33 bp, Artificial Sequence
  Synthetic oligonucleotide
tgcgcctccgcccacgtttcgaacatcgttgta

SEQ ID NO: 189152 - DNA, 36 bp, Artificial Sequence
  Synthetic oligonucleotide
aacacccgttcgtatggtcttgccctcacttactta

SEQ ID NO: 189153 - DNA, 36 bp, Artificial Sequence
  Synthetic oligonucleotide
tgcggtccttccctcagccccgtacactccagctta

SEQ ID NO: 189154 - DNA, 36 bp, Artificial Sequence
  Synthetic oligonucleotide
aatcgccgctccaccgcagcctgttacactcggtta

SEQ ID NO: 189155 - DNA, 35 bp, Artificial Sequence
  Synthetic oligonucleotide
gccccatccgccccctgcgagcgacgggtaacaac

SEQ ID NO: 189156 - DNA, 35 bp, Artificial Sequence
  Synthetic oligonucleotide
gatcggtcccccgataatgtttcgctcttcccaac

SEQ ID NO: 189157 - DNA, 35 bp, Artificial Sequence
  Synthetic oligonucleotide
acccctccacccgaatatagtgtcccggcggtaac

SEQ ID NO: 189158 - DNA, 35 bp, Artificial Sequence
  Synthetic oligonucleotide
gacggctcacgagcgcaagcctcccacttctgcac

SEQ ID NO: 189159 - DNA, 35 bp, Artificial Sequence
  Synthetic oligonucleotide
atgcacacgctctagcctcactcgccttcctggac

SEQ ID NO: 189160 - DNA, 35 bp, Artificial Sequence
  Synthetic oligonucleotide
gtgcatcccaactgtgcgcattataacccgcctac

SEQ ID NO: 189161 - DNA, 35 bp, Artificial Sequence
  Synthetic oligonucleotide
gtttgcgcgctatagcagtagcgatcgccttcccc

SEQ ID NO: 189162 - DNA, 35 bp, Artificial Sequence
  Synthetic oligonucleotide
accaatcgggcagaggtttgtttcgttccatgccc

SEQ ID NO: 189163 - DNA, 35 bp, Artificial Sequence
  Synthetic oligonucleotide
ccccccagacctcgctgttaccatcaccagtgccc

SEQ ID NO: 189164 - DNA, 35 bp, Artificial Sequence
  Synthetic oligonucleotide
gcctactccctcttgactgcaatgcgaacgacgcc

SEQ ID NO: 189165 - DNA, 35 bp, Artificial Sequence
  Synthetic oligonucleotide
gtggttcgctgccctctatttgccacgcctccgcc

SEQ ID NO: 189166 - DNA, 35 bp, Artificial Sequence
  Synthetic oligonucleotide
gtccctcacctgatcaaccttttgtcgtttccgcc

SEQ ID NO: 189167 - DNA, 35 bp, Artificial Sequence
  Synthetic oligonucleotide
ggtggtccatctgcactgaaacgaaccctcatgcc

SEQ ID NO: 189168 - DNA, 35 bp, Artificial Sequence
  Synthetic oligonucleotide
tctgtagcaagtgctccccgcggaccctcactgcc

SEQ ID NO: 189169 - DNA, 35 bp, Artificial Sequence
  Synthetic oligonucleotide
tggtcccgcgtaggacgcccgccctctgaattgcc

SEQ ID NO: 189170 - DNA, 35 bp, Artificial Sequence
  Synthetic oligonucleotide
gttcagacccgccgcgttgcgcccagccccttgcc

SEQ ID NO: 189171 - DNA, 35 bp, Artificial Sequence
  Synthetic oligonucleotide
tagatagccaccgaacatctgcgtcgttcccatcc

SEQ ID NO: 189172 - DNA, 35 bp, Artificial Sequence
  Synthetic oligonucleotide
aaccccgactactgcttttgcgtgcacatgcatcc

SEQ ID NO: 189173 - DNA, 34 bp, Artificial Sequence
  Synthetic oligonucleotide
gttcgcctgcctacccccgcgtgagtcgccctcc

SEQ ID NO: 189174 - DNA, 35 bp, Artificial Sequence
  Synthetic oligonucleotide
tcgaaacacatccctctgtcacgaccttagtgtcc

SEQ ID NO: 189175 - DNA, 35 bp, Artificial Sequence
  Synthetic oligonucleotide
gtacacgcccctgtgcatgacacttgtagccttcc

SEQ ID NO: 189176 - DNA, 35 bp, Artificial Sequence
  Synthetic oligonucleotide
ttctcccatgccgtagagcctagaacgtgccttcc

SEQ ID NO: 189177 - DNA, 35 bp, Artificial Sequence
  Synthetic oligonucleotide
taccagatcctccatgcccggtccgaatcggttcc

SEQ ID NO: 189178 - DNA, 35 bp, Artificial Sequence
  Synthetic oligonucleotide
aacactccgactatcttctaacccacggcacacgc

SEQ ID NO: 189179 - DNA, 35 bp, Artificial Sequence
  Synthetic oligonucleotide
acatgtcatcccgttctagccagaccctcccacgc

SEQ ID NO: 189180 - DNA, 35 bp, Artificial Sequence
  Synthetic oligonucleotide
gtgtcaattgacccggccgaacgccctacctccgc

SEQ ID NO: 189181 - DNA, 35 bp, Artificial Sequence
  Synthetic oligonucleotide
acaggcctatcgcattgcccttatcaccttccggc

SEQ ID NO: 189182 - DNA, 35 bp, Artificial Sequence
  Synthetic oligonucleotide
gacgcctccgacttgtcgcactgtccctaaagggc

SEQ ID NO: 189183 - DNA, 34 bp, Artificial Sequence
  Synthetic oligonucleotide
tcaggggaacgtggggaagcacggggaacgatgc

SEQ ID NO: 189184 - DNA, 35 bp, Artificial Sequence
  Synthetic oligonucleotide
gcttctacccgttcccccgctaacgcccgtcctgc

SEQ ID NO: 189185 - DNA, 35 bp, Artificial Sequence
  Synthetic oligonucleotide
gacggtacctcgtcataattttcccccgtccgtgc

SEQ ID NO: 189186 - DNA, 34 bp, Artificial Sequence
  Synthetic oligonucleotide
gatccgcaccatctcgattttgactcagccttgc

SEQ ID NO: 189187 - DNA, 35 bp, Artificial Sequence
  Synthetic oligonucleotide
ttgtcaacttggtcgttcttttcgggcttcttatc

SEQ ID NO: 189188 - DNA, 35 bp, Artificial Sequence
  Synthetic oligonucleotide
atcctgcttcggtcgtaatcagtcctttccgcctc

SEQ ID NO: 189189 - DNA, 35 bp, Artificial Sequence
  Synthetic oligonucleotide
tcccacacctaccaccagctggacgatatgcgctc

SEQ ID NO: 189190 - DNA, 35 bp, Artificial Sequence
  Synthetic oligonucleotide
tactgtctccggcctatcaatccccctcgggtgtc

SEQ ID NO: 189191 - DNA, 35 bp, Artificial Sequence
  Synthetic oligonucleotide
gttatgcagaacgtggggccagtttgcttcctttc

SEQ ID NO: 189192 - DNA, 35 bp, Artificial Sequence
  Synthetic oligonucleotide
ttgaccgccggtatctccttaatgttctccaccag

SEQ ID NO: 189193 - DNA, 35 bp, Artificial Sequence
  Synthetic oligonucleotide
accgaccgccccgttcacatggtaattcctaaccg

SEQ ID NO: 189194 - DNA, 35 bp, Artificial Sequence
  Synthetic oligonucleotide
acgtccacagttgtcgtcatctattctatctcccg

SEQ ID NO: 189195 - DNA, 35 bp, Artificial Sequence
  Synthetic oligonucleotide
gcaccacaagctttccctcgtcctcaacaccgccg

SEQ ID NO: 189196 - DNA, 35 bp, Artificial Sequence
  Synthetic oligonucleotide
gaccgcctgccacacatcttccatacgaccctccg

SEQ ID NO: 189197 - DNA, 35 bp, Artificial Sequence
  Synthetic oligonucleotide
atgcctgggcccgcggtcacatcgcatatcctccg

SEQ ID NO: 189198 - DNA, 35 bp, Artificial Sequence
  Synthetic oligonucleotide
ttcaaccccggcgataacaacagtccgcttctccg

SEQ ID NO: 189199 - DNA, 35 bp, Artificial Sequence
  Synthetic oligonucleotide
tcacgtctgtaggtcgccacttcccatcttctccg

SEQ ID NO: 189200 - DNA, 35 bp, Artificial Sequence
  Synthetic oligonucleotide
tcatcaccttccccgcaaacgcccgaacatctgcg

SEQ ID NO: 189201 - DNA, 35 bp, Artificial Sequence
  Synthetic oligonucleotide
gtggagggggacagaaaggaagaatgggggttgcg

SEQ ID NO: 189202 - DNA, 35 bp, Artificial Sequence
  Synthetic oligonucleotide
tcccgtccgaagtctaccccattaccctgcagtcg

SEQ ID NO: 189203 - DNA, 35 bp, Artificial Sequence
  Synthetic oligonucleotide
tccaacctaccgccataagcaccagcatgctttcg

SEQ ID NO: 189204 - DNA, 35 bp, Artificial Sequence
  Synthetic oligonucleotide
gcatgcgcactttcttcgatcacccgtttgtttcg

SEQ ID NO: 189205 - DNA, 35 bp, Artificial Sequence
  Synthetic oligonucleotide
tacccacgggagaaaggaggatggtacggaacggg

SEQ ID NO: 189206 - DNA, 35 bp, Artificial Sequence
  Synthetic oligonucleotide
ggaggggtgtccggggttgggaaggggatatatgg

SEQ ID NO: 189207 - DNA, 35 bp, Artificial Sequence
  Synthetic oligonucleotide
taccccatcgccccggcgcaacctttgacatattg

SEQ ID NO: 189208 - DNA, 35 bp, Artificial Sequence
  Synthetic oligonucleotide
gggggtgaggcgtgggggggaacggtgcggccttg

SEQ ID NO: 189209 - DNA, 34 bp, Artificial Sequence
  Synthetic oligonucleotide
gtgggaggaatgcggggggggggaatcacggaat

SEQ ID NO: 189210 - DNA, 35 bp, Artificial Sequence
  Synthetic oligonucleotide
tccatcgaagccatatgacatacgttcgcccccat

SEQ ID NO: 189211 - DNA, 35 bp, Artificial Sequence
  Synthetic oligonucleotide
ccacccgactctcatgctctcgcgtaccttgtact

SEQ ID NO: 189212 - DNA, 35 bp, Artificial Sequence
  Synthetic oligonucleotide
ttaccgcacgggactccgacttgaaccaccgacct

SEQ ID NO: 189213 - DNA, 35 bp, Artificial Sequence
  Synthetic oligonucleotide
ttgtaacacccgccacgaacaccaagggcacccct

SEQ ID NO: 189214 - DNA, 35 bp, Artificial Sequence
  Synthetic oligonucleotide
gactcgccacgaggtcttcatttccagcaatccct

SEQ ID NO: 189215 - DNA, 35 bp, Artificial Sequence
  Synthetic oligonucleotide
tgaaacgcacgcctttgcctcttttttctctgcct

SEQ ID NO: 189216 - DNA, 35 bp, Artificial Sequence
  Synthetic oligonucleotide
tgatcccgcccagcagtctgggttgccctcctgct

SEQ ID NO: 189217 - DNA, 35 bp, Artificial Sequence
  Synthetic oligonucleotide
gaacgtggtttggcgtattatctccctgtttctct

SEQ ID NO: 189218 - DNA, 35 bp, Artificial Sequence
  Synthetic oligonucleotide
aattctccagccctgcacgtgtccttcttcggtct

SEQ ID NO: 189219 - DNA, 35 bp, Artificial Sequence
  Synthetic oligonucleotide
gtgaatcgctcccgatagggtcacccactctttct

SEQ ID NO: 189220 - DNA, 35 bp, Artificial Sequence
  Synthetic oligonucleotide
aacctgcgagggggggggatctcaaggagggtagt

SEQ ID NO: 189221 - DNA, 35 bp, Artificial Sequence
  Synthetic oligonucleotide
atcggacgtactctatatctgctccaccaacacgt

SEQ ID NO: 189222 - DNA, 35 bp, Artificial Sequence
  Synthetic oligonucleotide
agcccattgcacatgtaacccgcctggactcccgt

SEQ ID NO: 189223 - DNA, 35 bp, Artificial Sequence
  Synthetic oligonucleotide
gagggggggggcacaagctagcgagagaagtccgt

SEQ ID NO: 189224 - DNA, 36 bp, Artificial Sequence
  Synthetic oligonucleotide
gtcaacacctcgcgcttaaatacggtccaaacttgt

SEQ ID NO: 189225 - DNA, 35 bp, Artificial Sequence
  Synthetic oligonucleotide
taggtccatctcgccgaggtttcgccccccgttgt

SEQ ID NO: 189226 - DNA, 35 bp, Artificial Sequence
  Synthetic oligonucleotide
gacccctgtctcgaactatctttatcgcctggatt

SEQ ID NO: 189227 - DNA, 35 bp, Artificial Sequence
  Synthetic oligonucleotide
gcatgttcacgttcgccttcccatccctgttgatt

SEQ ID NO: 189228 - DNA, 35 bp, Artificial Sequence
  Synthetic oligonucleotide
acgttgacgcactgtgccgttgctcaaccatcctt

SEQ ID NO: 189229 - DNA, 35 bp, Artificial Sequence
  Synthetic oligonucleotide
gcgcaccccccccactcccggagtacttcatgctt

SEQ ID NO: 189230 - DNA, 35 bp, Artificial Sequence
  Synthetic oligonucleotide
acttcatgcggtcgtgcgttcactccagcccagtt

SEQ ID NO: 189231 - DNA, 35 bp, Artificial Sequence
  Synthetic oligonucleotide
tggttccatccgggttctcacacacactccttgtt

SEQ ID NO: 189232 - DNA, 35 bp, Artificial Sequence
  Synthetic oligonucleotide
tagcccatccctcatacgacccttgttggcgcttt

SEQ ID NO: 189233 - DNA, 35 bp, Artificial Sequence
  Synthetic oligonucleotide
tagcctagccctcgtgaccagctctatacctcttt

SEQ ID NO: 189234 - DNA, 35 bp, Artificial Sequence
  Synthetic oligonucleotide
tttgtcacctcctattgtccctgccgtatgttttt

SEQ ID NO: 189235 - DNA, 35 bp, Artificial Sequence
  Synthetic oligonucleotide
actcgccccgtggacctctgtacgccgaccataaa

SEQ ID NO: 189236 - DNA, 36 bp, Artificial Sequence
  Synthetic oligonucleotide
gttggggggcgtgcaggccggggttggtggaggtaa

SEQ ID NO: 189237 - DNA, 36 bp, Artificial Sequence
  Synthetic oligonucleotide
gctgaggagggaggaaagtagagggctgtaaaaaca

SEQ ID NO: 189238 - DNA, 36 bp, Artificial Sequence
  Synthetic oligonucleotide
aatcccccacccccctgttgcattggaagacaaaca

SEQ ID NO: 189239 - DNA, 36 bp, Artificial Sequence
  Synthetic oligonucleotide
aaacgagcgccgttgctaatccttccactcctcaca

SEQ ID NO: 189240 - DNA, 36 bp, Artificial Sequence
  Synthetic oligonucleotide
tgccgaaatcactgggagggacggggcagggggaca

SEQ ID NO: 189241 - DNA, 36 bp, Artificial Sequence
  Synthetic oligonucleotide
gaacagcccacgctcctccacgtctcaagccgtaca

SEQ ID NO: 189242 - DNA, 35 bp, Artificial Sequence
  Synthetic oligonucleotide
gcgcccccgcctcttgtgcataccttcgctcccca

SEQ ID NO: 189243 - DNA, 36 bp, Artificial Sequence
  Synthetic oligonucleotide
actcccgcgccctaagcgatatgccctcgtatgcca

SEQ ID NO: 189244 - DNA, 36 bp, Artificial Sequence
  Synthetic oligonucleotide
actcaccatcgcctagtctggtcccatctgcctcca

SEQ ID NO: 189245 - DNA, 35 bp, Artificial Sequence
  Synthetic oligonucleotide
tgagcgcagttcaccgaccttacaccctccgtcca

SEQ ID NO: 189246 - DNA, 36 bp, Artificial Sequence
  Synthetic oligonucleotide
gaggactgtcaatcctcttttgagtccccgcttcca

SEQ ID NO: 189247 - DNA, 36 bp, Artificial Sequence
  Synthetic oligonucleotide
tacggatacaggtgtgggagggtgggtcaaatagca

SEQ ID NO: 189248 - DNA, 36 bp, Artificial Sequence
  Synthetic oligonucleotide
tggacggtcaccaggtgggagggggggaccagggca

SEQ ID NO: 189249 - DNA, 36 bp, Artificial Sequence
  Synthetic oligonucleotide
gcgggggggtggagtgggcgatgaaaggaagttgca

SEQ ID NO: 189250 - DNA, 35 bp, Artificial Sequence
  Synthetic oligonucleotide
tcaagaagcgctcactcctctatcccacaccatca

SEQ ID NO: 189251 - DNA, 36 bp, Artificial Sequence
  Synthetic oligonucleotide
atgacgccactgtactgtcctccacgcccatgatca

SEQ ID NO: 189252 - DNA, 36 bp, Artificial Sequence
  Synthetic oligonucleotide
gactgccaggcctccgtccgtgccttcgccatatca

SEQ ID NO: 189253 - DNA, 35 bp, Artificial Sequence
  Synthetic oligonucleotide
ttcgcaatcgatccagtcctatccgttcattctca

SEQ ID NO: 189254 - DNA, 36 bp, Artificial Sequence
  Synthetic oligonucleotide
tatcgccactgactcgacgacctgcacatattctca

SEQ ID NO: 189255 - DNA, 36 bp, Artificial Sequence
  Synthetic oligonucleotide
gctggcctccacgcccaggttattactgctttctca

SEQ ID NO: 189256 - DNA, 36 bp, Artificial Sequence
  Synthetic oligonucleotide
acactgctcacacaactgtcttcactgcacgcttca

SEQ ID NO: 189257 - DNA, 37 bp, Artificial Sequence
  Synthetic oligonucleotide
gagccagtacgacggggaagggtggaaaatcggaaga

SEQ ID NO: 189258 - DNA, 37 bp, Artificial Sequence
  Synthetic oligonucleotide
accacatgctggtcgggggttggggaggagaagcaga

SEQ ID NO: 189259 - DNA, 37 bp, Artificial Sequence
  Synthetic oligonucleotide
gcacaagcaaaagggtggcaaacaggggggtaggaga

SEQ ID NO: 189260 - DNA, 36 bp, Artificial Sequence
  Synthetic oligonucleotide
gcaagaagaccgtgaagggcgggggatcaacggaga

SEQ ID NO: 189261 - DNA, 37 bp, Artificial Sequence
  Synthetic oligonucleotide
gagggtgaggaaggatagccgaagcggcggagggaga

SEQ ID NO: 189262 - DNA, 37 bp, Artificial Sequence
  Synthetic oligonucleotide
gaggagagggaagtgggcgatgttgggtggcgggaga

SEQ ID NO: 189263 - DNA, 37 bp, Artificial Sequence
  Synthetic oligonucleotide
tcacgcgacaggccccatcttcgacctgcaccaacga

SEQ ID NO: 189264 - DNA, 36 bp, Artificial Sequence
  Synthetic oligonucleotide
tacgacgtgagtgagggtcgggggggtgggacacga

SEQ ID NO: 189265 - DNA, 35 bp, Artificial Sequence
  Synthetic oligonucleotide
tccatcatgccgccacccttaaacggtgtcaccga

SEQ ID NO: 189266 - DNA, 37 bp, Artificial Sequence
  Synthetic oligonucleotide
ttgttgctgtcgaccgcctctgatatccacactccga

SEQ ID NO: 189267 - DNA, 37 bp, Artificial Sequence
  Synthetic oligonucleotide
tttgggctgggaaggggtgggtgtgatgttcttgcga

SEQ ID NO: 189268 - DNA, 37 bp, Artificial Sequence
  Synthetic oligonucleotide
atagacgagtggaaggggggtatcgtggcagacagga

SEQ ID NO: 189269 - DNA, 35 bp, Artificial Sequence
  Synthetic oligonucleotide
tgatgggcggaacgggttgggagggaatgttagga

SEQ ID NO: 189270 - DNA, 36 bp, Artificial Sequence
  Synthetic oligonucleotide
tggaatgggcgggggggaactgcggaaaagtgcgga

SEQ ID NO: 189271 - DNA, 37 bp, Artificial Sequence
  Synthetic oligonucleotide
gtgacgtgggtgggagaaaaactgactggtggcggga

SEQ ID NO: 189272 - DNA, 37 bp, Artificial Sequence
  Synthetic oligonucleotide
aatcgggtgggtgggtatgcgaacctggtggatggga

SEQ ID NO: 189273 - DNA, 36 bp, Artificial Sequence
  Synthetic oligonucleotide
tagggccgtgcatttttcgtagttgggcgggtggga

SEQ ID NO: 189274 - DNA, 36 bp, Artificial Sequence
  Synthetic oligonucleotide
acgtggagggggttgaagggcaatgtgagcggtgga

SEQ ID NO: 189275 - DNA, 38 bp, Artificial Sequence
  Synthetic oligonucleotide
taaccccacccctcaactgtctgacagtccgtatatga

SEQ ID NO: 189276 - DNA, 35 bp, Artificial Sequence
  Synthetic oligonucleotide
acgtcgaccctttcatcgtgcatccccaaacctga

SEQ ID NO: 189277 - DNA, 36 bp, Artificial Sequence
  Synthetic oligonucleotide
tagatcagtcacagttcgcgatctgccccttcctga

SEQ ID NO: 189278 - DNA, 37 bp, Artificial Sequence
  Synthetic oligonucleotide
agcgggacagatgggtcagggaagggcggggggctga

SEQ ID NO: 189279 - DNA, 38 bp, Artificial Sequence
  Synthetic oligonucleotide
gaggatcaccgggaggagcgggtgggagactcgtctga

SEQ ID NO: 189280 - DNA, 38 bp, Artificial Sequence
  Synthetic oligonucleotide
gttcgcgcgctagttcatcgctcccctccattgtctga

SEQ ID NO: 189281 - DNA, 37 bp, Artificial Sequence
  Synthetic oligonucleotide
attccgcccctcctggttttcctcgcttctacagtga

SEQ ID NO: 189282 - DNA, 38 bp, Artificial Sequence
  Synthetic oligonucleotide
ttgctggggagggcatgggaaaggaggtaagccagtga

SEQ ID NO: 189283 - DNA, 38 bp, Artificial Sequence
  Synthetic oligonucleotide
ggtgatagggaaggagaggggggggctgtaaagagtga

SEQ ID NO: 189284 - DNA, 38 bp, Artificial Sequence
  Synthetic oligonucleotide
tcatcctacctcccgccagcttggcacagtcttattga

SEQ ID NO: 189285 - DNA, 37 bp, Artificial Sequence
  Synthetic oligonucleotide
gggatgccggggcggacgggcgaaaaggggcacttga

SEQ ID NO: 189286 - DNA, 38 bp, Artificial Sequence
  Synthetic oligonucleotide
gctacctccgacgctttcatcccgacagcccgccttga

SEQ ID NO: 189287 - DNA, 38 bp, Artificial Sequence
  Synthetic oligonucleotide
gccatccgtacaccgccctatagtgatgcctgccttga

SEQ ID NO: 189288 - DNA, 35 bp, Artificial Sequence
  Synthetic oligonucleotide
gtgcaatcctttagccgctacgccacactccttga

SEQ ID NO: 189289 - DNA, 37 bp, Artificial Sequence
  Synthetic oligonucleotide
ggacctgggccggttgcgtggcgccctttcctcttga

SEQ ID NO: 189290 - DNA, 35 bp, Artificial Sequence
  Synthetic oligonucleotide
gtttgcgttcgcctgacccccccgcatttcgttga

SEQ ID NO: 189291 - DNA, 37 bp, Artificial Sequence
  Synthetic oligonucleotide
tgaatccgcctccacttcccatgcatttgcgtgttga

SEQ ID NO: 189292 - DNA, 35 bp, Artificial Sequence
  Synthetic oligonucleotide
gttcccccatcggttaattggccggttttacccta

SEQ ID NO: 189293 - DNA, 35 bp, Artificial Sequence
  Synthetic oligonucleotide
agtggcccgaccagtttcatgcccctgccttccta

SEQ ID NO: 189294 - DNA, 36 bp, Artificial Sequence
  Synthetic oligonucleotide
ttgccacatgcgctcgcttgcttcacctatctcgta

SEQ ID NO: 189295 - DNA, 35 bp, Artificial Sequence
  Synthetic oligonucleotide
actccattctgcggcgacctgctgctcttctcgta

SEQ ID NO: 189296 - DNA, 36 bp, Artificial Sequence
  Synthetic oligonucleotide
gcaaccactgcaccttcccggtttgagtacctggta

SEQ ID NO: 189297 - DNA, 36 bp, Artificial Sequence
  Synthetic oligonucleotide
actacccgtgccctgtttttagttcgttaattatta

SEQ ID NO: 189298 - DNA, 35 bp, Artificial Sequence
  Synthetic oligonucleotide
gcccccatgtgccacgtgttctccctcctgagtta

SEQ ID NO: 189299 - DNA, 36 bp, Artificial Sequence
  Synthetic oligonucleotide
tcccggaagcgccgcctgccatcacattctgcttta

SEQ ID NO: 189300 - DNA, 36 bp, Artificial Sequence
  Synthetic oligonucleotide
gccatacatctcattctgctttttgttactggttta

SEQ ID NO: 189301 - DNA, 36 bp, Artificial Sequence
  Synthetic oligonucleotide
tgatggcgtagcatgccctcttcgcgctctctttta

SEQ ID NO: 189302 - DNA, 35 bp, Artificial Sequence
  Synthetic oligonucleotide
acgtaccaccaatcagcggctgcatcgaccctaac

SEQ ID NO: 189303 - DNA, 35 bp, Artificial Sequence
  Synthetic oligonucleotide
atcctcccgcaccgatgatattcgcgtcggtacac

SEQ ID NO: 189304 - DNA, 35 bp, Artificial Sequence
  Synthetic oligonucleotide
tacctgtagccgtacctttggactctcgatcccac

SEQ ID NO: 189305 - DNA, 35 bp, Artificial Sequence
  Synthetic oligonucleotide
gatctggacccacgccaacgaagtcgacccttcac

SEQ ID NO: 189306 - DNA, 35 bp, Artificial Sequence
  Synthetic oligonucleotide
acctgttagccacatcattctctcatccagctgac

SEQ ID NO: 189307 - DNA, 37 bp, Artificial Sequence
  Synthetic oligonucleotide
tgcctcactcggtgcacatacacccaccggtctatac

SEQ ID NO: 189308 - DNA, 35 bp, Artificial Sequence
  Synthetic oligonucleotide
gattcatcgtatcagcgcaccgtttgctctcttac

SEQ ID NO: 189309 - DNA, 35 bp, Artificial Sequence
  Synthetic oligonucleotide
acatccccagtccgtagattcccctccagcccacc

SEQ ID NO: 189310 - DNA, 35 bp, Artificial Sequence
  Synthetic oligonucleotide
gtatcacactgcctccgcagtcaacttccctcacc

SEQ ID NO: 189311 - DNA, 35 bp, Artificial Sequence
  Synthetic oligonucleotide
tccctccctctagctatgagcatatcgattatacc

SEQ ID NO: 189312 - DNA, 33 bp, Artificial Sequence
  Synthetic oligonucleotide
accgattcctacacaccgtaatggtcttatacc

SEQ ID NO: 189313 - DNA, 36 bp, Artificial Sequence
  Synthetic oligonucleotide
tgatctcatcatagcccccctgctgctggccttacc

SEQ ID NO: 189314 - DNA, 35 bp, Artificial Sequence
  Synthetic oligonucleotide
tccgacaagcggaaaatgttagcgcccctctaccc

SEQ ID NO: 189315 - DNA, 34 bp, Artificial Sequence
  Synthetic oligonucleotide
tacccgctccacgtttggaccagttctaagcccc

SEQ ID NO: 189316 - DNA, 35 bp, Artificial Sequence
  Synthetic oligonucleotide
gaaagccagtcacagccgccatcgtactttgcccc

SEQ ID NO: 189317 - DNA, 35 bp, Artificial Sequence
  Synthetic oligonucleotide
gaaccccgcccgctgccatgggcaacacaatgccc

SEQ ID NO: 189318 - DNA, 35 bp, Artificial Sequence
  Synthetic oligonucleotide
gtctcgtagatacgacattgcacgccctccatccc

SEQ ID NO: 189319 - DNA, 34 bp, Artificial Sequence
  Synthetic oligonucleotide
agtgccgccgcctaacattgaaacccgccccgcc

SEQ ID NO: 189320 - DNA, 35 bp, Artificial Sequence
  Synthetic oligonucleotide
tcaagtgttcatccggtctggtcacctcactcgcc

SEQ ID NO: 189321 - DNA, 35 bp, Artificial Sequence
  Synthetic oligonucleotide
tacccaatggcagccactctgacctcccctctgcc

SEQ ID NO: 189322 - DNA, 34 bp, Artificial Sequence
  Synthetic oligonucleotide
aagcgtagcccatgcttgatccactgcttctgcc

SEQ ID NO: 189323 - DNA, 34 bp, Artificial Sequence
  Synthetic oligonucleotide
gacctcgctcgcttgtctcccccgctttgttgcc

SEQ ID NO: 189324 - DNA, 35 bp, Artificial Sequence
  Synthetic oligonucleotide
gtctcccgtgtacgtgttatcctatgcctctatcc

SEQ ID NO: 189325 - DNA, 35 bp, Artificial Sequence
  Synthetic oligonucleotide
tccatccaacgattctgcccgttatcgctacttcc

SEQ ID NO: 189326 - DNA, 35 bp, Artificial Sequence
  Synthetic oligonucleotide
atgaccattgcgacgcggatccgcccctccgttcc

SEQ ID NO: 189327 - DNA, 35 bp, Artificial Sequence
  Synthetic oligonucleotide
attgcccccgaccctacgcattgcttccctttagc

SEQ ID NO: 189328 - DNA, 35 bp, Artificial Sequence
  Synthetic oligonucleotide
gcatgggccgtcttatgtaggttacccctctccgc

SEQ ID NO: 189329 - DNA, 35 bp, Artificial Sequence
  Synthetic oligonucleotide
gtcacctctcggcatttgagttctgcgtcgttcgc

SEQ ID NO: 189330 - DNA, 35 bp, Artificial Sequence
  Synthetic oligonucleotide
gttaccgccctatctgctttcgtacaccccttggc

SEQ ID NO: 189331 - DNA, 35 bp, Artificial Sequence
  Synthetic oligonucleotide
atcatggcactcagtcaccgttcgaacttccctgc

SEQ ID NO: 189332 - DNA, 35 bp, Artificial Sequence
  Synthetic oligonucleotide
aaaccgtacctgcaaacgccgcattccatccgatc

SEQ ID NO: 189333 - DNA, 35 bp, Artificial Sequence
  Synthetic oligonucleotide
gcaggccagacgcttgttctgttccagccgctatc

SEQ ID NO: 189334 - DNA, 35 bp, Artificial Sequence
  Synthetic oligonucleotide
gtgtacgcaccgcggcgcctggtcacagcttcctc

SEQ ID NO: 189335 - DNA, 35 bp, Artificial Sequence
  Synthetic oligonucleotide
atccctcgctcactccctgaatttgccacacgctc

SEQ ID NO: 189336 - DNA, 35 bp, Artificial Sequence
  Synthetic oligonucleotide
tgcgctccctcgtatcgcccttgaaactccaagtc

SEQ ID NO: 189337 - DNA, 35 bp, Artificial Sequence
  Synthetic oligonucleotide
gctgacagatggccccacccgtgtacctctgattc

SEQ ID NO: 189338 - DNA, 35 bp, Artificial Sequence
  Synthetic oligonucleotide
atagcgccgcgctaacttcctggtatgccctcttc

SEQ ID NO: 189339 - DNA, 35 bp, Artificial Sequence
  Synthetic oligonucleotide
tgccaatcctccctctgttatcgggcgtacctacg

SEQ ID NO: 189340 - DNA, 35 bp, Artificial Sequence
  Synthetic oligonucleotide
agatgtcccacctatcttgctcccttttttgtacg

SEQ ID NO: 189341 - DNA, 35 bp, Artificial Sequence
  Synthetic oligonucleotide
agaaaccccgcctccgtcgtactaactccattacg

SEQ ID NO: 189342 - DNA, 35 bp, Artificial Sequence
  Synthetic oligonucleotide
tctgacccagtacttgcactctcagctttttaccg

SEQ ID NO: 189343 - DNA, 35 bp, Artificial Sequence
  Synthetic oligonucleotide
gttacactctcgcgcacggatgtctctaccccccg

SEQ ID NO: 189344 - DNA, 35 bp, Artificial Sequence
  Synthetic oligonucleotide
acttccaccgtctcctctcttgcgcttgaggcccg

SEQ ID NO: 189345 - DNA, 35 bp, Artificial Sequence
  Synthetic oligonucleotide
atcatccgcaagccacggctccatacatcttatcg

SEQ ID NO: 189346 - DNA, 35 bp, Artificial Sequence
  Synthetic oligonucleotide
ttgctacccattgcggctttccgtaccgttcctcg

SEQ ID NO: 189347 - DNA, 34 bp, Artificial Sequence
  Synthetic oligonucleotide
acaccttccgccctctcgcacagcttggttttcg

SEQ ID NO: 189348 - DNA, 35 bp, Artificial Sequence
  Synthetic oligonucleotide
gaggggcaggggtttacaggggagggctagagagg

SEQ ID NO: 189349 - DNA, 35 bp, Artificial Sequence
  Synthetic oligonucleotide
aacggaagggggcgggaatcgcagggaagggaggg

SEQ ID NO: 189350 - DNA, 35 bp, Artificial Sequence
  Synthetic oligonucleotide
tagcggtggtggtggggttaaagtgaagggtaggg

SEQ ID NO: 189351 - DNA, 35 bp, Artificial Sequence
  Synthetic oligonucleotide
tcagaaatgggggtgagggagtggaactcgagtgg

SEQ ID NO: 189352 - DNA, 35 bp, Artificial Sequence
  Synthetic oligonucleotide
gtgggaggaccggagcaagggatggaactgagtgg

SEQ ID NO: 189353 - DNA, 35 bp, Artificial Sequence
  Synthetic oligonucleotide
gtttagccggcgtcaatgcgccctcccgaaccctg

SEQ ID NO: 189354 - DNA, 35 bp, Artificial Sequence
  Synthetic oligonucleotide
acctccgggtcttctacgtactctgatcaatcctg

SEQ ID NO: 189355 - DNA, 35 bp, Artificial Sequence
  Synthetic oligonucleotide
agtggcccccccgcccgaatgtaggacctactctg

SEQ ID NO: 189356 - DNA, 35 bp, Artificial Sequence
  Synthetic oligonucleotide
tcacctgcccccctttgtcgcctgctacatctttg

SEQ ID NO: 189357 - DNA, 34 bp, Artificial Sequence
  Synthetic oligonucleotide
tctccaccccgctcggtccctctaaatgacacat

SEQ ID NO: 189358 - DNA, 35 bp, Artificial Sequence
  Synthetic oligonucleotide
gatgccgccctattgggtctttttgccacccgtat

SEQ ID NO: 189359 - DNA, 35 bp, Artificial Sequence
  Synthetic oligonucleotide
tacagccgcccatccccagaattgtccctgtttat

SEQ ID NO: 189360 - DNA, 35 bp, Artificial Sequence
  Synthetic oligonucleotide
gaccgcctgtctcctcacaagttatagtctcacct

SEQ ID NO: 189361 - DNA, 35 bp, Artificial Sequence
  Synthetic oligonucleotide
tacattgtgacagtcgtcccccgcgtttctcacct

SEQ ID NO: 189362 - DNA, 35 bp, Artificial Sequence
  Synthetic oligonucleotide
tcctcatggcctgtttctactgctggcatttccct

SEQ ID NO: 189363 - DNA, 35 bp, Artificial Sequence
  Synthetic oligonucleotide
tgaacacctccgtttgctttttgtacacctctgct

SEQ ID NO: 189364 - DNA, 35 bp, Artificial Sequence
  Synthetic oligonucleotide
tatggacccaccctgcgatgctcatgcttaactct

SEQ ID NO: 189365 - DNA, 35 bp, Artificial Sequence
  Synthetic oligonucleotide
tatacgccacatctcttgccgatagaaccctctct

SEQ ID NO: 189366 - DNA, 35 bp, Artificial Sequence
  Synthetic oligonucleotide
atgtcaccatcgtcatacagcccgtccttcattct

SEQ ID NO: 189367 - DNA, 35 bp, Artificial Sequence
  Synthetic oligonucleotide
agattgcaggatacctgttccccgtgccaccttct

SEQ ID NO: 189368 - DNA, 35 bp, Artificial Sequence
  Synthetic oligonucleotide
tcctgtccgccctctgtcttgcataatctctttct

SEQ ID NO: 189369 - DNA, 35 bp, Artificial Sequence
  Synthetic oligonucleotide
taggagcgaatatcgggggcgggggtaaatgcagt

SEQ ID NO: 189370 - DNA, 35 bp, Artificial Sequence
  Synthetic oligonucleotide
tcattgccgcgaagttctccgccgttttctctcgt

SEQ ID NO: 189371 - DNA, 35 bp, Artificial Sequence
  Synthetic oligonucleotide
tgccccacggtacttcctgcctcgatatgatcggt

SEQ ID NO: 189372 - DNA, 35 bp, Artificial Sequence
  Synthetic oligonucleotide
gcaccatgtctacccctgccacccgccccttgggt

SEQ ID NO: 189373 - DNA, 35 bp, Artificial Sequence
  Synthetic oligonucleotide
gctacccttcctcgtcgtgccacctggtacactgt

SEQ ID NO: 189374 - DNA, 35 bp, Artificial Sequence
  Synthetic oligonucleotide
tcacgcgttcaccgctccaccgccgaatggaaatt

SEQ ID NO: 189375 - DNA, 35 bp, Artificial Sequence
  Synthetic oligonucleotide
atgatccaccgcttcctgtcctgttatggcggatt

SEQ ID NO: 189376 - DNA, 35 bp, Artificial Sequence
  Synthetic oligonucleotide
tgaacgatcggaactgtctccccggtgcacacctt

SEQ ID NO: 189377 - DNA, 35 bp, Artificial Sequence
  Synthetic oligonucleotide
acctaccgcatacctcgttgctcgtaaatctcctt

SEQ ID NO: 189378 - DNA, 35 bp, Artificial Sequence
  Synthetic oligonucleotide
gccgtcgcacgatcgtgcttcccacccggttcctt

SEQ ID NO: 189379 - DNA, 35 bp, Artificial Sequence
  Synthetic oligonucleotide
tgctgatgtcgttctgtcctttgcctgcccacgtt

SEQ ID NO: 189380 - DNA, 35 bp, Artificial Sequence
  Synthetic oligonucleotide
acctacattgcccaaccgttgatacccgttccgtt

SEQ ID NO: 189381 - DNA, 35 bp, Artificial Sequence
  Synthetic oligonucleotide
gtcccccatccgactttggttttggtccttccttt

SEQ ID NO: 189382 - DNA, 35 bp, Artificial Sequence
  Synthetic oligonucleotide
aaccggcattacgccctagcctccccctgtgcttt

SEQ ID NO: 189383 - DNA, 35 bp, Artificial Sequence
  Synthetic oligonucleotide
tatcacacagccgtgcctcccataggtttttcttt

SEQ ID NO: 189384 - DNA, 36 bp, Artificial Sequence
  Synthetic oligonucleotide
taagaggggctggggaggggtggtgaccgaattaaa

SEQ ID NO: 189385 - DNA, 36 bp, Artificial Sequence
  Synthetic oligonucleotide
gacgcccccctgcccccgtgacgttcttgaccacaa

SEQ ID NO: 189386 - DNA, 36 bp, Artificial Sequence
  Synthetic oligonucleotide
ttccaccctgccatcctctgctatcgcaaagagcaa

SEQ ID NO: 189387 - DNA, 36 bp, Artificial Sequence
  Synthetic oligonucleotide
gtggttgagagggggggtggtccattggcagtagaa

SEQ ID NO: 189388 - DNA, 36 bp, Artificial Sequence
  Synthetic oligonucleotide
gtgtaagggcccgagggggggaggtgaatcgtagaa

SEQ ID NO: 189389 - DNA, 35 bp, Artificial Sequence
  Synthetic oligonucleotide
tgccctagcccactgttaccccgatcctacgtgaa

SEQ ID NO: 189390 - DNA, 36 bp, Artificial Sequence
  Synthetic oligonucleotide
gttagacggcgcaggggagggttaggggggcttgaa

SEQ ID NO: 189391 - DNA, 36 bp, Artificial Sequence
  Synthetic oligonucleotide
tacccgcatcctggtgcacccctttgtcttatctaa

SEQ ID NO: 189392 - DNA, 36 bp, Artificial Sequence
  Synthetic oligonucleotide
tacagccacggttcttcttcgagtctgcgccacaca

SEQ ID NO: 189393 - DNA, 36 bp, Artificial Sequence
  Synthetic oligonucleotide
tccccgcaacgaggctcccctgcatatctcttcaca

SEQ ID NO: 189394 - DNA, 35 bp, Artificial Sequence
  Synthetic oligonucleotide
ttattccgccgtgagacgcccctccgcatgttaca

SEQ ID NO: 189395 - DNA, 35 bp, Artificial Sequence
  Synthetic oligonucleotide
gcaccaccacacatgtcacttagccgccctcacca

SEQ ID NO: 189396 - DNA, 35 bp, Artificial Sequence
  Synthetic oligonucleotide
atccacccaactggacatagacagcttattaccca

SEQ ID NO: 189397 - DNA, 36 bp, Artificial Sequence
  Synthetic oligonucleotide
gcagagcagtagcctttatccactacggttccccca

SEQ ID NO: 189398 - DNA, 35 bp, Artificial Sequence
  Synthetic oligonucleotide
acctgactgtcctccctggcgacgtgccctcccca

SEQ ID NO: 189399 - DNA, 36 bp, Artificial Sequence
  Synthetic oligonucleotide
aatagccgggcatgggtaggggagggacggcgccca

SEQ ID NO: 189400 - DNA, 36 bp, Artificial Sequence
  Synthetic oligonucleotide
agccccacctcatggttaagcattcacttctatcca

SEQ ID NO: 189401 - DNA, 36 bp, Artificial Sequence
  Synthetic oligonucleotide
gagtcacgtcatcttcgctccaggtcccacactcca

SEQ ID NO: 189402 - DNA, 36 bp, Artificial Sequence
  Synthetic oligonucleotide
gacctgcctcatgtttctctccttgccgtccctcca

SEQ ID NO: 189403 - DNA, 36 bp, Artificial Sequence
  Synthetic oligonucleotide
tccagggccagtactgatcctcctccttgctctcca

SEQ ID NO: 189404 - DNA, 36 bp, Artificial Sequence
  Synthetic oligonucleotide
acacactcgccctacggctattctcactgagttcca

SEQ ID NO: 189405 - DNA, 35 bp, Artificial Sequence
  Synthetic oligonucleotide
gcatgtaccaccccagcctcgtatcttttcaggca

SEQ ID NO: 189406 - DNA, 35 bp, Artificial Sequence
  Synthetic oligonucleotide
gcatggaccaaaggtattgtgggcggggaggggca

SEQ ID NO: 189407 - DNA, 36 bp, Artificial Sequence
  Synthetic oligonucleotide
ttcgaaactaagcagtcgggggggaagagggtggca

SEQ ID NO: 189408 - DNA, 36 bp, Artificial Sequence
  Synthetic oligonucleotide
acgctcactcggttcacttgcgtactttctcgatca

SEQ ID NO: 189409 - DNA, 36 bp, Artificial Sequence
  Synthetic oligonucleotide
gctggcccctccttacgtactgtgccgtggctatca

SEQ ID NO: 189410 - DNA, 36 bp, Artificial Sequence
  Synthetic oligonucleotide
ggtgctaactaccaggggggaaagaaggggggctca

SEQ ID NO: 189411 - DNA, 35 bp, Artificial Sequence
  Synthetic oligonucleotide
gaccccgccctcctgtttatacatccacgcaaaga

SEQ ID NO: 189412 - DNA, 37 bp, Artificial Sequence
  Synthetic oligonucleotide
atgggagggccagaacttcaggacagggatgggaaga

SEQ ID NO: 189413 - DNA, 37 bp, Artificial Sequence
  Synthetic oligonucleotide
tcagagcaccaccttgtcccttctaccacacagacga

SEQ ID NO: 189414 - DNA, 37 bp, Artificial Sequence
  Synthetic oligonucleotide
gacccgcccctgtatcatctgcttcctcgccggacga

SEQ ID NO: 189415 - DNA, 35 bp, Artificial Sequence
  Synthetic oligonucleotide
agcacctcctgcattcatccccgacattgctacga

SEQ ID NO: 189416 - DNA, 36 bp, Artificial Sequence
  Synthetic oligonucleotide
gactgcaccagtaccgcctttcttgcctctaaccga

SEQ ID NO: 189417 - DNA, 37 bp, Artificial Sequence
  Synthetic oligonucleotide
actgggcaggggggggcacgagatgatgggagcccga

SEQ ID NO: 189418 - DNA, 36 bp, Artificial Sequence
  Synthetic oligonucleotide
tcacacaggcacatggccagccttacctacactcga

SEQ ID NO: 189419 - DNA, 37 bp, Artificial Sequence
  Synthetic oligonucleotide
acccacggtccatattctagtattgttcttccttcga

SEQ ID NO: 189420 - DNA, 37 bp, Artificial Sequence
  Synthetic oligonucleotide
gaccaaggaagcagaatgggaagctgggaaggcagga

SEQ ID NO: 189421 - DNA, 37 bp, Artificial Sequence
  Synthetic oligonucleotide
tccacatggtggcaaaagagggggtggggcaggagga

SEQ ID NO: 189422 - DNA, 37 bp, Artificial Sequence
  Synthetic oligonucleotide
gtatagagggggcgatgtcttggggagggagggagga

SEQ ID NO: 189423 - DNA, 37 bp, Artificial Sequence
  Synthetic oligonucleotide
ggtggacggacataggggaacggaaaaggagtgagga

SEQ ID NO: 189424 - DNA, 37 bp, Artificial Sequence
  Synthetic oligonucleotide
tgtgcgagagcataaaacagggggaaggcaacaggga

SEQ ID NO: 189425 - DNA, 37 bp, Artificial Sequence
  Synthetic oligonucleotide
tggggaaagaccagggcgggtgacgtctcttggggga

SEQ ID NO: 189426 - DNA, 37 bp, Artificial Sequence
  Synthetic oligonucleotide
atagggggaaagtgaggggcggagacctacgtgggga

SEQ ID NO: 189427 - DNA, 35 bp, Artificial Sequence
  Synthetic oligonucleotide
tgcatcattgcctcctctattcctgccattttgga

SEQ ID NO: 189428 - DNA, 37 bp, Artificial Sequence
  Synthetic oligonucleotide
tgatcacgtgggaggggagtgggacttatcgggatga

SEQ ID NO: 189429 - DNA, 38 bp, Artificial Sequence
  Synthetic oligonucleotide
tacaccccctcacattgcgatataacacccagtgatga

SEQ ID NO: 189430 - DNA, 35 bp, Artificial Sequence
  Synthetic oligonucleotide
gactggcatcgcatccgccccacttattcacctga

SEQ ID NO: 189431 - DNA, 35 bp, Artificial Sequence
  Synthetic oligonucleotide
tgcactccatcatcgcacctctaaccggctcctga

SEQ ID NO: 189432 - DNA, 38 bp, Artificial Sequence
  Synthetic oligonucleotide
agaggacactgggcaggggggggtaggggcatccgtga

SEQ ID NO: 189433 - DNA, 38 bp, Artificial Sequence
  Synthetic oligonucleotide
tgttcccccacatgttcacccggacactccccctgtga

SEQ ID NO: 189434 - DNA, 38 bp, Artificial Sequence
  Synthetic oligonucleotide
tccgtacatccgccccgccttgatctccgcccgtgtga

SEQ ID NO: 189435 - DNA, 36 bp, Artificial Sequence
  Synthetic oligonucleotide
gttgccccttcccctctctggtttatttagcacata

SEQ ID NO: 189436 - DNA, 36 bp, Artificial Sequence
  Synthetic oligonucleotide
gacccctccgtgattcgtatcaccgttttattcata

SEQ ID NO: 189437 - DNA, 36 bp, Artificial Sequence
  Synthetic oligonucleotide
ggatcacaacagcagtgcccgccagcttttcaccta

SEQ ID NO: 189438 - DNA, 36 bp, Artificial Sequence
  Synthetic oligonucleotide
tgacccccgccctccgttattttattcagctaccta

SEQ ID NO: 189439 - DNA, 36 bp, Artificial Sequence
  Synthetic oligonucleotide
gcacgccccatatcgttgcatatcctcggtgcccta

SEQ ID NO: 189440 - DNA, 36 bp, Artificial Sequence
  Synthetic oligonucleotide
gtggatggaggggaaggatgggatatatgcggagta

SEQ ID NO: 189441 - DNA, 36 bp, Artificial Sequence
  Synthetic oligonucleotide
tgcatccgtgcgctaattccgtcctatctcctggta

SEQ ID NO: 189442 - DNA, 36 bp, Artificial Sequence
  Synthetic oligonucleotide
gcacatcgctgtagctgcgcttgcacccctcttgta

SEQ ID NO: 189443 - DNA, 35 bp, Artificial Sequence
  Synthetic oligonucleotide
tcccccatgaccttccgcatcgcatagctgcctta

SEQ ID NO: 189444 - DNA, 35 bp, Artificial Sequence
  Synthetic oligonucleotide
gtgtctcacctcgatttgcctccccgtccaagtta

SEQ ID NO: 189445 - DNA, 35 bp, Artificial Sequence
  Synthetic oligonucleotide
taactcaccgtgccccctctgaatatcaagccaac

SEQ ID NO: 189446 - DNA, 35 bp, Artificial Sequence
  Synthetic oligonucleotide
gacgaacgcctgagatgctccctgccgcacaccac

SEQ ID NO: 189447 - DNA, 35 bp, Artificial Sequence
  Synthetic oligonucleotide
aatgtcccgccgacgtgctgtgcgcgtacctgcac

SEQ ID NO: 189448 - DNA, 35 bp, Artificial Sequence
  Synthetic oligonucleotide
gccgacgctcttctatacccctctgatcggtaacc

SEQ ID NO: 189449 - DNA, 35 bp, Artificial Sequence
  Synthetic oligonucleotide
atctcacaggacacccgacgtgcttaccctctacc

SEQ ID NO: 189450 - DNA, 35 bp, Artificial Sequence
  Synthetic oligonucleotide
tgtgagctcgcctcgtcgtgtttgtggctccaccc

SEQ ID NO: 189451 - DNA, 35 bp, Artificial Sequence
  Synthetic oligonucleotide
acacccatccgtatgagcccaatagcccagggccc

SEQ ID NO: 189452 - DNA, 35 bp, Artificial Sequence
  Synthetic oligonucleotide
atgtccgcagctggttctctatctccccggccgcc

SEQ ID NO: 189453 - DNA, 35 bp, Artificial Sequence
  Synthetic oligonucleotide
tgaacctcccatgccaatagctgcacccaagggcc

SEQ ID NO: 189454 - DNA, 35 bp, Artificial Sequence
  Synthetic oligonucleotide
gccatgcccgccggtccgtccgtctctccgttgcc

SEQ ID NO: 189455 - DNA, 35 bp, Artificial Sequence
  Synthetic oligonucleotide
tccccaacgcagcggtattccatttatcgtttgcc

SEQ ID NO: 189456 - DNA, 35 bp, Artificial Sequence
  Synthetic oligonucleotide
gcaccgaggatactcttgtcatgctgttcccctcc

SEQ ID NO: 189457 - DNA, 35 bp, Artificial Sequence
  Synthetic oligonucleotide
tgcgctctatgcgtttaatcgcctccatattctcc

SEQ ID NO: 189458 - DNA, 35 bp, Artificial Sequence
  Synthetic oligonucleotide
tgctcccctcagtccgcctttgattcccgttctcc

SEQ ID NO: 189459 - DNA, 35 bp, Artificial Sequence
  Synthetic oligonucleotide
tgcgaccgagccctctgacatattcttcgcagtcc

SEQ ID NO: 189460 - DNA, 35 bp, Artificial Sequence
  Synthetic oligonucleotide
gattgccccctcctccgtatcttgagtggtcttcc

SEQ ID NO: 189461 - DNA, 35 bp, Artificial Sequence
  Synthetic oligonucleotide
ggatcaccctgttactactgccgccccatggttcc

SEQ ID NO: 189462 - DNA, 31 bp, Artificial Sequence
  Synthetic oligonucleotide
aagcaaagagcgtcccccgccccgcccccgc

SEQ ID NO: 189463 - DNA, 36 bp, Artificial Sequence
  Synthetic oligonucleotide
tcgatagcactcatggctctcgcgttgactccccgc

SEQ ID NO: 189464 - DNA, 35 bp, Artificial Sequence
  Synthetic oligonucleotide
ttctacgcgtaggtcgccctcctacaccacttcgc

SEQ ID NO: 189465 - DNA, 35 bp, Artificial Sequence
  Synthetic oligonucleotide
taggtaagcatctctgtctccattcgtcctttcgc

SEQ ID NO: 189466 - DNA, 35 bp, Artificial Sequence
  Synthetic oligonucleotide
gagggtgggaggcgggtataattgcgcatggatgc

SEQ ID NO: 189467 - DNA, 35 bp, Artificial Sequence
  Synthetic oligonucleotide
gaggggggtgtagagggggtggtatgagtgactgc

SEQ ID NO: 189468 - DNA, 35 bp, Artificial Sequence
  Synthetic oligonucleotide
tgcgaaagacaacaagcgtacacctgaccccctgc

SEQ ID NO: 189469 - DNA, 35 bp, Artificial Sequence
  Synthetic oligonucleotide
gtcgtacaacactccagccgcaccacgctccctgc

SEQ ID NO: 189470 - DNA, 35 bp, Artificial Sequence
  Synthetic oligonucleotide
atgccgaactatctcagccagctttatctccgtgc

SEQ ID NO: 189471 - DNA, 35 bp, Artificial Sequence
  Synthetic oligonucleotide
tgcacactactgacgtggactccctgactcccctc

SEQ ID NO: 189472 - DNA, 35 bp, Artificial Sequence
  Synthetic oligonucleotide
tcgtgctggtgcatgttcgctgattttcgttcctc

SEQ ID NO: 189473 - DNA, 35 bp, Artificial Sequence
  Synthetic oligonucleotide
acgacccatatggtgccacttttctccgtctgctc

SEQ ID NO: 189474 - DNA, 35 bp, Artificial Sequence
  Synthetic oligonucleotide
gccatcctgcaccaccatgtcagtattgacctctc

SEQ ID NO: 189475 - DNA, 35 bp, Artificial Sequence
  Synthetic oligonucleotide
ccgagcatggccactcgttcgtatttccttctctc

SEQ ID NO: 189476 - DNA, 35 bp, Artificial Sequence
  Synthetic oligonucleotide
aggtccggtcactgccatcactacccccttgattc

SEQ ID NO: 189477 - DNA, 35 bp, Artificial Sequence
  Synthetic oligonucleotide
tccgggcaactcgttcccagcctgactacgccttc

SEQ ID NO: 189478 - DNA, 35 bp, Artificial Sequence
  Synthetic oligonucleotide
acaacacatgatcaccgttcagctcctcccgtttc

SEQ ID NO: 189479 - DNA, 35 bp, Artificial Sequence
  Synthetic oligonucleotide
taccacttctgttcacctctgccatccttttgtag

SEQ ID NO: 189480 - DNA, 35 bp, Artificial Sequence
  Synthetic oligonucleotide
aacccccgtaggcctttccgcacgtatttactacg

SEQ ID NO: 189481 - DNA, 35 bp, Artificial Sequence
  Synthetic oligonucleotide
actaacagacgtctccttcggccccatcgcatccg

SEQ ID NO: 189482 - DNA, 35 bp, Artificial Sequence
  Synthetic oligonucleotide
ggagaccccgaccgtatccctatcccgtttaatcg

SEQ ID NO: 189483 - DNA, 35 bp, Artificial Sequence
  Synthetic oligonucleotide
gtctagaggaggaggcttgggcagggggaggatcg

SEQ ID NO: 189484 - DNA, 35 bp, Artificial Sequence
  Synthetic oligonucleotide
tatggggggggcaaggcgagatccagggataaggg

SEQ ID NO: 189485 - DNA, 35 bp, Artificial Sequence
  Synthetic oligonucleotide
gccagggggagggagcctagcggactgggcgaggg

SEQ ID NO: 189486 - DNA, 35 bp, Artificial Sequence
  Synthetic oligonucleotide
gtaggaaggaggagcgggggccgagcacgcgtatg

SEQ ID NO: 189487 - DNA, 35 bp, Artificial Sequence
  Synthetic oligonucleotide
tcatacgccatctctattaccgtttactgccactg

SEQ ID NO: 189488 - DNA, 35 bp, Artificial Sequence
  Synthetic oligonucleotide
ggtaaagggaaggagtagaagggaaaatgaggcat

SEQ ID NO: 189489 - DNA, 35 bp, Artificial Sequence
  Synthetic oligonucleotide
gccctccgtacccgcccttgttcttgggcccgact

SEQ ID NO: 189490 - DNA, 34 bp, Artificial Sequence
  Synthetic oligonucleotide
atgatgccgcccctgatgtagcacttttccccct

SEQ ID NO: 189491 - DNA, 35 bp, Artificial Sequence
  Synthetic oligonucleotide
gcaggcccagaacgtcggccctcgttattttccct

SEQ ID NO: 189492 - DNA, 35 bp, Artificial Sequence
  Synthetic oligonucleotide
tatccatccttcgctctgttgtttccgatctgcct

SEQ ID NO: 189493 - DNA, 35 bp, Artificial Sequence
  Synthetic oligonucleotide
tcactccgcgctccattagtacaagttctcgtcct

SEQ ID NO: 189494 - DNA, 35 bp, Artificial Sequence
  Synthetic oligonucleotide
cactgggtgaagggtgggcggggagaagacattct

SEQ ID NO: 189495 - DNA, 35 bp, Artificial Sequence
  Synthetic oligonucleotide
tcccccccgccacctcggaatgttgtacggtttct

SEQ ID NO: 189496 - DNA, 35 bp, Artificial Sequence
  Synthetic oligonucleotide
gtccacccgtcaccctattcgcgctcaagccacgt

SEQ ID NO: 189497 - DNA, 35 bp, Artificial Sequence
  Synthetic oligonucleotide
acagatgggaccggaagccggatagggggggtggt

SEQ ID NO: 189498 - DNA, 35 bp, Artificial Sequence
  Synthetic oligonucleotide
gccacgtcccgtcgtcgttccaactggtttttggt

SEQ ID NO: 189499 - DNA, 35 bp, Artificial Sequence
  Synthetic oligonucleotide
gcaccctcgttccttgttgttgacttgtcatctgt

SEQ ID NO: 189500 - DNA, 35 bp, Artificial Sequence
  Synthetic oligonucleotide
tcaagtcacgccgcgatctctctgctattctctgt

SEQ ID NO: 189501 - DNA, 35 bp, Artificial Sequence
  Synthetic oligonucleotide
gatcgcatgtgcctattatcacccccccctacatt

SEQ ID NO: 189502 - DNA, 35 bp, Artificial Sequence
  Synthetic oligonucleotide
agtcctcccttgctctgtttaagcctcctccgatt

SEQ ID NO: 189503 - DNA, 35 bp, Artificial Sequence
  Synthetic oligonucleotide
ttgtacgcagtgagcgtgtcattctctcgttcctt

SEQ ID NO: 189504 - DNA, 35 bp, Artificial Sequence
  Synthetic oligonucleotide
aacgccccatctatgtctcttgattcttgctgctt

SEQ ID NO: 189505 - DNA, 35 bp, Artificial Sequence
  Synthetic oligonucleotide
gccctccccgctgatccatcgattttttacctctt

SEQ ID NO: 189506 - DNA, 35 bp, Artificial Sequence
  Synthetic oligonucleotide
gtccatgtcagccatgattctatccggtccacgtt

SEQ ID NO: 189507 - DNA, 35 bp, Artificial Sequence
  Synthetic oligonucleotide
ggatcaacgtcactcacccaggtcgcctccatgtt

SEQ ID NO: 189508 - DNA, 35 bp, Artificial Sequence
  Synthetic oligonucleotide
gccgtgccccagttcctttagtccagctccctgtt

SEQ ID NO: 189509 - DNA, 36 bp, Artificial Sequence
  Synthetic oligonucleotide
acccactcatctgctccgccacagttacaatcataa

SEQ ID NO: 189510 - DNA, 36 bp, Artificial Sequence
  Synthetic oligonucleotide
gcatcctgctctatccacccacggacgtccttacca

SEQ ID NO: 189511 - DNA, 36 bp, Artificial Sequence
  Synthetic oligonucleotide
tgtcgcccccgcatcttgaatggaacctcgccgcca

SEQ ID NO: 189512 - DNA, 36 bp, Artificial Sequence
  Synthetic oligonucleotide
tcactgcccggccgtctgtttctatctcacttgcca

SEQ ID NO: 189513 - DNA, 35 bp, Artificial Sequence
  Synthetic oligonucleotide
tgatgcatagcacctgccctctttaatggtctcca

SEQ ID NO: 189514 - DNA, 35 bp, Artificial Sequence
  Synthetic oligonucleotide
ttcctgcccccgccacgtagtttgactcgcttcca

SEQ ID NO: 189515 - DNA, 36 bp, Artificial Sequence
  Synthetic oligonucleotide
agcaaccccgtaaattggccgccttgttctgttcca

SEQ ID NO: 189516 - DNA, 36 bp, Artificial Sequence
  Synthetic oligonucleotide
ttcgcctccttccttcgcactcgcgactgtctcgca

SEQ ID NO: 189517 - DNA, 36 bp, Artificial Sequence
  Synthetic oligonucleotide
gaagacgagggacataagatagggggagggtttgca

SEQ ID NO: 189518 - DNA, 36 bp, Artificial Sequence
  Synthetic oligonucleotide
gtacccatcgttgcatgccgccctattcgcacatca

SEQ ID NO: 189519 - DNA, 34 bp, Artificial Sequence
  Synthetic oligonucleotide
tgtgacaccctcacgccacgccttgacgccctca

SEQ ID NO: 189520 - DNA, 35 bp, Artificial Sequence
  Synthetic oligonucleotide
gtgacaagaaagggtaggggggcactggcgggtca

SEQ ID NO: 189521 - DNA, 36 bp, Artificial Sequence
  Synthetic oligonucleotide
aactcatggcggaggagggggtcctgggtggtgtca

SEQ ID NO: 189522 - DNA, 36 bp, Artificial Sequence
  Synthetic oligonucleotide
tcgccattctctactacatgtattgttcgcctttca

SEQ ID NO: 189523 - DNA, 37 bp, Artificial Sequence
  Synthetic oligonucleotide
aagggggaaggaaggacgggggggccggggtaggaga

SEQ ID NO: 189524 - DNA, 36 bp, Artificial Sequence
  Synthetic oligonucleotide
gagagggaggggtgcatttcacagggcttcgggaga

SEQ ID NO: 189525 - DNA, 36 bp, Artificial Sequence
  Synthetic oligonucleotide
accgctccctccctactgtgcaggccgatacaacga

SEQ ID NO: 189526 - DNA, 36 bp, Artificial Sequence
  Synthetic oligonucleotide
ttcgccccctcgttactgttacttatacgtacccga

SEQ ID NO: 189527 - DNA, 37 bp, Artificial Sequence
  Synthetic oligonucleotide
tcgacaattcgatgcatgtactacaccctccccccga

SEQ ID NO: 189528 - DNA, 35 bp, Artificial Sequence
  Synthetic oligonucleotide
attccttccccagttgccgatagccatttgcccga

SEQ ID NO: 189529 - DNA, 36 bp, Artificial Sequence
  Synthetic oligonucleotide
gttgcatgtagtcccgtttgagcccccccatgccga

SEQ ID NO: 189530 - DNA, 37 bp, Artificial Sequence
  Synthetic oligonucleotide
acttgcactcgccatccttgtacaaaaatcacctcga

SEQ ID NO: 189531 - DNA, 37 bp, Artificial Sequence
  Synthetic oligonucleotide
tcattcctgccgtcgcgttatcgcgtcaatctctcga

SEQ ID NO: 189532 - DNA, 37 bp, Artificial Sequence
  Synthetic oligonucleotide
tgacagaactccagcgtgcgttctcctgttctctcga

SEQ ID NO: 189533 - DNA, 35 bp, Artificial Sequence
  Synthetic oligonucleotide
tgctgtccgcatatacactctcgcttttccttcga

SEQ ID NO: 189534 - DNA, 34 bp, Artificial Sequence
  Synthetic oligonucleotide
tctggggagggaggccgggagtaagcagggagga

SEQ ID NO: 189535 - DNA, 37 bp, Artificial Sequence
  Synthetic oligonucleotide
gggggggaaatgacgagtgacaaggggatggtgagga

SEQ ID NO: 189536 - DNA, 37 bp, Artificial Sequence
  Synthetic oligonucleotide
agagccaggcagggaagtgggcaatggacggggggga

SEQ ID NO: 189537 - DNA, 37 bp, Artificial Sequence
  Synthetic oligonucleotide
gccctctccccgcaaatgctcgtacttcctcctggga

SEQ ID NO: 189538 - DNA, 37 bp, Artificial Sequence
  Synthetic oligonucleotide
tgcccgctcccctcgctagtattcgtatccatctgga

SEQ ID NO: 189539 - DNA, 38 bp, Artificial Sequence
  Synthetic oligonucleotide
agtggccccttaccctcctgcctagaccctgtccatga

SEQ ID NO: 189540 - DNA, 38 bp, Artificial Sequence
  Synthetic oligonucleotide
tcgcacctctccacatctgccggagctaatctacctga

SEQ ID NO: 189541 - DNA, 38 bp, Artificial Sequence
  Synthetic oligonucleotide
gatacccgcccgagctggcccttaatgtctggtgctga

SEQ ID NO: 189542 - DNA, 38 bp, Artificial Sequence
  Synthetic oligonucleotide
gcccacgccctcccggtctagatagcacgcgcccgtga

SEQ ID NO: 189543 - DNA, 38 bp, Artificial Sequence
  Synthetic oligonucleotide
tcacctcgcgactgccctccactcaccaccatgcgtga

SEQ ID NO: 189544 - DNA, 38 bp, Artificial Sequence
  Synthetic oligonucleotide
tcccgcatgccgccgcacctcccatactcaagtcgtga

SEQ ID NO: 189545 - DNA, 34 bp, Artificial Sequence
  Synthetic oligonucleotide
aaacaggaacgggtggcctggagtaaaggggtga

SEQ ID NO: 189546 - DNA, 38 bp, Artificial Sequence
  Synthetic oligonucleotide
gactagaggaggggtgttaggcggggcaggtcgtgtga

SEQ ID NO: 189547 - DNA, 38 bp, Artificial Sequence
  Synthetic oligonucleotide
gagagagctaagagaggagggcgggactatgggtgtga

SEQ ID NO: 189548 - DNA, 38 bp, Artificial Sequence
  Synthetic oligonucleotide
acgaccccccctttcaaccgtgccttcactctgtgtga

SEQ ID NO: 189549 - DNA, 38 bp, Artificial Sequence
  Synthetic oligonucleotide
tctcagcctccccgttcatgtttctgcgtacaccttga

SEQ ID NO: 189550 - DNA, 38 bp, Artificial Sequence
  Synthetic oligonucleotide
gattcccccctccgccatgtatttcaaaacgtgcttga

SEQ ID NO: 189551 - DNA, 37 bp, Artificial Sequence
  Synthetic oligonucleotide
ggtgggtagaagacggaggtgcgagcgggagggttga

SEQ ID NO: 189552 - DNA, 37 bp, Artificial Sequence
  Synthetic oligonucleotide
agccatgccacgacgtttcgcccacctgccgctttga

SEQ ID NO: 189553 - DNA, 37 bp, Artificial Sequence
  Synthetic oligonucleotide
tcacactgctgttgcaaccactccccactctgtttga

SEQ ID NO: 189554 - DNA, 37 bp, Artificial Sequence
  Synthetic oligonucleotide
acctacacgtccgttgcctgatccatacctcttttga

SEQ ID NO: 189555 - DNA, 36 bp, Artificial Sequence
  Synthetic oligonucleotide
tctacgcgcaactggccgcgctatccctcccttata

SEQ ID NO: 189556 - DNA, 36 bp, Artificial Sequence
  Synthetic oligonucleotide
gtaccgtacaggtttgttgtccacccaccgctccta

SEQ ID NO: 189557 - DNA, 35 bp, Artificial Sequence
  Synthetic oligonucleotide
ttcgtctgtgtggtcctgcccctgtctttctgcta

SEQ ID NO: 189558 - DNA, 35 bp, Artificial Sequence
  Synthetic oligonucleotide
accaggccacgccctcctgcttacatggccatcta

SEQ ID NO: 189559 - DNA, 36 bp, Artificial Sequence
  Synthetic oligonucleotide
atggcctgacaccgtacgccatccgttccttctcta

SEQ ID NO: 189560 - DNA, 36 bp, Artificial Sequence
  Synthetic oligonucleotide
tgtacccgaacttggttcagccacaccacactagta

SEQ ID NO: 189561 - DNA, 35 bp, Artificial Sequence
  Synthetic oligonucleotide
ttaccaccgctactctcttcccctgtaccatcgta

SEQ ID NO: 189562 - DNA, 35 bp, Artificial Sequence
  Synthetic oligonucleotide
ttccgtccttccgctctgatccacggcctccggta

SEQ ID NO: 189563 - DNA, 36 bp, Artificial Sequence
  Synthetic oligonucleotide
gccatggggccccattcatgttctcctgacctggta

SEQ ID NO: 189564 - DNA, 36 bp, Artificial Sequence
  Synthetic oligonucleotide
tcagtcgtggggtgtggagggtgggtaggtatgtta

SEQ ID NO: 189565 - DNA, 35 bp, Artificial Sequence
  Synthetic oligonucleotide
gccatggttcaaactgccaagcccttcgacctaac

SEQ ID NO: 189566 - DNA, 35 bp, Artificial Sequence
  Synthetic oligonucleotide
tcagacgccatgtctgattctctatcttgcatcac

SEQ ID NO: 189567 - DNA, 35 bp, Artificial Sequence
  Synthetic oligonucleotide
gttcgccccttgccttcgccccattgtccgctgac

SEQ ID NO: 189568 - DNA, 35 bp, Artificial Sequence
  Synthetic oligonucleotide
gaatgagccacccgaggtcccatgtcctatcaacc

SEQ ID NO: 189569 - DNA, 35 bp, Artificial Sequence
  Synthetic oligonucleotide
ttaccctgcactcgtttagcctattcgccgtaacc

SEQ ID NO: 189570 - DNA, 35 bp, Artificial Sequence
  Synthetic oligonucleotide
gcgaagcactgtgcttggcaagcactttcaccacc

SEQ ID NO: 189571 - DNA, 34 bp, Artificial Sequence
  Synthetic oligonucleotide
tcatgtgctcctttatgcttcggtcccgattacc

SEQ ID NO: 189572 - DNA, 35 bp, Artificial Sequence
  Synthetic oligonucleotide
ttggttaagcgctttttcgatatgtctccctcccc

SEQ ID NO: 189573 - DNA, 35 bp, Artificial Sequence
  Synthetic oligonucleotide
ggatcacccgcaattctttgagccatgttgcgccc

SEQ ID NO: 189574 - DNA, 35 bp, Artificial Sequence
  Synthetic oligonucleotide
ttggaactggctagtcttatcaccatcgcgctccc

SEQ ID NO: 189575 - DNA, 35 bp, Artificial Sequence
  Synthetic oligonucleotide
gtaaaccaccgcctcgatcctcccatttgttagcc

SEQ ID NO: 189576 - DNA, 35 bp, Artificial Sequence
  Synthetic oligonucleotide
tttcgaacaacgctgccctttctatatgcaccgcc

SEQ ID NO: 189577 - DNA, 35 bp, Artificial Sequence
  Synthetic oligonucleotide
taaatcaccggctgagaaatacactcgtccccgcc

SEQ ID NO: 189578 - DNA, 35 bp, Artificial Sequence
  Synthetic oligonucleotide
gctaagccgtaaagcactattcccctgtctccgcc

SEQ ID NO: 189579 - DNA, 35 bp, Artificial Sequence
  Synthetic oligonucleotide
gaagaccgccctcccccactcgacataatgaggcc

SEQ ID NO: 189580 - DNA, 35 bp, Artificial Sequence
  Synthetic oligonucleotide
gcaatcttaacgcatgccgcccttgaccctttgcc

SEQ ID NO: 189581 - DNA, 35 bp, Artificial Sequence
  Synthetic oligonucleotide
gtcacgccaggcctggctcttatttcgtccgctcc

SEQ ID NO: 189582 - DNA, 35 bp, Artificial Sequence
  Synthetic oligonucleotide
tcactgccccagctgtctccgatcggccccattcc

SEQ ID NO: 189583 - DNA, 35 bp, Artificial Sequence
  Synthetic oligonucleotide
gagacgcctgtggtctcaaagtaatcgctccttcc

SEQ ID NO: 189584 - DNA, 35 bp, Artificial Sequence
  Synthetic oligonucleotide
gtgctggcctctggattgcgctccctcgtccttcc

SEQ ID NO: 189585 - DNA, 35 bp, Artificial Sequence
  Synthetic oligonucleotide
atcgctcacaccaccttcagcaagcgccgtcttcc

SEQ ID NO: 189586 - DNA, 35 bp, Artificial Sequence
  Synthetic oligonucleotide
taggcccctcgccgtccgatttccccgtactttcc

SEQ ID NO: 189587 - DNA, 35 bp, Artificial Sequence
  Synthetic oligonucleotide
tcacccaccattagcattgcggccctgcctggggc

SEQ ID NO: 189588 - DNA, 34 bp, Artificial Sequence
  Synthetic oligonucleotide
acaccacctcaccatctgtgcttcttaccctggc

SEQ ID NO: 189589 - DNA, 35 bp, Artificial Sequence
  Synthetic oligonucleotide
aatcccccacgttagctcgaacccagctcgcctgc

SEQ ID NO: 189590 - DNA, 35 bp, Artificial Sequence
  Synthetic oligonucleotide
ggttcaccacgtccctcacgtcatcttcccagtgc

SEQ ID NO: 189591 - DNA, 35 bp, Artificial Sequence
  Synthetic oligonucleotide
attgtcgcaagtaaccgttccccccgttttcgtgc

SEQ ID NO: 189592 - DNA, 35 bp, Artificial Sequence
  Synthetic oligonucleotide
acccactgaatctcttgcttgtttggaccctttgc

SEQ ID NO: 189593 - DNA, 35 bp, Artificial Sequence
  Synthetic oligonucleotide
gaaggtcaggggtccaccgccgccaatgtaacatc

SEQ ID NO: 189594 - DNA, 35 bp, Artificial Sequence
  Synthetic oligonucleotide
ttcgatcaacctcgtagcgggtattgcaatccatc

SEQ ID NO: 189595 - DNA, 35 bp, Artificial Sequence
  Synthetic oligonucleotide
atccaccccctctgatgaatacggctcaattcatc

SEQ ID NO: 189596 - DNA, 35 bp, Artificial Sequence
  Synthetic oligonucleotide
tccccacgccccggtgtctcacacctaggctactc

SEQ ID NO: 189597 - DNA, 35 bp, Artificial Sequence
  Synthetic oligonucleotide
ggaggccgcctcaccatacgttccccgacaacctc

SEQ ID NO: 189598 - DNA, 35 bp, Artificial Sequence
  Synthetic oligonucleotide
gaagccactctagtatagtcatcgaccacgccctc

SEQ ID NO: 189599 - DNA, 35 bp, Artificial Sequence
  Synthetic oligonucleotide
tttgcactgcactcctgcccctgtcgtaggccctc

SEQ ID NO: 189600 - DNA, 35 bp, Artificial Sequence
  Synthetic oligonucleotide
tgctttgcagtacgcctctgttcactcatatcctc

SEQ ID NO: 189601 - DNA, 36 bp, Artificial Sequence
  Synthetic oligonucleotide
gtaccgcccaattatttaagcacgaccactaccgtc

SEQ ID NO: 189602 - DNA, 35 bp, Artificial Sequence
  Synthetic oligonucleotide
aagtcaacaacgttgcctatactgccttttttgtc

SEQ ID NO: 189603 - DNA, 35 bp, Artificial Sequence
  Synthetic oligonucleotide
aaaccacagcgtagcgtgggattttgcctctcttc

SEQ ID NO: 189604 - DNA, 35 bp, Artificial Sequence
  Synthetic oligonucleotide
gtgtgtcccgcctcgtgttcggtccatatacgttc

SEQ ID NO: 189605 - DNA, 35 bp, Artificial Sequence
  Synthetic oligonucleotide
tgtgccgggtctctttccgttgtgcccttcctttc

SEQ ID NO: 189606 - DNA, 35 bp, Artificial Sequence
  Synthetic oligonucleotide
aacgagggacagcattctaataacctgcttctttc

SEQ ID NO: 189607 - DNA, 35 bp, Artificial Sequence
  Synthetic oligonucleotide
gtaccatcccgcccattgccttcgtagcacttttc

SEQ ID NO: 189608 - DNA, 35 bp, Artificial Sequence
  Synthetic oligonucleotide
gtcgtcgatactgcccggctcccctctcgcgcaag

SEQ ID NO: 189609 - DNA, 35 bp, Artificial Sequence
  Synthetic oligonucleotide
ggggcgaaggggcggcggtaactataaagggccag

SEQ ID NO: 189610 - DNA, 35 bp, Artificial Sequence
  Synthetic oligonucleotide
tcccgccgccccatctttgcatatgccctgccacg

SEQ ID NO: 189611 - DNA, 35 bp, Artificial Sequence
  Synthetic oligonucleotide
tatcacctctgtgtgcgcctaggcccgaatccccg

SEQ ID NO: 189612 - DNA, 35 bp, Artificial Sequence
  Synthetic oligonucleotide
actgccccctagttcgacgtgctttgtctcttccg

SEQ ID NO: 189613 - DNA, 35 bp, Artificial Sequence
  Synthetic oligonucleotide
gcacctccccccctgccgtgaatttagctaccgcg

SEQ ID NO: 189614 - DNA, 35 bp, Artificial Sequence
  Synthetic oligonucleotide
acacccgtaccttatttatacattgccccttctcg

SEQ ID NO: 189615 - DNA, 35 bp, Artificial Sequence
  Synthetic oligonucleotide
gcatgggtaagggtggatgggagggatcctgaagg

SEQ ID NO: 189616 - DNA, 35 bp, Artificial Sequence
  Synthetic oligonucleotide
tggaggggggggatcggtttaggaggggctctcgg

SEQ ID NO: 189617 - DNA, 35 bp, Artificial Sequence
  Synthetic oligonucleotide
gtgaggcagaggggggcgtaaatgtcgagggaggg

SEQ ID NO: 189618 - DNA, 35 bp, Artificial Sequence
  Synthetic oligonucleotide
atccatcctacattcgcagcctcatccttttcggg

SEQ ID NO: 189619 - DNA, 35 bp, Artificial Sequence
  Synthetic oligonucleotide
gtagtgccgtgaggtggaaaaggggagagatgtgg

SEQ ID NO: 189620 - DNA, 35 bp, Artificial Sequence
  Synthetic oligonucleotide
aaccccacctctgaaggtagtcattgtcccccatg

SEQ ID NO: 189621 - DNA, 35 bp, Artificial Sequence
  Synthetic oligonucleotide
gtccacctccctattgtccgtataaatctacgctg

SEQ ID NO: 189622 - DNA, 35 bp, Artificial Sequence
  Synthetic oligonucleotide
acgacgggggagggcgaaaggaaacatggctcgtg

SEQ ID NO: 189623 - DNA, 35 bp, Artificial Sequence
  Synthetic oligonucleotide
gtgtgtgctaccgccccgtacttgacccccatgtg

SEQ ID NO: 189624 - DNA, 35 bp, Artificial Sequence
  Synthetic oligonucleotide
cacgtcacatcttgttgcctcgcctcccctcgtat

SEQ ID NO: 189625 - DNA, 35 bp, Artificial Sequence
  Synthetic oligonucleotide
aatcccaccctccgttccctcatcagcgaaggtat

SEQ ID NO: 189626 - DNA, 35 bp, Artificial Sequence
  Synthetic oligonucleotide
gttaacctccctgttgtgccatggcttcccttact

SEQ ID NO: 189627 - DNA, 35 bp, Artificial Sequence
  Synthetic oligonucleotide
tacgtacgttgtcctcttcctgcctggcttgacct

SEQ ID NO: 189628 - DNA, 36 bp, Artificial Sequence
  Synthetic oligonucleotide
gtgtatgccgccgtactgtccgctcttggtgcccct

SEQ ID NO: 189629 - DNA, 35 bp, Artificial Sequence
  Synthetic oligonucleotide
tgcagtgccagagtctcactgcagccgttcgccct

SEQ ID NO: 189630 - DNA, 35 bp, Artificial Sequence
  Synthetic oligonucleotide
ttgcggaatgtcgcccgcttgatccagtacttcct

SEQ ID NO: 189631 - DNA, 35 bp, Artificial Sequence
  Synthetic oligonucleotide
gaccgtgctccgtatcgcacccttctcttgttcct

SEQ ID NO: 189632 - DNA, 36 bp, Artificial Sequence
  Synthetic oligonucleotide
tcgacgtctcgggtacgagtgcatcgctcccactct

SEQ ID NO: 189633 - DNA, 35 bp, Artificial Sequence
  Synthetic oligonucleotide
ctagtacccaccgatgcaggtattacatcttctct

SEQ ID NO: 189634 - DNA, 34 bp, Artificial Sequence
  Synthetic oligonucleotide
ttcgccgccccattgcttgttccatccgtcttct

SEQ ID NO: 189635 - DNA, 35 bp, Artificial Sequence
  Synthetic oligonucleotide
tgtgtatcgcacctcttgatcccgccgaccgttct

SEQ ID NO: 189636 - DNA, 35 bp, Artificial Sequence
  Synthetic oligonucleotide
gataccgggagtggcgggtgggcggagtgttaggt

SEQ ID NO: 189637 - DNA, 35 bp, Artificial Sequence
  Synthetic oligonucleotide
tctacccctcgttggtccttctcgccgcccgcggt

SEQ ID NO: 189638 - DNA, 35 bp, Artificial Sequence
  Synthetic oligonucleotide
acacagtggtgacgcgctcccctgccctatatggt

SEQ ID NO: 189639 - DNA, 35 bp, Artificial Sequence
  Synthetic oligonucleotide
accatcatctgttgctttagttttttccacattgt

SEQ ID NO: 189640 - DNA, 35 bp, Artificial Sequence
  Synthetic oligonucleotide
gggtgatcgcagcttagcctggtctcccctacctt

SEQ ID NO: 189641 - DNA, 35 bp, Artificial Sequence
  Synthetic oligonucleotide
tcccccgccgcattactaggccctctttcatcctt

SEQ ID NO: 189642 - DNA, 35 bp, Artificial Sequence
  Synthetic oligonucleotide
gtgcacgcacctgcctttacccggccccactgctt

SEQ ID NO: 189643 - DNA, 35 bp, Artificial Sequence
  Synthetic oligonucleotide
ataacacctctcgcataatgatccaccatggagtt

SEQ ID NO: 189644 - DNA, 34 bp, Artificial Sequence
  Synthetic oligonucleotide
tagccgcatcgcatcgtcaaccgtgctccctgtt

SEQ ID NO: 189645 - DNA, 35 bp, Artificial Sequence
  Synthetic oligonucleotide
gtgaaccgctgccgaacacctttgcctactcgttt

SEQ ID NO: 189646 - DNA, 34 bp, Artificial Sequence
  Synthetic oligonucleotide
ggaaccccctccatacctgcatacggacctccaa

SEQ ID NO: 189647 - DNA, 35 bp, Artificial Sequence
  Synthetic oligonucleotide
agtagagggggacaggggaaaggcaagacgtgcaa

SEQ ID NO: 189648 - DNA, 35 bp, Artificial Sequence
  Synthetic oligonucleotide
tcaagggcggtacatgggtacgggggggtagagaa

SEQ ID NO: 189649 - DNA, 36 bp, Artificial Sequence
  Synthetic oligonucleotide
gccatccccggtacgatctctattttgttcacctaa

SEQ ID NO: 189650 - DNA, 36 bp, Artificial Sequence
  Synthetic oligonucleotide
tgtcccagtcacacgctccatccgttctactcttaa

SEQ ID NO: 189651 - DNA, 36 bp, Artificial Sequence
  Synthetic oligonucleotide
gtcgcataactcagcctgttgcgcacgtactcccca

SEQ ID NO: 189652 - DNA, 35 bp, Artificial Sequence
  Synthetic oligonucleotide
gatacttgaggcacatgtgatcgcgcccttcccca

SEQ ID NO: 189653 - DNA, 35 bp, Artificial Sequence
  Synthetic oligonucleotide
acacccgcaccgacccgtcatttcgtagtatccca

SEQ ID NO: 189654 - DNA, 36 bp, Artificial Sequence
  Synthetic oligonucleotide
atctgccacaccggtcactttgcgataactacgcca

SEQ ID NO: 189655 - DNA, 35 bp, Artificial Sequence
  Synthetic oligonucleotide
tccctcccccgctccttctgcattacagcttgcca

SEQ ID NO: 189656 - DNA, 36 bp, Artificial Sequence
  Synthetic oligonucleotide
tgaggcctccctacgtatggtcatatcctccatcca

SEQ ID NO: 189657 - DNA, 35 bp, Artificial Sequence
  Synthetic oligonucleotide
tagccgcccccatgactgcctacaatgcctatcca

SEQ ID NO: 189658 - DNA, 35 bp, Artificial Sequence
  Synthetic oligonucleotide
ggtccacctaacgagtgtagcttcccccccttcca

SEQ ID NO: 189659 - DNA, 37 bp, Artificial Sequence
  Synthetic oligonucleotide
tgcgctcactcgcgggagggggggcgtggtatttcca

SEQ ID NO: 189660 - DNA, 35 bp, Artificial Sequence
  Synthetic oligonucleotide
tatgacacctcgctgcttatctaagaaaaccatca

SEQ ID NO: 189661 - DNA, 35 bp, Artificial Sequence
  Synthetic oligonucleotide
acatccgttgctggcacttaacactggccctatca

SEQ ID NO: 189662 - DNA, 36 bp, Artificial Sequence
  Synthetic oligonucleotide
gtgtaccggcgtatgatcacacacgtttccccctca

SEQ ID NO: 189663 - DNA, 36 bp, Artificial Sequence
  Synthetic oligonucleotide
gatgtggcatcgtgttttcggccaccctctgtctca

SEQ ID NO: 189664 - DNA, 33 bp, Artificial Sequence
  Synthetic oligonucleotide
ttcatcatagacctgcccgtgctctagttctca

SEQ ID NO: 189665 - DNA, 35 bp, Artificial Sequence
  Synthetic oligonucleotide
tctggtgccatccgttccaattgagtttccgttca

SEQ ID NO: 189666 - DNA, 37 bp, Artificial Sequence
  Synthetic oligonucleotide
actgttgaagacgtaggaggaagggggaggacgcaga

SEQ ID NO: 189667 - DNA, 37 bp, Artificial Sequence
  Synthetic oligonucleotide
aagacgggaagggagttgagggagcgcgcaagtgaga

SEQ ID NO: 189668 - DNA, 37 bp, Artificial Sequence
  Synthetic oligonucleotide
gacagttagagagcacgaaagggagggagagtgtaga

SEQ ID NO: 189669 - DNA, 37 bp, Artificial Sequence
  Synthetic oligonucleotide
tttgggccgtccgtgcttcattcccctgcctctacga

SEQ ID NO: 189670 - DNA, 36 bp, Artificial Sequence
  Synthetic oligonucleotide
agcaccaaccctatgcctaccagtgccattctacga

SEQ ID NO: 189671 - DNA, 35 bp, Artificial Sequence
  Synthetic oligonucleotide
tacgggcatacctcacgccgatcttcctcttacga

SEQ ID NO: 189672 - DNA, 36 bp, Artificial Sequence
  Synthetic oligonucleotide
tctcacgcgcacttcatccgaccctccgaggcccga

SEQ ID NO: 189673 - DNA, 37 bp, Artificial Sequence
  Synthetic oligonucleotide
gttgccgtctaactctccgcccgtcccatcacgccga

SEQ ID NO: 189674 - DNA, 35 bp, Artificial Sequence
  Synthetic oligonucleotide
acgtaccagccgatccaccatcgttcccgttccga

SEQ ID NO: 189675 - DNA, 37 bp, Artificial Sequence
  Synthetic oligonucleotide
atcgctgccactggccctgacttgatcactcttgcga

SEQ ID NO: 189676 - DNA, 37 bp, Artificial Sequence
  Synthetic oligonucleotide
gcatcaccatgtcccatgcgtccaaccgtaacatcga

SEQ ID NO: 189677 - DNA, 36 bp, Artificial Sequence
  Synthetic oligonucleotide
tgatgcgccccccgccgtgagtactcccaccctcga

SEQ ID NO: 189678 - DNA, 36 bp, Artificial Sequence
  Synthetic oligonucleotide
gggaagagtgacggaggggaaatagcgccgcgtcga

SEQ ID NO: 189679 - DNA, 37 bp, Artificial Sequence
  Synthetic oligonucleotide
atggaaagtggagagggggaggaacggcgcataagga

SEQ ID NO: 189680 - DNA, 36 bp, Artificial Sequence
  Synthetic oligonucleotide
gggggtgggaaggagggcttagcaacatctagagga

SEQ ID NO: 189681 - DNA, 37 bp, Artificial Sequence
  Synthetic oligonucleotide
tcattcacccgccactgcctactgtggtctattagga

SEQ ID NO: 189682 - DNA, 37 bp, Artificial Sequence
  Synthetic oligonucleotide
agagacatgcaagtggaaggtttggggcgaggacgga

SEQ ID NO: 189683 - DNA, 35 bp, Artificial Sequence
  Synthetic oligonucleotide
gccatcctcgagccctgtcgcctaatcttgccgga

SEQ ID NO: 189684 - DNA, 37 bp, Artificial Sequence
  Synthetic oligonucleotide
attgagcaactcgtgctcccgttccacccctttcgga

SEQ ID NO: 189685 - DNA, 37 bp, Artificial Sequence
  Synthetic oligonucleotide
gatgctagcattggagaccgggggggtgcgggcggga

SEQ ID NO: 189686 - DNA, 37 bp, Artificial Sequence
  Synthetic oligonucleotide
gaagaggggcggaggacaactcattatgaggagggga

SEQ ID NO: 189687 - DNA, 36 bp, Artificial Sequence
  Synthetic oligonucleotide
aacgaagcgggggataggtcagagggtaggagggga

SEQ ID NO: 189688 - DNA, 37 bp, Artificial Sequence
  Synthetic oligonucleotide
tagcatggaagcaaggggggagcattaggatcgggga

SEQ ID NO: 189689 - DNA, 37 bp, Artificial Sequence
  Synthetic oligonucleotide
atgtgagtggggcatcgggaatggaacgggaggggga

SEQ ID NO: 189690 - DNA, 37 bp, Artificial Sequence
  Synthetic oligonucleotide
agggcgggaatgaggggggggagtaggttcgtatgga

SEQ ID NO: 189691 - DNA, 37 bp, Artificial Sequence
  Synthetic oligonucleotide
taggcgggggggtgtaaagagggcgaaaaggggtgga

SEQ ID NO: 189692 - DNA, 37 bp, Artificial Sequence
  Synthetic oligonucleotide
gagtgcaagagggtgaaggggttgctgacggattgga

SEQ ID NO: 189693 - DNA, 38 bp, Artificial Sequence
  Synthetic oligonucleotide
gagagaggtggaggtaaccggaggagaagttgaaatga

SEQ ID NO: 189694 - DNA, 38 bp, Artificial Sequence
  Synthetic oligonucleotide
tccgtccccgcctcgcatgatcttcgtgtgcaccatga

SEQ ID NO: 189695 - DNA, 38 bp, Artificial Sequence
  Synthetic oligonucleotide
tgtgacttgggctagggtggggagggagatcaccatga

SEQ ID NO: 189696 - DNA, 37 bp, Artificial Sequence
  Synthetic oligonucleotide
tgtccaccatcctgtccttccgatcacgtacgtatga

SEQ ID NO: 189697 - DNA, 38 bp, Artificial Sequence
  Synthetic oligonucleotide
accaccggctcctcttgttttggaaacctcccacctga

SEQ ID NO: 189698 - DNA, 38 bp, Artificial Sequence
  Synthetic oligonucleotide
actcagccctgctatatccgatactccctgccacctga

SEQ ID NO: 189699 - DNA, 36 bp, Artificial Sequence
  Synthetic oligonucleotide
tccgtagacacatcatgtaccttggacccctcctga

SEQ ID NO: 189700 - DNA, 38 bp, Artificial Sequence
  Synthetic oligonucleotide
gaccaaccgctgcttggataccgaaaccccccctctga

SEQ ID NO: 189701 - DNA, 38 bp, Artificial Sequence
  Synthetic oligonucleotide
acaccgccgttatgtgtacgaatatccaccttttctga

SEQ ID NO: 189702 - DNA, 36 bp, Artificial Sequence
  Synthetic oligonucleotide
tccaccactgcaactatcccttggccatcctcgtga

SEQ ID NO: 189703 - DNA, 38 bp, Artificial Sequence
  Synthetic oligonucleotide
aggacgagtgagcggaggggggccgggggaaacggtga

SEQ ID NO: 189704 - DNA, 38 bp, Artificial Sequence
  Synthetic oligonucleotide
ttgaccactgccattgccctcacatactccgcctgtga

SEQ ID NO: 189705 - DNA, 37 bp, Artificial Sequence
  Synthetic oligonucleotide
tgcccgaccgtccggctccgttccgaccccttattga

SEQ ID NO: 189706 - DNA, 38 bp, Artificial Sequence
  Synthetic oligonucleotide
atccaactccaaccggccattcatgtggacgcacttga

SEQ ID NO: 189707 - DNA, 38 bp, Artificial Sequence
  Synthetic oligonucleotide
gcgagcaagttggttcgcgtcgtcctctcttcacttga

SEQ ID NO: 189708 - DNA, 38 bp, Artificial Sequence
  Synthetic oligonucleotide
tcgttgtcctcgattgcctatcggttcatcctccttga

SEQ ID NO: 189709 - DNA, 38 bp, Artificial Sequence
  Synthetic oligonucleotide
atccatgtcgtgatgtgctcttcacctgcctttcttga

SEQ ID NO: 189710 - DNA, 38 bp, Artificial Sequence
  Synthetic oligonucleotide
gcgcatgcacggggctgagaagggagtgatagggttga

SEQ ID NO: 189711 - DNA, 38 bp, Artificial Sequence
  Synthetic oligonucleotide
gtggcctacctctgcatcccgttacgtttcacatttga

SEQ ID NO: 189712 - DNA, 35 bp, Artificial Sequence
  Synthetic oligonucleotide
ttgcaacaactgttcgttaccgtgccctgttcata

SEQ ID NO: 189713 - DNA, 36 bp, Artificial Sequence
  Synthetic oligonucleotide
tcaacagggcgggcggggggtgataaatgcgttata

SEQ ID NO: 189714 - DNA, 36 bp, Artificial Sequence
  Synthetic oligonucleotide
aatacgcttcccgcctgccacgttccatgccaacta

SEQ ID NO: 189715 - DNA, 36 bp, Artificial Sequence
  Synthetic oligonucleotide
gcccatgcccgaacgatagcccccgtagaatcccta

SEQ ID NO: 189716 - DNA, 36 bp, Artificial Sequence
  Synthetic oligonucleotide
tctactggtcagacatttcccatccacactgcgcta

SEQ ID NO: 189717 - DNA, 35 bp, Artificial Sequence
  Synthetic oligonucleotide
tccgctccagtattcaattgaacctccacgccgta

SEQ ID NO: 189718 - DNA, 35 bp, Artificial Sequence
  Synthetic oligonucleotide
actgcccccctgtcactgaccttcactaattcgta

SEQ ID NO: 189719 - DNA, 36 bp, Artificial Sequence
  Synthetic oligonucleotide
tgtcaccaccatctatatgaaccctcatttttcgta

SEQ ID NO: 189720 - DNA, 35 bp, Artificial Sequence
  Synthetic oligonucleotide
gttccgtcacgtcaccgcaaaggccgcccccctta

SEQ ID NO: 189721 - DNA, 36 bp, Artificial Sequence
  Synthetic oligonucleotide
agccccgctcctttgctatacgttgtttacctctta

SEQ ID NO: 189722 - DNA, 36 bp, Artificial Sequence
  Synthetic oligonucleotide
tcccccacccagtcgcgtttgcctataactgcgtta

SEQ ID NO: 189723 - DNA, 35 bp, Artificial Sequence
  Synthetic oligonucleotide
gatgtagcaggaagggggggatatggaacagcaac

SEQ ID NO: 189724 - DNA, 35 bp, Artificial Sequence
  Synthetic oligonucleotide
atcccatctgcctttgtgattttattacgctcaac

SEQ ID NO: 189725 - DNA, 35 bp, Artificial Sequence
  Synthetic oligonucleotide
ggggggggggggggggtagcacgagttggggccac

SEQ ID NO: 189726 - DNA, 35 bp, Artificial Sequence
  Synthetic oligonucleotide
tccccttgtccccccttgtaagccgtcgacctgac

SEQ ID NO: 189727 - DNA, 35 bp, Artificial Sequence
  Synthetic oligonucleotide
gacacaccctggcaatcgacaccggacccgcttac

SEQ ID NO: 189728 - DNA, 35 bp, Artificial Sequence
  Synthetic oligonucleotide
tcatcccatcccatcagttctggcatgagcccccc

SEQ ID NO: 189729 - DNA, 35 bp, Artificial Sequence
  Synthetic oligonucleotide
tggtatcgaccactgtggcctaccgctgctccccc

SEQ ID NO: 189730 - DNA, 35 bp, Artificial Sequence
  Synthetic oligonucleotide
actctggccgcccagctcgcattcggtactgtccc

SEQ ID NO: 189731 - DNA, 35 bp, Artificial Sequence
  Synthetic oligonucleotide
gctcccttccgcttatcttttgtggaccgcctgcc

SEQ ID NO: 189732 - DNA, 35 bp, Artificial Sequence
  Synthetic oligonucleotide
gttgtgttcagccctttcctcttcgtccgcttgcc

SEQ ID NO: 189733 - DNA, 35 bp, Artificial Sequence
  Synthetic oligonucleotide
tgccgacacgcccctacttactatcatctgttgcc

SEQ ID NO: 189734 - DNA, 35 bp, Artificial Sequence
  Synthetic oligonucleotide
atccgcacgtggtattgttattggtccccgcctcc

SEQ ID NO: 189735 - DNA, 35 bp, Artificial Sequence
  Synthetic oligonucleotide
tcgaccaacctccaacgctggatttccaggcctcc

SEQ ID NO: 189736 - DNA, 35 bp, Artificial Sequence
  Synthetic oligonucleotide
gacctcactgtccagctcgttactcttcatggtcc

SEQ ID NO: 189737 - DNA, 35 bp, Artificial Sequence
  Synthetic oligonucleotide
attgacaccccccatcatctagctttataagacgc

SEQ ID NO: 189738 - DNA, 35 bp, Artificial Sequence
  Synthetic oligonucleotide
gtgcacgcgaagtgcattgactagattccccccgc

SEQ ID NO: 189739 - DNA, 35 bp, Artificial Sequence
  Synthetic oligonucleotide
gacgcacccctgaaaccgccatccattgccctggc

SEQ ID NO: 189740 - DNA, 35 bp, Artificial Sequence; identical to SEQ ID NO: 36276
  Synthetic oligonucleotide

SEQ ID NO: 189741 - DNA, 35 bp, Artificial Sequence
  Synthetic oligonucleotide
gcctcaacgtagtgcccctcctccactgactttgc

SEQ ID NO: 189742 - DNA, 35 bp, Artificial Sequence
  Synthetic oligonucleotide
gagtgcataatcactgtggtttcatcgctcccatc

SEQ ID NO: 189743 - DNA, 35 bp, Artificial Sequence
  Synthetic oligonucleotide
tgagctgcagccgcatcgcttgcactacatcactc

SEQ ID NO: 189744 - DNA, 35 bp, Artificial Sequence
  Synthetic oligonucleotide
tgatcccctcagcaactattcgtcccatcaacctc

SEQ ID NO: 189745 - DNA, 35 bp, Artificial Sequence
  Synthetic oligonucleotide
atgacggccatgtgttatcctctcagttgtacctc

SEQ ID NO: 189746 - DNA, 35 bp, Artificial Sequence
  Synthetic oligonucleotide
tttgttccagcctgatccgaatgctctcaccgctc

SEQ ID NO: 189747 - DNA, 35 bp, Artificial Sequence
  Synthetic oligonucleotide
aggccgtatcaatcgcactgacaccctgttcgctc

SEQ ID NO: 189748 - DNA, 35 bp, Artificial Sequence
  Synthetic oligonucleotide
tgccgtcgctctcaatgtctgttttgttttcgctc

SEQ ID NO: 189749 - DNA, 35 bp, Artificial Sequence
  Synthetic oligonucleotide
tgtccccgtccgtgccccacccaccgtccacagtc

SEQ ID NO: 189750 - DNA, 35 bp, Artificial Sequence
  Synthetic oligonucleotide
tggatatgccctctggtcctccctcttgtacagtc

SEQ ID NO: 189751 - DNA, 35 bp, Artificial Sequence
  Synthetic oligonucleotide
agtcgccctctgtcgcctttatccgatgtaccgtc

SEQ ID NO: 189752 - DNA, 35 bp, Artificial Sequence
  Synthetic oligonucleotide
gacccctcaggacgtttcttctgttgctctgtgtc

SEQ ID NO: 189753 - DNA, 35 bp, Artificial Sequence
  Synthetic oligonucleotide
tttgatcgacctcgcccctgtgattccctttattc

SEQ ID NO: 189754 - DNA, 35 bp, Artificial Sequence
  Synthetic oligonucleotide
actgccacatgcccactgttgagctacgcgtcttc

SEQ ID NO: 189755 - DNA, 35 bp, Artificial Sequence
  Synthetic oligonucleotide
gctcgcaccacgttcattccctgacgcttactttc

SEQ ID NO: 189756 - DNA, 35 bp, Artificial Sequence
  Synthetic oligonucleotide
agggacaggggggctttaggcggtgggaggaaaag

SEQ ID NO: 189757 - DNA, 35 bp, Artificial Sequence
  Synthetic oligonucleotide
gggggggggggcaatggagggtgctgtcggtggag

SEQ ID NO: 189758 - DNA, 33 bp, Artificial Sequence
  Synthetic oligonucleotide
agcaccaccccatgccgactattttcatgatag

SEQ ID NO: 189759 - DNA, 35 bp, Artificial Sequence
  Synthetic oligonucleotide
aatggtggaaaggggtgtgacaggggggcacttag

SEQ ID NO: 189760 - DNA, 35 bp, Artificial Sequence
  Synthetic oligonucleotide
gccacataccgccgattccttatctttagttaacg

SEQ ID NO: 189761 - DNA, 35 bp, Artificial Sequence
  Synthetic oligonucleotide
aagccgcggggcccggtttccatctccccacaccg

SEQ ID NO: 189762 - DNA, 35 bp, Artificial Sequence
  Synthetic oligonucleotide
gcctccccctattgcaaaccggcgtcaaccccccg

SEQ ID NO: 189763 - DNA, 35 bp, Artificial Sequence
  Synthetic oligonucleotide
tgcacatacacgacgtgatcctagccttccccccg

SEQ ID NO: 189764 - DNA, 35 bp, Artificial Sequence
  Synthetic oligonucleotide
acgaccacgctgccctcccgtcctgtgactccccg

SEQ ID NO: 189765 - DNA, 35 bp, Artificial Sequence
  Synthetic oligonucleotide
gttcagcacagccccgctccatcatccagatcccg

SEQ ID NO: 189766 - DNA, 35 bp, Artificial Sequence
  Synthetic oligonucleotide
tcgtgtccccgttgtgatccgtcctattgtcatcg

SEQ ID NO: 189767 - DNA, 35 bp, Artificial Sequence
  Synthetic oligonucleotide
gtttgtcgccctttctgctccggacttcctcctcg

SEQ ID NO: 189768 - DNA, 35 bp, Artificial Sequence
  Synthetic oligonucleotide
ggggggaaggattgaggaggcactgggacatacgg

SEQ ID NO: 189769 - DNA, 35 bp, Artificial Sequence
  Synthetic oligonucleotide
gcgtggagtatagaggcgggagggagcgaagaggg

SEQ ID NO: 189770 - DNA, 35 bp, Artificial Sequence
  Synthetic oligonucleotide
aggtgcagaaggaggggcgaagctgcagacggggg

SEQ ID NO: 189771 - DNA, 35 bp, Artificial Sequence
  Synthetic oligonucleotide
tcagtgccaagcgcatccgtcttttttgttccatg

SEQ ID NO: 189772 - DNA, 35 bp, Artificial Sequence
  Synthetic oligonucleotide
tttcgacacgagtccactttacgcctgttcccctg

SEQ ID NO: 189773 - DNA, 35 bp, Artificial Sequence
  Synthetic oligonucleotide
tagtccaaccttcattcgtccccttgctctcagtg

SEQ ID NO: 189774 - DNA, 35 bp, Artificial Sequence
  Synthetic oligonucleotide
acctccagacgtccctctgtcttcgttcatccttg

SEQ ID NO: 189775 - DNA, 35 bp, Artificial Sequence
  Synthetic oligonucleotide
gagctcccgccgccgtattgtcctcccacgttttg

SEQ ID NO: 189776 - DNA, 35 bp, Artificial Sequence
  Synthetic oligonucleotide
tacttgccgccccaccatgctcgtactgtcacaat

SEQ ID NO: 189777 - DNA, 35 bp, Artificial Sequence
  Synthetic oligonucleotide
agcgccgcgctcatgaactccgcctggccctccat

SEQ ID NO: 189778 - DNA, 35 bp, Artificial Sequence
  Synthetic oligonucleotide
atgtcagccacattccctcgacccatgttacgcat

SEQ ID NO: 189779 - DNA, 35 bp, Artificial Sequence
  Synthetic oligonucleotide
gggggggacggcaggtacgaaaggagaatgccgat

SEQ ID NO: 189780 - DNA, 35 bp, Artificial Sequence
  Synthetic oligonucleotide
tcgattccacccacacatctggattattagatcct

SEQ ID NO: 189781 - DNA, 35 bp, Artificial Sequence
  Synthetic oligonucleotide
tttaaccccgtccctcctgcctcgttccagaggct

SEQ ID NO: 189782 - DNA, 35 bp, Artificial Sequence
  Synthetic oligonucleotide
tcaatcgccttgctgtacccacttcatctgctgct

SEQ ID NO: 189783 - DNA, 35 bp, Artificial Sequence
  Synthetic oligonucleotide
gttccgcattcctgttttgctgggcatccatttct

SEQ ID NO: 189784 - DNA, 35 bp, Artificial Sequence
  Synthetic oligonucleotide
ttgccactctcaactgcccacatatgcctgtttct

SEQ ID NO: 189785 - DNA, 35 bp, Artificial Sequence
  Synthetic oligonucleotide
gacgcctctcttcacatcgtatgtcttcaccgagt

SEQ ID NO: 189786 - DNA, 35 bp, Artificial Sequence
  Synthetic oligonucleotide
agtcacaagcgcacgtctgcctgcaactccttcgt

SEQ ID NO: 189787 - DNA, 35 bp, Artificial Sequence
  Synthetic oligonucleotide
ggaggggtgagagaaggttacggagaggtgagggt

SEQ ID NO: 189788 - DNA, 35 bp, Artificial Sequence
  Synthetic oligonucleotide
gcaccttgtcgcgtactgcctctttcctcccgggt

SEQ ID NO: 189789 - DNA, 35 bp, Artificial Sequence
  Synthetic oligonucleotide
gggtactcctctcatccgcccgcaccgccttatgt

SEQ ID NO: 189790 - DNA, 35 bp, Artificial Sequence
  Synthetic oligonucleotide
gggacgagctgtagcactctatcctttgttcctgt

SEQ ID NO: 189791 - DNA, 35 bp, Artificial Sequence
  Synthetic oligonucleotide
tgtagccaagatacctgtttacgcttcacctctgt

SEQ ID NO: 189792 - DNA, 35 bp, Artificial Sequence
  Synthetic oligonucleotide
gatgcggatccgatccttccccgcgataaccttgt

SEQ ID NO: 189793 - DNA, 35 bp, Artificial Sequence
  Synthetic oligonucleotide
actcagtgcacctcgccttgttaccacttccttgt

SEQ ID NO: 189794 - DNA, 34 bp, Artificial Sequence
  Synthetic oligonucleotide
gatgccccccccctgctgtaccaccccgataatt

SEQ ID NO: 189795 - DNA, 35 bp, Artificial Sequence
  Synthetic oligonucleotide
agtcacgactacgaaatgtcacctctccttgtatt

SEQ ID NO: 189796 - DNA, 36 bp, Artificial Sequence
  Synthetic oligonucleotide
tcgaccgtggcatgggccagatcactcctccccctt

SEQ ID NO: 189797 - DNA, 35 bp, Artificial Sequence
  Synthetic oligonucleotide
agcgcctcaatcattaggtaatccccgtctcgctt

SEQ ID NO: 189798 - DNA, 36 bp, Artificial Sequence
  Synthetic oligonucleotide
gcaaccctcctgtcattgttccttggcacctcccaa

SEQ ID NO: 189799 - DNA, 35 bp, Artificial Sequence
  Synthetic oligonucleotide
aacacgagcggaggatttactgcttcacctctcaa

SEQ ID NO: 189800 - DNA, 35 bp, Artificial Sequence
  Synthetic oligonucleotide
atgccccacacgcacttgactttgtactttctcaa

SEQ ID NO: 189801 - DNA, 35 bp, Artificial Sequence
  Synthetic oligonucleotide
tcacgcgctccgactcgcacagaacccccgccgaa

SEQ ID NO: 189802 - DNA, 36 bp, Artificial Sequence
  Synthetic oligonucleotide
ttccgccccaaattggtatccgacccctgtaactaa

SEQ ID NO: 189803 - DNA, 36 bp, Artificial Sequence
  Synthetic oligonucleotide
tgtccacgccatattcctcccatctagtacctcaca

SEQ ID NO: 189804 - DNA, 36 bp, Artificial Sequence
  Synthetic oligonucleotide
gtcgtctcggccgcagatcttgctcgccccggtaca

SEQ ID NO: 189805 - DNA, 37 bp, Artificial Sequence
  Synthetic oligonucleotide
accgccccaggaacttgatatctccagcccatttaca

SEQ ID NO: 189806 - DNA, 36 bp, Artificial Sequence
  Synthetic oligonucleotide
gagcgccgtcccgtaatctaatcgccttcccgccca

SEQ ID NO: 189807 - DNA, 35 bp, Artificial Sequence
  Synthetic oligonucleotide
gtccccagcgcatgttccagcccatctcgtcgcca

SEQ ID NO: 189808 - DNA, 35 bp, Artificial Sequence
  Synthetic oligonucleotide
tccagtcccagctacgacgacctctttcactgcca

SEQ ID NO: 189809 - DNA, 35 bp, Artificial Sequence
  Synthetic oligonucleotide
gcatcctccccgatacctcagtctgaccggctcca

SEQ ID NO: 189810 - DNA, 36 bp, Artificial Sequence
  Synthetic oligonucleotide
accccgccgtaatgccctcaggcgtcccgcattcca

SEQ ID NO: 189811 - DNA, 35 bp, Artificial Sequence
  Synthetic oligonucleotide
accctctctcgaccgttactacagttttggttcca

SEQ ID NO: 189812 - DNA, 36 bp, Artificial Sequence
  Synthetic oligonucleotide
tcctcctgcggctgctaatttctacctcggctcgca

SEQ ID NO: 189813 - DNA, 36 bp, Artificial Sequence
  Synthetic oligonucleotide
gcgccacccgcctgtgcttttctttggccacctgca

SEQ ID NO: 189814 - DNA, 36 bp, Artificial Sequence
  Synthetic oligonucleotide
accctcgtagaagactcccccgtacttactgttgca

SEQ ID NO: 189815 - DNA, 35 bp, Artificial Sequence
  Synthetic oligonucleotide
tgcaccccacgcctgccctattaatacgcttctca

SEQ ID NO: 189816 - DNA, 36 bp, Artificial Sequence
  Synthetic oligonucleotide
ttatccgccacccccgactatgtacttgctccgtca

SEQ ID NO: 189817 - DNA, 36 bp, Artificial Sequence
  Synthetic oligonucleotide
accttcccctcacgtgatgagcctgttttgctttca

SEQ ID NO: 189818 - DNA, 36 bp, Artificial Sequence
  Synthetic oligonucleotide
agcgcaccgaagggagtgggggagggggttgcaaga

SEQ ID NO: 189819 - DNA, 37 bp, Artificial Sequence
  Synthetic oligonucleotide
gcacgaccgacttttacatccactctgctcatccaga

SEQ ID NO: 189820 - DNA, 37 bp, Artificial Sequence
  Synthetic oligonucleotide
gtccgaggaaaagggatatggagtggggcgaatgaga

SEQ ID NO: 189821 - DNA, 37 bp, Artificial Sequence
  Synthetic oligonucleotide
tccacccaatgcgctacccggcccttcgtttcttaga

SEQ ID NO: 189822 - DNA, 37 bp, Artificial Sequence
  Synthetic oligonucleotide
aagggagggctccgggtgggatacgagactcaaacga

SEQ ID NO: 189823 - DNA, 37 bp, Artificial Sequence
  Synthetic oligonucleotide
gcgaggtacggggggtctctggactgggaaggaacga

SEQ ID NO: 189824 - DNA, 37 bp, Artificial Sequence
  Synthetic oligonucleotide
acgccaccctcccgctcgctcttaactcgactaacga

SEQ ID NO: 189825 - DNA, 36 bp, Artificial Sequence
  Synthetic oligonucleotide
acttgcccgccgttccatcacgtcgttatgacccga

SEQ ID NO: 189826 - DNA, 37 bp, Artificial Sequence
  Synthetic oligonucleotide
actgcaacctgagctctgcttctttgaggccccccga

SEQ ID NO: 189827 - DNA, 37 bp, Artificial Sequence
  Synthetic oligonucleotide
gcgactggtccacgctgctaccgacgccatattccga

SEQ ID NO: 189828 - DNA, 37 bp, Artificial Sequence
  Synthetic oligonucleotide
accccgcctagcccttcatatcgccgcctttccgcga

SEQ ID NO: 189829 - DNA, 37 bp, Artificial Sequence
  Synthetic oligonucleotide
atgggaatagggagggtgaggataggttacagcgcga

SEQ ID NO: 189830 - DNA, 37 bp, Artificial Sequence
  Synthetic oligonucleotide
tgatatcgccccatcattattgcaacaactctcgcga

SEQ ID NO: 189831 - DNA, 37 bp, Artificial Sequence
  Synthetic oligonucleotide
tactccctcgcaccattcattgagacgtcgtactcga

SEQ ID NO: 189832 - DNA, 37 bp, Artificial Sequence
  Synthetic oligonucleotide
accccccgcactctctcatatcgacatcctgagtcga

SEQ ID NO: 189833 - DNA, 37 bp, Artificial Sequence
  Synthetic oligonucleotide
tgcccgtagggagggagggaggacgggatggattcga

SEQ ID NO: 189834 - DNA, 37 bp, Artificial Sequence
  Synthetic oligonucleotide
aatggagtgggaggaatcggcggacggggagcacgga

SEQ ID NO: 189835 - DNA, 37 bp, Artificial Sequence
  Synthetic oligonucleotide
gacagtaggtgaggggggggaggcggatacacaggga

SEQ ID NO: 189836 - DNA, 37 bp, Artificial Sequence
  Synthetic oligonucleotide
agtgcggatgagcagggggtattggatggagagggga

SEQ ID NO: 189837 - DNA, 37 bp, Artificial Sequence
  Synthetic oligonucleotide
gtgcattccttggctgtttcctctcttcccacgggga

SEQ ID NO: 189838 - DNA, 37 bp, Artificial Sequence
  Synthetic oligonucleotide
aagagggcgggaggcattggaagcaggtggaggggga

SEQ ID NO: 189839 - DNA, 37 bp, Artificial Sequence
  Synthetic oligonucleotide
atcacaagcggccgggaggctaacgggtgggggggga

SEQ ID NO: 189840 - DNA, 37 bp, Artificial Sequence
  Synthetic oligonucleotide
gctagacagcaggggtgggaaaacaggagggtgggga

SEQ ID NO: 189841 - DNA, 37 bp, Artificial Sequence
  Synthetic oligonucleotide
ggggtagtagagggtggaacggggatcgacggatgga

SEQ ID NO: 189842 - DNA, 36 bp, Artificial Sequence
  Synthetic oligonucleotide
gcaacccccacatggggctccactaccatctttgga

SEQ ID NO: 189843 - DNA, 37 bp, Artificial Sequence
  Synthetic oligonucleotide
agccacctcacacacttcctcgtcctcctagtttgga

SEQ ID NO: 189844 - DNA, 37 bp, Artificial Sequence
  Synthetic oligonucleotide
tgatcccctccccgtgcgcacttaccaattgtttgga

SEQ ID NO: 189845 - DNA, 38 bp, Artificial Sequence
  Synthetic oligonucleotide
aaagcggtcgtgtgtctttccctctgccctctccatga

SEQ ID NO: 189846 - DNA, 38 bp, Artificial Sequence
  Synthetic oligonucleotide
aacacgccaattagtaccatgaccacccccctctatga

SEQ ID NO: 189847 - DNA, 38 bp, Artificial Sequence
  Synthetic oligonucleotide
tttgcccatccgccttttcttattggtaccttctatga

SEQ ID NO: 189848 - DNA, 38 bp, Artificial Sequence
  Synthetic oligonucleotide
gagcacaacatctgccctatcggtccctccttctatga

SEQ ID NO: 189849 - DNA, 35 bp, Artificial Sequence
  Synthetic oligonucleotide
tccgatcctacacgtcgtcctgctctatcgtatga

SEQ ID NO: 189850 - DNA, 38 bp, Artificial Sequence
  Synthetic oligonucleotide
gaaggccccacactgttcgtctcaatcgtccttcctga

SEQ ID NO: 189851 - DNA, 36 bp, Artificial Sequence
  Synthetic oligonucleotide
tcagccaatctccgcttgtttactgtttccttctga

SEQ ID NO: 189852 - DNA, 38 bp, Artificial Sequence
  Synthetic oligonucleotide
acagctgccccgcccctgcttctactgacatacagtga

SEQ ID NO: 189853 - DNA, 38 bp, Artificial Sequence
  Synthetic oligonucleotide
gtccgctccctatgctcattccacacgctcacccgtga

SEQ ID NO: 189854 - DNA, 38 bp, Artificial Sequence
  Synthetic oligonucleotide
atctaccgcctatcatttgagttttgcccccgccgtga

SEQ ID NO: 189855 - DNA, 38 bp, Artificial Sequence
  Synthetic oligonucleotide
agagcggtgcgcgttaaattgcttccttggttccgtga

SEQ ID NO: 189856 - DNA, 38 bp, Artificial Sequence
  Synthetic oligonucleotide
taccgccctcctcctttatctgcatcggtgacgggtga

SEQ ID NO: 189857 - DNA, 36 bp, Artificial Sequence
  Synthetic oligonucleotide
tagccatccgctggcctgacctaccactactattga

SEQ ID NO: 189858 - DNA, 38 bp, Artificial Sequence
  Synthetic oligonucleotide
tgtcgtcgccctctcgtatcccctaggcccggacttga

SEQ ID NO: 189859 - DNA, 38 bp, Artificial Sequence
  Synthetic oligonucleotide
tcccgcggtcgttgcgacttgtgacccttcctccttga

SEQ ID NO: 189860 - DNA, 38 bp, Artificial Sequence
  Synthetic oligonucleotide
gtagcacaagtgtatccgccaccccctcacactgttga

SEQ ID NO: 189861 - DNA, 38 bp, Artificial Sequence
  Synthetic oligonucleotide
tagggagtgagcgggcggggagaaacgcaggagtttga

SEQ ID NO: 189862 - DNA, 36 bp, Artificial Sequence
  Synthetic oligonucleotide
ttgacgccagcctcatcatcattcgtgccaccaata

SEQ ID NO: 189863 - DNA, 35 bp, Artificial Sequence
  Synthetic oligonucleotide
gtgcaccctccgacttcaaatcacctgttcatata

SEQ ID NO: 189864 - DNA, 36 bp, Artificial Sequence
  Synthetic oligonucleotide
tacatcgccgtcgcttgcctgtcctgcaatactata

SEQ ID NO: 189865 - DNA, 35 bp, Artificial Sequence
  Synthetic oligonucleotide
gtgaaccatccttttcgtaataggtcattgcccta

SEQ ID NO: 189866 - DNA, 35 bp, Artificial Sequence
  Synthetic oligonucleotide
tccgtctggccgccacccttgtcttatcccagcta

SEQ ID NO: 189867 - DNA, 28 bp, Artificial Sequence
  Synthetic oligonucleotide
tcgagcgccatgtgcacccccccctcta

SEQ ID NO: 189868 - DNA, 35 bp, Artificial Sequence
  Synthetic oligonucleotide
tcctacaccgctctttgtcctttgcaagttacgta

SEQ ID NO: 189869 - DNA, 35 bp, Artificial Sequence
  Synthetic oligonucleotide
tgctctggctccctgtactaccatcctttcaggta

SEQ ID NO: 189870 - DNA, 36 bp, Artificial Sequence
  Synthetic oligonucleotide
gtggagaggttagacggggtgtggtggcggtatgta

SEQ ID NO: 189871 - DNA, 36 bp, Artificial Sequence
  Synthetic oligonucleotide
tgttcaccgctctgtctctatcactcgtccagtgta

SEQ ID NO: 189872 - DNA, 36 bp, Artificial Sequence
  Synthetic oligonucleotide
gtccagctcaaccacctggtatagccgccctcatta

SEQ ID NO: 189873 - DNA, 36 bp, Artificial Sequence
  Synthetic oligonucleotide
actgcttcgtcgccgtctatctatccgccgtcatta

SEQ ID NO: 189874 - DNA, 36 bp, Artificial Sequence
  Synthetic oligonucleotide
accgcggtccatatttttcgcttcctgtccggttta

SEQ ID NO: 189875 - DNA, 35 bp, Artificial Sequence
  Synthetic oligonucleotide
ttcatgcccctcgaatctgggttagattcccacac

SEQ ID NO: 189876 - DNA, 35 bp, Artificial Sequence
  Synthetic oligonucleotide
aaccatctatcagcccggtgcgaaaccgcttacac

SEQ ID NO: 189877 - DNA, 35 bp, Artificial Sequence
  Synthetic oligonucleotide
gatgcctcacgtgcgtacgttgaagtcctcgccac

SEQ ID NO: 189878 - DNA, 35 bp, Artificial Sequence
  Synthetic oligonucleotide
gagagggtggtagggtactcattgctccgggggac

SEQ ID NO: 189879 - DNA, 35 bp, Artificial Sequence
  Synthetic oligonucleotide
tgagtcgtacgcattccgctccacccgttaaaacc

SEQ ID NO: 189880 - DNA, 35 bp, Artificial Sequence
  Synthetic oligonucleotide
tcccatcactcgccatgtgcatgtttgggcccacc

SEQ ID NO: 189881 - DNA, 35 bp, Artificial Sequence
  Synthetic oligonucleotide
tgccacaccttcatgacttagtaaagctgtccacc

SEQ ID NO: 189882 - DNA, 35 bp, Artificial Sequence
  Synthetic oligonucleotide
tgtggatccgctggcctgtcaatatacctactacc

SEQ ID NO: 189883 - DNA, 35 bp, Artificial Sequence
  Synthetic oligonucleotide
gctccgcctccgtgctttcctcgctgttcgttacc

SEQ ID NO: 189884 - DNA, 35 bp, Artificial Sequence
  Synthetic oligonucleotide
gtcccgctaacggccactggtctccgctggttacc

SEQ ID NO: 189885 - DNA, 35 bp, Artificial Sequence
  Synthetic oligonucleotide
accacatctgctcttgttacggcctttatccaccc

SEQ ID NO: 189886 - DNA, 35 bp, Artificial Sequence
  Synthetic oligonucleotide
acctgcgcccctgtcattggactttattggccccc

SEQ ID NO: 189887 - DNA, 35 bp, Artificial Sequence
  Synthetic oligonucleotide
acgaccacccccctattgataaggttcacttcccc

SEQ ID NO: 189888 - DNA, 35 bp, Artificial Sequence
  Synthetic oligonucleotide
agaatcaccagcccagcgctgctccccttcagccc

SEQ ID NO: 189889 - DNA, 35 bp, Artificial Sequence
  Synthetic oligonucleotide
agtctcagtcgcaacggctagcatcgacccctccc

SEQ ID NO: 189890 - DNA, 34 bp, Artificial Sequence
  Synthetic oligonucleotide
atccgcctcgaccgatagggcttgttcacttccc

SEQ ID NO: 189891 - DNA, 35 bp, Artificial Sequence
  Synthetic oligonucleotide
atttggccgcatcgcacacctcactccgatccgcc

SEQ ID NO: 189892 - DNA, 35 bp, Artificial Sequence
  Synthetic oligonucleotide
tacgccttgctgacctgcctactgcctaccttgcc

SEQ ID NO: 189893 - DNA, 35 bp, Artificial Sequence
  Synthetic oligonucleotide
gtacggtcccgcaccctcagccttgatcctattcc

SEQ ID NO: 189894 - DNA, 35 bp, Artificial Sequence
  Synthetic oligonucleotide
ttgtgcgtgccattgctgagcccatacgcatttcc

SEQ ID NO: 189895 - DNA, 35 bp, Artificial Sequence
  Synthetic oligonucleotide
ttgccatcttatggttgttgcttacctctttccgc

SEQ ID NO: 189896 - DNA, 35 bp, Artificial Sequence
  Synthetic oligonucleotide
gtccgcggtgtgccttgttcctgttgctaccctgc

SEQ ID NO: 189897 - DNA, 35 bp, Artificial Sequence
  Synthetic oligonucleotide
gatcactaacgcccgcaccgcaacacctgtgctgc

SEQ ID NO: 189898 - DNA, 35 bp, Artificial Sequence
  Synthetic oligonucleotide
gctgtaccgcgcgtttgcggattattctcccttgc

SEQ ID NO: 189899 - DNA, 35 bp, Artificial Sequence
  Synthetic oligonucleotide
tgaacccactctgtcgttcccttatagttgcttgc

SEQ ID NO: 189900 - DNA, 35 bp, Artificial Sequence
  Synthetic oligonucleotide
ttcgtatcacaccggaggtaccgctccactcttgc

SEQ ID NO: 189901 - DNA, 35 bp, Artificial Sequence
  Synthetic oligonucleotide
accgcgctgtagatatacattctctcccccacatc

SEQ ID NO: 189902 - DNA, 35 bp, Artificial Sequence
  Synthetic oligonucleotide
tgcgtaccttccgatttgattcattcagcgtcctc

SEQ ID NO: 189903 - DNA, 35 bp, Artificial Sequence
  Synthetic oligonucleotide
gaacccaggcagacgggcccggatcccttgtcctc

SEQ ID NO: 189904 - DNA, 35 bp, Artificial Sequence
  Synthetic oligonucleotide
tcagccctggccgtatagttttcacgtatcatctc

SEQ ID NO: 189905 - DNA, 35 bp, Artificial Sequence
  Synthetic oligonucleotide
gcgatgcagtccctgttcttacccctcggattctc

SEQ ID NO: 189906 - DNA, 35 bp, Artificial Sequence
  Synthetic oligonucleotide
aacgcgcttgacacagtccttccaccgggcttctc

SEQ ID NO: 189907 - DNA, 35 bp, Artificial Sequence
  Synthetic oligonucleotide
acataccggcattgctcactccgtcgccgcatgtc

SEQ ID NO: 189908 - DNA, 35 bp, Artificial Sequence
  Synthetic oligonucleotide
accccctcctgaaaggttatgctatcatgcccttc

SEQ ID NO: 189909 - DNA, 35 bp, Artificial Sequence
  Synthetic oligonucleotide
gagcccccatccaccggtgtttatgtcttggcttc

SEQ ID NO: 189910 - DNA, 35 bp, Artificial Sequence
  Synthetic oligonucleotide
gttatccagctctaatgcccctcttgcgtacgttc

SEQ ID NO: 189911 - DNA, 35 bp, Artificial Sequence
  Synthetic oligonucleotide
tgacggactgggttgcatctcgtcatgttcctttc

SEQ ID NO: 189912 - DNA, 35 bp, Artificial Sequence
  Synthetic oligonucleotide
acctgtcccagggccatacgctcggtccaaccacg

SEQ ID NO: 189913 - DNA, 35 bp, Artificial Sequence
  Synthetic oligonucleotide
tcccaacgccccatctttgcatatgccctgccacg

SEQ ID NO: 189914 - DNA, 35 bp, Artificial Sequence
  Synthetic oligonucleotide
attaccgcccattgctctcgctaccaccctgtacg

SEQ ID NO: 189915 - DNA, 35 bp, Artificial Sequence
  Synthetic oligonucleotide
ttaggcgctcgttatcgctgtcccttcccgtcgcg

SEQ ID NO: 189916 - DNA, 35 bp, Artificial Sequence
  Synthetic oligonucleotide
tgacactccccatgcctttcgtcctgtcccattcg

SEQ ID NO: 189917 - DNA, 35 bp, Artificial Sequence
  Synthetic oligonucleotide
tccccgtcaccatcccctggcactggcttgcttcg

SEQ ID NO: 189918 - DNA, 35 bp, Artificial Sequence
  Synthetic oligonucleotide
gtcccacctcactaatgtttccgtcgcccttttcg

SEQ ID NO: 189919 - DNA, 36 bp, Artificial Sequence
  Synthetic oligonucleotide
agacaacgatcgggggcggtggggaattgggatagg

SEQ ID NO: 189920 - DNA, 35 bp, Artificial Sequence
  Synthetic oligonucleotide
gtagggagggagaaacagtgtgacggcggcttagg

SEQ ID NO: 189921 - DNA, 35 bp, Artificial Sequence
  Synthetic oligonucleotide
agtagtgcccccgaacttccttccctccacctatg

SEQ ID NO: 189922 - DNA, 35 bp, Artificial Sequence
  Synthetic oligonucleotide
tctccacctcatcgcctacgtgtcatgctccgctg

SEQ ID NO: 189923 - DNA, 35 bp, Artificial Sequence
  Synthetic oligonucleotide
ggggtcacggggggaaatggagcggggctttagtg

SEQ ID NO: 189924 - DNA, 37 bp, Artificial Sequence
  Synthetic oligonucleotide
tatgccgcccgccttggagccctaacacagctaattg

SEQ ID NO: 189925 - DNA, 35 bp, Artificial Sequence
  Synthetic oligonucleotide
actcggaccatctactgtattcacaccccttgttg

SEQ ID NO: 189926 - DNA, 35 bp, Artificial Sequence
  Synthetic oligonucleotide
gcatcggggtgtgggggggacgggacgtctgcaat

SEQ ID NO: 189927 - DNA, 35 bp, Artificial Sequence
  Synthetic oligonucleotide
gattccgccactatctttccgtcttcctaagacat

SEQ ID NO: 189928 - DNA, 35 bp, Artificial Sequence
  Synthetic oligonucleotide
tctctccacccgtagcctgttcgtcctcagaccat

SEQ ID NO: 189929 - DNA, 35 bp, Artificial Sequence
  Synthetic oligonucleotide
acatgccctatctagctgatcccttgtccattcat

SEQ ID NO: 189930 - DNA, 35 bp, Artificial Sequence
  Synthetic oligonucleotide
gcgtacgcatcacccacctgtgccttccgctcgat

SEQ ID NO: 189931 - DNA, 35 bp, Artificial Sequence
  Synthetic oligonucleotide
gagatgcgttcttctttattgctgccctgttctat

SEQ ID NO: 189932 - DNA, 35 bp, Artificial Sequence
  Synthetic oligonucleotide
gtgagcatagcttatgacctgtcccccttccttat

SEQ ID NO: 189933 - DNA, 35 bp, Artificial Sequence
  Synthetic oligonucleotide
actcagcctatggtccaccgcgcccccctgtccct

SEQ ID NO: 189934 - DNA, 35 bp, Artificial Sequence
  Synthetic oligonucleotide
tcaccaccctgcctgtttgtgtctccacccagcct

SEQ ID NO: 189935 - DNA, 35 bp, Artificial Sequence
  Synthetic oligonucleotide
acatgctgtacttgccgtttcgttttgtttcgcct

SEQ ID NO: 189936 - DNA, 35 bp, Artificial Sequence
  Synthetic oligonucleotide
gactcgaacagtgccaactgcctaccctgcttcct

SEQ ID NO: 189937 - DNA, 35 bp, Artificial Sequence
  Synthetic oligonucleotide
aactcaggaccgcacctgtccttctatgatttcct

SEQ ID NO: 189938 - DNA, 35 bp, Artificial Sequence
  Synthetic oligonucleotide
accatacctcggacgcggtatttcatccattcgct

SEQ ID NO: 189939 - DNA, 35 bp, Artificial Sequence
  Synthetic oligonucleotide
gagccgtacgaaagtactaaagccaccgcccctct

SEQ ID NO: 189940 - DNA, 35 bp, Artificial Sequence
  Synthetic oligonucleotide
tcagtgtacgcgccccacctttccagtctcgttct

SEQ ID NO: 189941 - DNA, 35 bp, Artificial Sequence
  Synthetic oligonucleotide
tagctccgctggcaacatctcctttttcctccggt

SEQ ID NO: 189942 - DNA, 35 bp, Artificial Sequence
  Synthetic oligonucleotide
ttgcagaccaccctgtctatcttcgccacctcggt

SEQ ID NO: 189943 - DNA, 35 bp, Artificial Sequence
  Synthetic oligonucleotide
aaagtggagggggcataaccgggaaagccaggggt

SEQ ID NO: 189944 - DNA, 35 bp, Artificial Sequence
  Synthetic oligonucleotide
ttgctgctgcaccgtgtaccccccccgcgctatgt

SEQ ID NO: 189945 - DNA, 35 bp, Artificial Sequence
  Synthetic oligonucleotide
atgcccccttcctccaatgtaatgctggcaaactt

SEQ ID NO: 189946 - DNA, 35 bp, Artificial Sequence
  Synthetic oligonucleotide
gagtagctctacctgtcgtcgtcgctttcctactt

SEQ ID NO: 189947 - DNA, 35 bp, Artificial Sequence
  Synthetic oligonucleotide
gatgcccttcctgctctgaccacatgacacccgtt

SEQ ID NO: 189948 - DNA, 35 bp, Artificial Sequence
  Synthetic oligonucleotide
tacacctcacctatgcccggtcctgcccgcccttt

SEQ ID NO: 189949 - DNA, 35 bp, Artificial Sequence
  Synthetic oligonucleotide
gtaacgagtaccgcccacgccctgttcattctttt

SEQ ID NO: 189950 - DNA, 36 bp, Artificial Sequence
  Synthetic oligonucleotide
gatacgacattaggtggtggggacggggaggtaaaa

SEQ ID NO: 189951 - DNA, 35 bp, Artificial Sequence
  Synthetic oligonucleotide
gagttgcggtcacaagtcgttctttctccgccaaa

SEQ ID NO: 189952 - DNA, 35 bp, Artificial Sequence
  Synthetic oligonucleotide
gggggtgacggagggcgggaacggggagtatgaaa

SEQ ID NO: 189953 - DNA, 35 bp, Artificial Sequence
  Synthetic oligonucleotide
ggtagatgggggggactagaaatgggcgggcgcaa

SEQ ID NO: 189954 - DNA, 35 bp, Artificial Sequence
  Synthetic oligonucleotide
atcctggccagtacccgccgctgccgattgacaca

SEQ ID NO: 189955 - DNA, 35 bp, Artificial Sequence
  Synthetic oligonucleotide
gctgccagatattttccaggacctgcccccccaca

SEQ ID NO: 189956 - DNA, 35 bp, Artificial Sequence
  Synthetic oligonucleotide
accggaccggccctgtactctgtaatctcgccaca

SEQ ID NO: 189957 - DNA, 36 bp, Artificial Sequence
  Synthetic oligonucleotide
ttcagcatcgacctggtaattgctcagcccgcccca

SEQ ID NO: 189958 - DNA, 35 bp, Artificial Sequence
  Synthetic oligonucleotide
ttcgtccagcatagttggctcatctccggctccca

SEQ ID NO: 189959 - DNA, 36 bp, Artificial Sequence
  Synthetic oligonucleotide
gttcgtctccacccccgatgccttcatttccagcca

SEQ ID NO: 189960 - DNA, 35 bp, Artificial Sequence
  Synthetic oligonucleotide
gcaccccgaagcaagtcctcagtccctcttccgca

SEQ ID NO: 189961 - DNA, 36 bp, Artificial Sequence
  Synthetic oligonucleotide
tcccacaccatcgatcctcaggccctattgcgcgca

SEQ ID NO: 189962 - DNA, 35 bp, Artificial Sequence
  Synthetic oligonucleotide
gcacgccctaacttccagatccctatccttgcgca

SEQ ID NO: 189963 - DNA, 36 bp, Artificial Sequence
  Synthetic oligonucleotide
ttcgagcatcggtgctcgattgtctcatctctatca

SEQ ID NO: 189964 - DNA, 36 bp, Artificial Sequence
  Synthetic oligonucleotide
attgcacaaaagaagggggtgagggggtgcgagtca

SEQ ID NO: 189965 - DNA, 36 bp, Artificial Sequence
  Synthetic oligonucleotide
tttatcccgcctcatcgcttggtttctagtccttca

SEQ ID NO: 189966 - DNA, 35 bp, Artificial Sequence
  Synthetic oligonucleotide
gtgtgatggggcgagacggttaggaaggggagaga

SEQ ID NO: 189967 - DNA, 37 bp, Artificial Sequence
  Synthetic oligonucleotide
aagaggtgaggcggaggaaggtcccgtgggggagaga

SEQ ID NO: 189968 - DNA, 37 bp, Artificial Sequence
  Synthetic oligonucleotide
gaggaacgttggtataggggcgaagggcaggcggaga

SEQ ID NO: 189969 - DNA, 36 bp, Artificial Sequence
  Synthetic oligonucleotide
gcgcacctcatcgggcattcgtcgcacttcccccga

SEQ ID NO: 189970 - DNA, 37 bp, Artificial Sequence
  Synthetic oligonucleotide
acactgcaccttttacgatattcgcctctgtccccga

SEQ ID NO: 189971 - DNA, 37 bp, Artificial Sequence
  Synthetic oligonucleotide
tcccccccagctgtctgagtcttacattatcccgcga

SEQ ID NO: 189972 - DNA, 37 bp, Artificial Sequence
  Synthetic oligonucleotide
gtatgtggtcggaagggaggcggaggagaattgtcga

SEQ ID NO: 189973 - DNA, 36 bp, Artificial Sequence
  Synthetic oligonucleotide
acgatctccatccgctcccgttaaacacacccagga

SEQ ID NO: 189974 - DNA, 36 bp, Artificial Sequence
  Synthetic oligonucleotide
atagtagggtagtgagggtggttagcggggagagga

SEQ ID NO: 189975 - DNA, 37 bp, Artificial Sequence
  Synthetic oligonucleotide
gagaagcgcagaacgaacaggagcggaaaggaaggga

SEQ ID NO: 189976 - DNA, 37 bp, Artificial Sequence
  Synthetic oligonucleotide
tatgtatcggggtggggtacggggtacacccagggga

SEQ ID NO: 189977 - DNA, 37 bp, Artificial Sequence
  Synthetic oligonucleotide
gtggggagcgactggggagggttcttccatccgggga

SEQ ID NO: 189978 - DNA, 37 bp, Artificial Sequence
  Synthetic oligonucleotide
tgatgggccggaatctgggcgggatggatgtctggga

SEQ ID NO: 189979 - DNA, 38 bp, Artificial Sequence
  Synthetic oligonucleotide
actaccccgtaggttctgtaactgttccatctacatga

SEQ ID NO: 189980 - DNA, 37 bp, Artificial Sequence
  Synthetic oligonucleotide
accaggagcgccgccacgtctttcccagctccactga

SEQ ID NO: 189981 - DNA, 37 bp, Artificial Sequence
  Synthetic oligonucleotide
tagtcacgtcccatccctgatcatgcctgttcactga

SEQ ID NO: 189982 - DNA, 35 bp, Artificial Sequence
  Synthetic oligonucleotide
ggggccacccgacgctcttctatttggctacctga

SEQ ID NO: 189983 - DNA, 38 bp, Artificial Sequence
  Synthetic oligonucleotide
tgtcacctgcgacacgactctgccactccgttccctga

SEQ ID NO: 189984 - DNA, 37 bp, Artificial Sequence
  Synthetic oligonucleotide
tccaccctcatatgagttatcttcacctaccatctga

SEQ ID NO: 189985 - DNA, 38 bp, Artificial Sequence
  Synthetic oligonucleotide
gtgtatggacgagaggggacgggggtaggcaatagtga

SEQ ID NO: 189986 - DNA, 38 bp, Artificial Sequence
  Synthetic oligonucleotide
gtggagagggaggggcgtaggcatgaggaaaaccgtga

SEQ ID NO: 189987 - DNA, 37 bp, Artificial Sequence
  Synthetic oligonucleotide
gcaagggcacgtgccgtcctcctccgctttgccgtga

SEQ ID NO: 189988 - DNA, 38 bp, Artificial Sequence
  Synthetic oligonucleotide
agtgcgggttgggcgggggctaacgaagggggaggtga

SEQ ID NO: 189989 - DNA, 34 bp, Artificial Sequence
  Synthetic oligonucleotide
gtgttcccccgttccgacactcttcacctggtga

SEQ ID NO: 189990 - DNA, 37 bp, Artificial Sequence
  Synthetic oligonucleotide
gaacccgtctgtatgtcctcgtccttcctttctgtga

SEQ ID NO: 189991 - DNA, 38 bp, Artificial Sequence
  Synthetic oligonucleotide
gggacgggtgggcaggggtagcactaacagaggtgtga

SEQ ID NO: 189992 - DNA, 37 bp, Artificial Sequence
  Synthetic oligonucleotide
tcagtcgtcttaccccccccgccactcgagtcattga

SEQ ID NO: 189993 - DNA, 38 bp, Artificial Sequence
  Synthetic oligonucleotide
tcaacgcatccgccgcccgctcgtagttaccatattga

SEQ ID NO: 189994 - DNA, 38 bp, Artificial Sequence
  Synthetic oligonucleotide
atccccgcccctacattagcacggtcaagaggccttga

SEQ ID NO: 189995 - DNA, 37 bp, Artificial Sequence
  Synthetic oligonucleotide
gagggccgtcgtgatcttgtctcactctctctcttga

SEQ ID NO: 189996 - DNA, 36 bp, Artificial Sequence
  Synthetic oligonucleotide
accgccttgcccaccacacgctcttttcgaggaata

SEQ ID NO: 189997 - DNA, 35 bp, Artificial Sequence
  Synthetic oligonucleotide
gcacgccttcgctgttcgccccgcaaagatccata

SEQ ID NO: 189998 - DNA, 36 bp, Artificial Sequence
  Synthetic oligonucleotide
gaatatcccgctctcaccgccgtgccccattccgta

SEQ ID NO: 189999 - DNA, 37 bp, Artificial Sequence
  Synthetic oligonucleotide
aacaattgctggagggggtaggggatggaggacggta

SEQ ID NO: 190000 - DNA, 36 bp, Artificial Sequence
  Synthetic oligonucleotide
gtgcagtaggactaagcggaggaggggtagggggta

SEQ ID NO: 190001 - DNA, 36 bp, Artificial Sequence
  Synthetic oligonucleotide
tgagtcccgcttccattgttcccctgactctttgta

SEQ ID NO: 190002 - DNA, 36 bp, Artificial Sequence
  Synthetic oligonucleotide
acagtccactctctccgtcgttatcttgcctcatta

SEQ ID NO: 190003 - DNA, 35 bp, Artificial Sequence
  Synthetic oligonucleotide
gaaggggggctcaaaatctgggggctgggttcaac

SEQ ID NO: 190004 - DNA, 35 bp, Artificial Sequence
  Synthetic oligonucleotide
ttctccgcccaggtgatcgttaatccgccttgaac

SEQ ID NO: 190005 - DNA, 35 bp, Artificial Sequence
  Synthetic oligonucleotide
accacctcctggtcatacgtttttggttcacacac

SEQ ID NO: 190006 - DNA, 35 bp, Artificial Sequence
  Synthetic oligonucleotide
tcgctcccctcccgtaactcttattgtacatacac

SEQ ID NO: 190007 - DNA, 35 bp, Artificial Sequence
  Synthetic oligonucleotide
gttgtcctcccgcatgccccacattccataaggac

SEQ ID NO: 190008 - DNA, 35 bp, Artificial Sequence
  Synthetic oligonucleotide
ttccacccagcctgtacccgcgatatcggtcctac

SEQ ID NO: 190009 - DNA, 35 bp, Artificial Sequence
  Synthetic oligonucleotide
tcccaccgatccgttcgctttacctttagttgtac

SEQ ID NO: 190010 - DNA, 35 bp, Artificial Sequence
  Synthetic oligonucleotide
gcacaccctctgttattcttcaaagctttcattac

SEQ ID NO: 190011 - DNA, 35 bp, Artificial Sequence
  Synthetic oligonucleotide
gaccccctcacgtgcactcatacagacctccaccc

SEQ ID NO: 190012 - DNA, 35 bp, Artificial Sequence
  Synthetic oligonucleotide
tacccgccccaaaatgtacttctttagtgcccccc

SEQ ID NO: 190013 - DNA, 35 bp, Artificial Sequence
  Synthetic oligonucleotide
atgcgcagtgtatcctccgcacgaccgtggccccc

SEQ ID NO: 190014 - DNA, 35 bp, Artificial Sequence
  Synthetic oligonucleotide
gagcacccactgccttcccgctccatctgtcgccc

SEQ ID NO: 190015 - DNA, 35 bp, Artificial Sequence
  Synthetic oligonucleotide
taccgcccctcctttgcccgcgtatttcgactccc

SEQ ID NO: 190016 - DNA, 35 bp, Artificial Sequence
  Synthetic oligonucleotide
agcagaatcatcagccttatatttggtccgctccc

SEQ ID NO: 190017 - DNA, 35 bp, Artificial Sequence
  Synthetic oligonucleotide
gccgccggccagggatctccccgcacatggctccc

SEQ ID NO: 190018 - DNA, 35 bp, Artificial Sequence
  Synthetic oligonucleotide
ggagtctgcatatgcaccttgtcctgtccaccgcc

SEQ ID NO: 190019 - DNA, 35 bp, Artificial Sequence
  Synthetic oligonucleotide
gaccgccatccgccatgcattattactgacccgcc

SEQ ID NO: 190020 - DNA, 35 bp, Artificial Sequence
  Synthetic oligonucleotide
taggcaccttgtccccagtcctccaggtactcgcc

SEQ ID NO: 190021 - DNA, 35 bp, Artificial Sequence
  Synthetic oligonucleotide
gctctacctatctgtcccttcgcacacgagctgcc

SEQ ID NO: 190022 - DNA, 35 bp, Artificial Sequence
  Synthetic oligonucleotide
agccaagcccgttcgtaggaacgtccgttctatcc

SEQ ID NO: 190023 - DNA, 35 bp, Artificial Sequence
  Synthetic oligonucleotide
ttttccgcccattgtgatacttacttgctacctcc

SEQ ID NO: 190024 - DNA, 35 bp, Artificial Sequence
  Synthetic oligonucleotide
acgatccatccgttacttgctctggtacgccctcc

SEQ ID NO: 190025 - DNA, 35 bp, Artificial Sequence
  Synthetic oligonucleotide
atcatctgccggtggcgatccaatctcgggcctcc

SEQ ID NO: 190026 - DNA, 35 bp, Artificial Sequence
  Synthetic oligonucleotide
aggacgagctcgatcccctatggccctgtcgctcc

SEQ ID NO: 190027 - DNA, 35 bp, Artificial Sequence
  Synthetic oligonucleotide
ttccccccaaccgttccccgacgtgcaagatctcc

SEQ ID NO: 190028 - DNA, 35 bp, Artificial Sequence
  Synthetic oligonucleotide
gccgccccgtccggtccttgtccatcagtctctcc

SEQ ID NO: 190029 - DNA, 36 bp, Artificial Sequence
  Synthetic oligonucleotide
agatcgtcgaatctgctgtcatccccctgcttgtcc

SEQ ID NO: 190030 - DNA, 35 bp, Artificial Sequence
  Synthetic oligonucleotide
tggaatcgcggtactttcattatggctgcctttcc

SEQ ID NO: 190031 - DNA, 35 bp, Artificial Sequence
  Synthetic oligonucleotide
gcagaccgcatctttctgtacgatcctccatgagc

SEQ ID NO: 190032 - DNA, 35 bp, Artificial Sequence
  Synthetic oligonucleotide
gcaccgcattgtctctttcttctgtccacaaacgc

SEQ ID NO: 190033 - DNA, 35 bp, Artificial Sequence
  Synthetic oligonucleotide
tcatccaccgttacaagggaactctctcatcacgc

SEQ ID NO: 190034 - DNA, 35 bp, Artificial Sequence
  Synthetic oligonucleotide
attcaccctcctgtcccacgggctatctaagccgc

SEQ ID NO: 190035 - DNA, 35 bp, Artificial Sequence
  Synthetic oligonucleotide
tctgtaccgtgcacctctctgacgattgttctcgc

SEQ ID NO: 190036 - DNA, 35 bp, Artificial Sequence
  Synthetic oligonucleotide
tcacctcctatgtcatcccccattgcgctcgtcgc

SEQ ID NO: 190037 - DNA, 35 bp, Artificial Sequence
  Synthetic oligonucleotide
atggcgaagaaggaaggggtggaagatagtgtcgc

SEQ ID NO: 190038 - DNA, 35 bp, Artificial Sequence
  Synthetic oligonucleotide
tgaggggaggggagggaagggtagcacgactcggc

SEQ ID NO: 190039 - DNA, 35 bp, Artificial Sequence
  Synthetic oligonucleotide
gatgccttgtagagggcgaagggagggaggagggc

SEQ ID NO: 190040 - DNA, 35 bp, Artificial Sequence
  Synthetic oligonucleotide
tcccgacaggggtctcctgcgtcgcttctcctggc

SEQ ID NO: 190041 - DNA, 35 bp, Artificial Sequence
  Synthetic oligonucleotide
tcttcgtacaggccaacttatgttacaccgcaatc

SEQ ID NO: 190042 - DNA, 35 bp, Artificial Sequence
  Synthetic oligonucleotide
aacaccaccccctgttctcttgactggtgtcaatc

SEQ ID NO: 190043 - DNA, 35 bp, Artificial Sequence
  Synthetic oligonucleotide
gccatctcgttccttctcacggcgttccacctatc

SEQ ID NO: 190044 - DNA, 35 bp, Artificial Sequence
  Synthetic oligonucleotide
tcctgcaagagcccacctttttgactccgcacctc

SEQ ID NO: 190045 - DNA, 35 bp, Artificial Sequence
  Synthetic oligonucleotide
ttgccactcccccggttcgacagaacgttgccctc

SEQ ID NO: 190046 - DNA, 35 bp, Artificial Sequence
  Synthetic oligonucleotide
atgccccactgcactgccctagcctacgatatctc

SEQ ID NO: 190047 - DNA, 35 bp, Artificial Sequence
  Synthetic oligonucleotide
tcatctaccgcagtacagctcgccatcccccggtc

SEQ ID NO: 190048 - DNA, 35 bp, Artificial Sequence
  Synthetic oligonucleotide
ttatcccgctaacatctcgttccccctggcttgtc

SEQ ID NO: 190049 - DNA, 35 bp, Artificial Sequence
  Synthetic oligonucleotide
tgtgccttcggggcgctcgttatgccttggccttc

SEQ ID NO: 190050 - DNA, 35 bp, Artificial Sequence
  Synthetic oligonucleotide
acgctccacatgtccatcactcggtctgttccttc

SEQ ID NO: 190051 - DNA, 35 bp, Artificial Sequence
  Synthetic oligonucleotide
atagcacggagaaggagggccgaagggatctgaag

SEQ ID NO: 190052 - DNA, 35 bp, Artificial Sequence
  Synthetic oligonucleotide
tgcaagcgcgcacgttcaaccccaagatccccccg

SEQ ID NO: 190053 - DNA, 35 bp, Artificial Sequence
  Synthetic oligonucleotide
acgcggggcgtatgtggagcccccccccttgcccg

SEQ ID NO: 190054 - DNA, 36 bp, Artificial Sequence
  Synthetic oligonucleotide
ggagggcggaaggtggacggggttcggggctgggcg

SEQ ID NO: 190055 - DNA, 35 bp, Artificial Sequence
  Synthetic oligonucleotide
acaatgacgcaggggggcgggaggggactgtgtcg

SEQ ID NO: 190056 - DNA, 35 bp, Artificial Sequence
  Synthetic oligonucleotide
ggacacgctatgtcctttgcctccgattaaattcg

SEQ ID NO: 190057 - DNA, 35 bp, Artificial Sequence
  Synthetic oligonucleotide
taccttgctccacttgggttgatcgcctctcttcg

SEQ ID NO: 190058 - DNA, 35 bp, Artificial Sequence
  Synthetic oligonucleotide
taagttaaagagggggtagggtagtcgggggtagg

SEQ ID NO: 190059 - DNA, 31 bp, Artificial Sequence
  Synthetic oligonucleotide
tgcaatcatcttctgttctcccccgctcggg

SEQ ID NO: 190060 - DNA, 35 bp, Artificial Sequence
  Synthetic oligonucleotide
gagtgacaaacgagatgtaaatgtgggagaagggg

SEQ ID NO: 190061 - DNA, 35 bp, Artificial Sequence
  Synthetic oligonucleotide
attccagacgtacccccgcgctcctctcaccgtgg

SEQ ID NO: 190062 - DNA, 35 bp, Artificial Sequence
  Synthetic oligonucleotide
tggtgtcaccacgccgtctccaatgctcactcctg

SEQ ID NO: 190063 - DNA, 35 bp, Artificial Sequence
  Synthetic oligonucleotide
gttatgtcgccccatgtcccctggtttgtctcttg

SEQ ID NO: 190064 - DNA, 35 bp, Artificial Sequence
  Synthetic oligonucleotide
tggagagggaggcctggagagctaggcgggggttg

SEQ ID NO: 190065 - DNA, 35 bp, Artificial Sequence
  Synthetic oligonucleotide
acacaccacctaacatgttcgccgttccgcttttg

SEQ ID NO: 190066 - DNA, 35 bp, Artificial Sequence
  Synthetic oligonucleotide
gccacccggcgtcataccgaagcccgtactctcat

SEQ ID NO: 190067 - DNA, 35 bp, Artificial Sequence
  Synthetic oligonucleotide
tcgttccgccatcccgattcgattacctttgctat

SEQ ID NO: 190068 - DNA, 35 bp, Artificial Sequence
  Synthetic oligonucleotide
gcccaggcgccatggtccgataccctgcaacacct

SEQ ID NO: 190069 - DNA, 35 bp, Artificial Sequence
  Synthetic oligonucleotide
atagccccctcgcacttgttcaatctgtgttccct

SEQ ID NO: 190070 - DNA, 35 bp, Artificial Sequence
  Synthetic oligonucleotide
tcatcaccgcctcatctgtccattacaccttgcct

SEQ ID NO: 190071 - DNA, 27 bp, Artificial Sequence
  Synthetic oligonucleotide
atgcctgcctccctttgttaacctcct

SEQ ID NO: 190072 - DNA, 35 bp, Artificial Sequence
  Synthetic oligonucleotide
ttcccaccgcaccacctgtcctatttcatatagct

SEQ ID NO: 190073 - DNA, 35 bp, Artificial Sequence
  Synthetic oligonucleotide
tcctatgtttgccgttgtaccaagttccctctgct

SEQ ID NO: 190074 - DNA, 35 bp, Artificial Sequence
  Synthetic oligonucleotide
gagcgctccgacctgccaacactcctggtacatct

SEQ ID NO: 190075 - DNA, 35 bp, Artificial Sequence
  Synthetic oligonucleotide
ctgtgccatcacgtttgatcatctgacggttttct

SEQ ID NO: 190076 - DNA, 35 bp, Artificial Sequence
  Synthetic oligonucleotide
tttatcgccctcccgttagcgcgttctattccatt

SEQ ID NO: 190077 - DNA, 35 bp, Artificial Sequence
  Synthetic oligonucleotide
gttgcgccagtccgctctcctatcgtcgtcttatt

SEQ ID NO: 190078 - DNA, 35 bp, Artificial Sequence
  Synthetic oligonucleotide
agtaacacccgctctcctcttggaccgtttccttt

SEQ ID NO: 190079 - DNA, 35 bp, Artificial Sequence
  Synthetic oligonucleotide
aaccacggcgctgtatgcaacacctcttccgcttt

SEQ ID NO: 190080 - DNA, 36 bp, Artificial Sequence
  Synthetic oligonucleotide
gactacgcctttccactggtttccacactgttacaa

SEQ ID NO: 190081 - DNA, 36 bp, Artificial Sequence
  Synthetic oligonucleotide
gcctgacctccgtatgtgcccccgccgtgaacgcaa

SEQ ID NO: 190082 - DNA, 36 bp, Artificial Sequence
  Synthetic oligonucleotide
ttgataccctccactgctgaaatgacttcccaagaa

SEQ ID NO: 190083 - DNA, 35 bp, Artificial Sequence
  Synthetic oligonucleotide
tgccctgccacattaatccgtctgtttacaccgaa

SEQ ID NO: 190084 - DNA, 35 bp, Artificial Sequence
  Synthetic oligonucleotide
ggaaggacgaggattttggggcgggggatagcgaa

SEQ ID NO: 190085 - DNA, 36 bp, Artificial Sequence
  Synthetic oligonucleotide
tcgctcatccgactgcgatcttcctgtcatccttaa

SEQ ID NO: 190086 - DNA, 35 bp, Artificial Sequence
  Synthetic oligonucleotide
aaggacacaagtacgggagggaggtggtgctgaca

SEQ ID NO: 190087 - DNA, 36 bp, Artificial Sequence
  Synthetic oligonucleotide
tgtgactgtagtccaacgccatggaccatcccccca

SEQ ID NO: 190088 - DNA, 36 bp, Artificial Sequence
  Synthetic oligonucleotide
tggacagaggtgggtatgggggggagggaaggccca

SEQ ID NO: 190089 - DNA, 36 bp, Artificial Sequence
  Synthetic oligonucleotide
taccccgtccagctgccttactgtaccgtacctcca

SEQ ID NO: 190090 - DNA, 35 bp, Artificial Sequence
  Synthetic oligonucleotide
aacaccatggtcccgcttgttcctctgtgcctcca

SEQ ID NO: 190091 - DNA, 36 bp, Artificial Sequence
  Synthetic oligonucleotide
taacggtaggtggaatagggtaggggggtagtggca

SEQ ID NO: 190092 - DNA, 34 bp, Artificial Sequence
  Synthetic oligonucleotide
aagcaccagcccaacgtcttccgacccaccatca

SEQ ID NO: 190093 - DNA, 36 bp, Artificial Sequence
  Synthetic oligonucleotide
tttggccgcccccgcccctcctggtcacagatatca

SEQ ID NO: 190094 - DNA, 36 bp, Artificial Sequence
  Synthetic oligonucleotide
aagctcgccctccactgttacatgcccaccgcctca

SEQ ID NO: 190095 - DNA, 36 bp, Artificial Sequence
  Synthetic oligonucleotide
tccacgctgcactcctttaatatatgccctgcctca

SEQ ID NO: 190096 - DNA, 35 bp, Artificial Sequence
  Synthetic oligonucleotide
gtcgcccctcagttccgtcatctggttaatcctca

SEQ ID NO: 190097 - DNA, 35 bp, Artificial Sequence
  Synthetic oligonucleotide
gtgaagctcgcccaccgacccagctgccactctca

SEQ ID NO: 190098 - DNA, 36 bp, Artificial Sequence
  Synthetic oligonucleotide
tttgcgacatgtcagcatccaacctcgtacctctca

SEQ ID NO: 190099 - DNA, 36 bp, Artificial Sequence
  Synthetic oligonucleotide
gagcccaagtccatgttatagtcctcccacttgtca

SEQ ID NO: 190100 - DNA, 36 bp, Artificial Sequence
  Synthetic oligonucleotide
acaccgcacaatgcccctcggtccataatctattca

SEQ ID NO: 190101 - DNA, 35 bp, Artificial Sequence
  Synthetic oligonucleotide
tgcaccctgctactcctcgctcgttatcccgaaga

SEQ ID NO: 190102 - DNA, 37 bp, Artificial Sequence
  Synthetic oligonucleotide
tatgtgtagggaggggtggaggcaaaatagggtaaga

SEQ ID NO: 190103 - DNA, 37 bp, Artificial Sequence
  Synthetic oligonucleotide
aaggaagggcagtaagccgagcaaggggcggaggaga

SEQ ID NO: 190104 - DNA, 37 bp, Artificial Sequence
  Synthetic oligonucleotide
taggtgccgtagggaatgcggaaggggaggtggtaga

SEQ ID NO: 190105 - DNA, 37 bp, Artificial Sequence
  Synthetic oligonucleotide
tcaccagtccagccctgctctaatgccctcgccccga

SEQ ID NO: 190106 - DNA, 36 bp, Artificial Sequence
  Synthetic oligonucleotide
tccgcaactcgccctagtgcttcgttacctccccga

SEQ ID NO: 190107 - DNA, 37 bp, Artificial Sequence
  Synthetic oligonucleotide
gatgggactgatgcttgcgtgcccgtgccctccccga

SEQ ID NO: 190108 - DNA, 36 bp, Artificial Sequence
  Synthetic oligonucleotide
gagtgtcctcaccccgttctcttccttcccgcccga

SEQ ID NO: 190109 - DNA, 37 bp, Artificial Sequence
  Synthetic oligonucleotide
tctgtgcagctcgccctgcccctcgctttctctccga

SEQ ID NO: 190110 - DNA, 37 bp, Artificial Sequence
  Synthetic oligonucleotide
gttccacccctgtccttcatcctagcaggatgagcga

SEQ ID NO: 190111 - DNA, 36 bp, Artificial Sequence
  Synthetic oligonucleotide
gtagtgggagggaagtgggtaaatgcacggaatcga

SEQ ID NO: 190112 - DNA, 36 bp, Artificial Sequence
  Synthetic oligonucleotide
agtgggagggcagggtgtggggaccggtctactcga

SEQ ID NO: 190113 - DNA, 36 bp, Artificial Sequence
  Synthetic oligonucleotide
ttcaccatcggtggtttcacgttcttcactcctcga

SEQ ID NO: 190114 - DNA, 36 bp, Artificial Sequence
  Synthetic oligonucleotide
gcatccacctcacggttcactcgattactttctcga

SEQ ID NO: 190115 - DNA, 36 bp, Artificial Sequence
  Synthetic oligonucleotide
gctccgacccgcccttgttacgccaagttcattcga

SEQ ID NO: 190116 - DNA, 37 bp, Artificial Sequence
  Synthetic oligonucleotide
gtacgcgcaatgttgcttacctccttcgtcacttcga

SEQ ID NO: 190117 - DNA, 37 bp, Artificial Sequence
  Synthetic oligonucleotide
atgtggctggggagaactgggtggtgaagggaaagga

SEQ ID NO: 190118 - DNA, 36 bp, Artificial Sequence
  Synthetic oligonucleotide
tctccgcgcgacctccccaaccgttcctccgccgga

SEQ ID NO: 190119 - DNA, 37 bp, Artificial Sequence
  Synthetic oligonucleotide
tcaactcactcagcgtcgtatcctctctctgccggga

SEQ ID NO: 190120 - DNA, 37 bp, Artificial Sequence
  Synthetic oligonucleotide
tgcccagtatccgttgggagggagggtacttagggga

SEQ ID NO: 190121 - DNA, 37 bp, Artificial Sequence
  Synthetic oligonucleotide
tcctgacctctctgttgctgcatttttccacacatga

SEQ ID NO: 190122 - DNA, 37 bp, Artificial Sequence
  Synthetic oligonucleotide
gggcaccgcccgtcgtcctttccggccttcactatga

SEQ ID NO: 190123 - DNA, 38 bp, Artificial Sequence
  Synthetic oligonucleotide
tccgcccctcaatccctaaagtacgccgcatactatga

SEQ ID NO: 190124 - DNA, 38 bp, Artificial Sequence
  Synthetic oligonucleotide
aagagggaggggtggaaggatgcagaccggtgttatga

SEQ ID NO: 190125 - DNA, 37 bp, Artificial Sequence
  Synthetic oligonucleotide
gaccttgtcgcgggggggagcaggagggacacactga

SEQ ID NO: 190126 - DNA, 36 bp, Artificial Sequence
  Synthetic oligonucleotide
ggactgccgccccccactgtatgcgtgttcacctga

SEQ ID NO: 190127 - DNA, 37 bp, Artificial Sequence
  Synthetic oligonucleotide
tcgtagctgaatcctgccggccacacgtaaaccctga

SEQ ID NO: 190128 - DNA, 38 bp, Artificial Sequence
  Synthetic oligonucleotide
tctgagccccctccgtcactagtacgtgccctccctga

SEQ ID NO: 190129 - DNA, 38 bp, Artificial Sequence
  Synthetic oligonucleotide
tcagctcagtgcttatcgcgcaacgccatcccgcctga

SEQ ID NO: 190130 - DNA, 38 bp, Artificial Sequence
  Synthetic oligonucleotide
atgtgcgcaatcaacgcgttctacctgcacactcctga

SEQ ID NO: 190131 - DNA, 38 bp, Artificial Sequence
  Synthetic oligonucleotide
agcacgttcagcactcgtcaccgccgtccttgtcctga

SEQ ID NO: 190132 - DNA, 38 bp, Artificial Sequence
  Synthetic oligonucleotide
ggaggggggggcctaggtacatggggcggtcttgctga

SEQ ID NO: 190133 - DNA, 38 bp, Artificial Sequence
  Synthetic oligonucleotide
gccttatgaccggtgcgtaatttcacctgcccttctga

SEQ ID NO: 190134 - DNA, 37 bp, Artificial Sequence
  Synthetic oligonucleotide
acgggaggcaagggagggaagttcggaggaatagtga

SEQ ID NO: 190135 - DNA, 38 bp, Artificial Sequence
  Synthetic oligonucleotide
gttgctccattctggtgtcccgtcctccttccccgtga

SEQ ID NO: 190136 - DNA, 38 bp, Artificial Sequence
  Synthetic oligonucleotide
gtgcgcacgtctcccctgcacctccccgcgtttcgtga

SEQ ID NO: 190137 - DNA, 38 bp, Artificial Sequence
  Synthetic oligonucleotide
gttgagtgtccatagggaataggatagggaaggggtga

SEQ ID NO: 190138 - DNA, 38 bp, Artificial Sequence
  Synthetic oligonucleotide
tacctcctccgccccttcacgagactgtcattcattga

SEQ ID NO: 190139 - DNA, 38 bp, Artificial Sequence
  Synthetic oligonucleotide
tatcgcccacacccgaaccagcctctacagtctattga

SEQ ID NO: 190140 - DNA, 37 bp, Artificial Sequence
  Synthetic oligonucleotide
gtggccccgccttgactaatccggccattctccttga

SEQ ID NO: 190141 - DNA, 38 bp, Artificial Sequence
  Synthetic oligonucleotide
tgtaagggaaaggggtagtagggaatgggcagtgttga

SEQ ID NO: 190142 - DNA, 38 bp, Artificial Sequence
  Synthetic oligonucleotide
taagcacccgctgcatatcaattcccccgtcactttga

SEQ ID NO: 190143 - DNA, 37 bp, Artificial Sequence
  Synthetic oligonucleotide
tcaggtcatttgtaccaccctggccgcccccctttga

SEQ ID NO: 190144 - DNA, 38 bp, Artificial Sequence
  Synthetic oligonucleotide
atcagcccgattcgccccgtaacgctcactccctttga

SEQ ID NO: 190145 - DNA, 36 bp, Artificial Sequence
  Synthetic oligonucleotide
ttggagagctggtgggtgggtcgaacatgccaaata

SEQ ID NO: 190146 - DNA, 35 bp, Artificial Sequence
  Synthetic oligonucleotide
acgataccctcctcgtactcagcccccgggctata

SEQ ID NO: 190147 - DNA, 35 bp, Artificial Sequence
  Synthetic oligonucleotide
tgctcccctcgttcctcaccgctgccaggtcgcta

SEQ ID NO: 190148 - DNA, 36 bp, Artificial Sequence
  Synthetic oligonucleotide
agcaacccgccaggccccccgcccacttctctgcta

SEQ ID NO: 190149 - DNA, 35 bp, Artificial Sequence
  Synthetic oligonucleotide
tcaacgccattcagcggacttttcagtcacctcta

SEQ ID NO: 190150 - DNA, 36 bp, Artificial Sequence
  Synthetic oligonucleotide
acactactctgtgcccctccaggtgaccgctctcta

SEQ ID NO: 190151 - DNA, 36 bp, Artificial Sequence
  Synthetic oligonucleotide
gcccacattctctgtttactataagtccaccttcta

SEQ ID NO: 190152 - DNA, 35 bp, Artificial Sequence
  Synthetic oligonucleotide
tgcacgaggcctgcttggttgttcctgcttttcta

SEQ ID NO: 190153 - DNA, 36 bp, Artificial Sequence
  Synthetic oligonucleotide
ggacgcgataccactgcgcgtcgaacccttcccgta

SEQ ID NO: 190154 - DNA, 35 bp, Artificial Sequence
  Synthetic oligonucleotide
tccccggccaaccatccctgtcttcagttacggta

SEQ ID NO: 190155 - DNA, 35 bp, Artificial Sequence
  Synthetic oligonucleotide
attcagggtgggcagggtatgggggtaaaactgta

SEQ ID NO: 190156 - DNA, 35 bp, Artificial Sequence
  Synthetic oligonucleotide
gtaagctgcccgccccatattagccgtcgagccac

SEQ ID NO: 190157 - DNA, 35 bp, Artificial Sequence
  Synthetic oligonucleotide
atcgacgccgaactcttagtccattccctgtgcac

SEQ ID NO: 190158 - DNA, 35 bp, Artificial Sequence
  Synthetic oligonucleotide
gacccttccaatagtatagttcgtttctcttgtac

SEQ ID NO: 190159 - DNA, 35 bp, Artificial Sequence
  Synthetic oligonucleotide
acacaacgagcgtaacttgtgacccgccctcttac

SEQ ID NO: 190160 - DNA, 33 bp, Artificial Sequence
  Synthetic oligonucleotide
atgtgaacgtgctgctaataggctccaccaacc

SEQ ID NO: 190161 - DNA, 35 bp, Artificial Sequence
  Synthetic oligonucleotide
caccactgccttggtgcgctctgcctatttgcccc

SEQ ID NO: 190162 - DNA, 35 bp, Artificial Sequence
  Synthetic oligonucleotide
gtccgcctcacgctgacctcaaggttacccggccc

SEQ ID NO: 190163 - DNA, 35 bp, Artificial Sequence
  Synthetic oligonucleotide
tcccgcgcacaggccgttcgtcgctgttccctccc

SEQ ID NO: 190164 - DNA, 35 bp, Artificial Sequence
  Synthetic oligonucleotide
gtgtccctcactggttgccaagccccataagtccc

SEQ ID NO: 190165 - DNA, 35 bp, Artificial Sequence
  Synthetic oligonucleotide
gggtacccccgcgatttcgtcacatcctagttccc

SEQ ID NO: 190166 - DNA, 35 bp, Artificial Sequence
  Synthetic oligonucleotide
tgccacgccgatcgctttttgatccacttttagcc

SEQ ID NO: 190167 - DNA, 35 bp, Artificial Sequence
  Synthetic oligonucleotide
ttaagcccgacccatgttcatttcgaaatccggcc

SEQ ID NO: 190168 - DNA, 35 bp, Artificial Sequence
  Synthetic oligonucleotide
gagtcgccgtcctactcaattcactgtcccctgcc

SEQ ID NO: 190169 - DNA, 35 bp, Artificial Sequence
  Synthetic oligonucleotide
ggacgcgcgggtttacttttgtctcggtgccctcc

SEQ ID NO: 190170 - DNA, 35 bp, Artificial Sequence
  Synthetic oligonucleotide
tcgcccctcgatgtcaacgccgcccactgagctcc

SEQ ID NO: 190171 - DNA, 35 bp, Artificial Sequence
  Synthetic oligonucleotide
ccacgcccccctgacgctctcataatgttcagtcc

SEQ ID NO: 190172 - DNA, 35 bp, Artificial Sequence
  Synthetic oligonucleotide
taccttacaccgtcctatagtccctcatcatgtcc

SEQ ID NO: 190173 - DNA, 35 bp, Artificial Sequence
  Synthetic oligonucleotide
tagaccgccttctcaagatctctgctattacccgc

SEQ ID NO: 190174 - DNA, 35 bp, Artificial Sequence
  Synthetic oligonucleotide
acagcccgctcgcacactgttccaccgaccgccgc

SEQ ID NO: 190175 - DNA, 35 bp, Artificial Sequence
  Synthetic oligonucleotide
tcacaaccgccaatttcagtccttcgcttactcgc

SEQ ID NO: 190176 - DNA, 35 bp, Artificial Sequence
  Synthetic oligonucleotide
tgtcgccgcctgtaaaacctcgtgcaaaccttcgc

SEQ ID NO: 190177 - DNA, 35 bp, Artificial Sequence
  Synthetic oligonucleotide
tcaccctgtccgcctcccacggtgtttttgttcgc

SEQ ID NO: 190178 - DNA, 35 bp, Artificial Sequence
  Synthetic oligonucleotide
gcccgccgaacacttctgtactgctactggtaatc

SEQ ID NO: 190179 - DNA, 35 bp, Artificial Sequence
  Synthetic oligonucleotide
gacccccgcccaagtgtaaggagtccctccccatc

SEQ ID NO: 190180 - DNA, 35 bp, Artificial Sequence
  Synthetic oligonucleotide
accaactcgtacggcatactaaaagttcctccatc

SEQ ID NO: 190181 - DNA, 35 bp, Artificial Sequence
  Synthetic oligonucleotide
acgccctgggctcccattagcaaattcgtttcatc

SEQ ID NO: 190182 - DNA, 35 bp, Artificial Sequence
  Synthetic oligonucleotide
tgcccagctgctacccagttcacacgctcgcactc

SEQ ID NO: 190183 - DNA, 35 bp, Artificial Sequence
  Synthetic oligonucleotide
tcacgccgtgccgcaataatacttggtagatcctc

SEQ ID NO: 190184 - DNA, 35 bp, Artificial Sequence
  Synthetic oligonucleotide
gccaaaccctggccgaatacactgtcatctcgctc

SEQ ID NO: 190185 - DNA, 35 bp, Artificial Sequence
  Synthetic oligonucleotide
tatgcaccgtagttcagatggcacctccccatctc

SEQ ID NO: 190186 - DNA, 35 bp, Artificial Sequence
  Synthetic oligonucleotide
atcttcctacgcggtctcctgcgcatctgccattc

SEQ ID NO: 190187 - DNA, 35 bp, Artificial Sequence
  Synthetic oligonucleotide
agcgccccatcgctctgaatcctgccgtgcccttc

SEQ ID NO: 190188 - DNA, 35 bp, Artificial Sequence
  Synthetic oligonucleotide
agcgagtcgcggctctcgtccccgtgcctcttttc

SEQ ID NO: 190189 - DNA, 35 bp, Artificial Sequence
  Synthetic oligonucleotide
gtaccgcccttgtatttttgctgcttcacccgcag

SEQ ID NO: 190190 - DNA, 35 bp, Artificial Sequence
  Synthetic oligonucleotide
atgtggggggaggacgtggtttcgcggtagtgcag

SEQ ID NO: 190191 - DNA, 35 bp, Artificial Sequence
  Synthetic oligonucleotide
attgggtgaagcagagggggggactggaaaacgag

SEQ ID NO: 190192 - DNA, 35 bp, Artificial Sequence
  Synthetic oligonucleotide
tgtcacctctcgccacactgatcctgcctccttag

SEQ ID NO: 190193 - DNA, 35 bp, Artificial Sequence
  Synthetic oligonucleotide
tcacgccgcccgagcacgcccgccagaacccaacg

SEQ ID NO: 190194 - DNA, 35 bp, Artificial Sequence
  Synthetic oligonucleotide
gatacgagggggatgtgtgggcaatgggggggacg

SEQ ID NO: 190195 - DNA, 35 bp, Artificial Sequence
  Synthetic oligonucleotide
tgacggactcctgccattgttctcaccccacgccg

SEQ ID NO: 190196 - DNA, 35 bp, Artificial Sequence
  Synthetic oligonucleotide
gtgttacctcacgtcgcaacatcttcctttcgccg

SEQ ID NO: 190197 - DNA, 35 bp, Artificial Sequence
  Synthetic oligonucleotide
atccctagccaaattatgtcgcttcacctgctccg

SEQ ID NO: 190198 - DNA, 35 bp, Artificial Sequence
  Synthetic oligonucleotide
agccccttcaacccactctattttctgcggttccg

SEQ ID NO: 190199 - DNA, 33 bp, Artificial Sequence
  Synthetic oligonucleotide
atcgcctctgagtaacaccccccgcggtttccg

SEQ ID NO: 190200 - DNA, 35 bp, Artificial Sequence
  Synthetic oligonucleotide
tgggccctgcgctcctgttctgtcgattcctctcg

SEQ ID NO: 190201 - DNA, 35 bp, Artificial Sequence
  Synthetic oligonucleotide
gacgaccttccacgcccgccctttgttgtacttcg

SEQ ID NO: 190202 - DNA, 35 bp, Artificial Sequence
  Synthetic oligonucleotide
gccgagaggtagtagcgggcgggagcatacggggg

SEQ ID NO: 190203 - DNA, 35 bp, Artificial Sequence
  Synthetic oligonucleotide
tatcgagaaggggtgctgacggaagggccgggggg

SEQ ID NO: 190204 - DNA, 35 bp, Artificial Sequence
  Synthetic oligonucleotide
aacacgcacgttcggccccgattgccctgtccatg

SEQ ID NO: 190205 - DNA, 35 bp, Artificial Sequence
  Synthetic oligonucleotide
tcagacatcctcaggcgctccaagcctgcaccctg

SEQ ID NO: 190206 - DNA, 35 bp, Artificial Sequence
  Synthetic oligonucleotide
tctatcgcgactcacgttccatctttctctttgtg

SEQ ID NO: 190207 - DNA, 35 bp, Artificial Sequence
  Synthetic oligonucleotide
gcaccaacctcggctgacttctcgtaaacacattg

SEQ ID NO: 190208 - DNA, 35 bp, Artificial Sequence
  Synthetic oligonucleotide
gtgcgtaccactgaacttccctgttattagccttg

SEQ ID NO: 190209 - DNA, 35 bp, Artificial Sequence
  Synthetic oligonucleotide
gaggccggtagagggtgggcgggttaaaattcttg

SEQ ID NO: 190210 - DNA, 35 bp, Artificial Sequence
  Synthetic oligonucleotide
tcccccatcaacacgtggtcaatacagttggcact

SEQ ID NO: 190211 - DNA, 35 bp, Artificial Sequence
  Synthetic oligonucleotide
gccccgccacattcctatctatccagcactcacct

SEQ ID NO: 190212 - DNA, 35 bp, Artificial Sequence
  Synthetic oligonucleotide
gccgacaatccgactttgttttccgatgatcccct

SEQ ID NO: 190213 - DNA, 32 bp, Artificial Sequence
  Synthetic oligonucleotide
tcgatccccaccagtgccctctaggattccct

SEQ ID NO: 190214 - DNA, 35 bp, Artificial Sequence
  Synthetic oligonucleotide
tgtcatatccgctggtctgtaacgctccccctcct

SEQ ID NO: 190215 - DNA, 35 bp, Artificial Sequence
  Synthetic oligonucleotide
tccaagcaccgcttgtaaggcccccatccgttcct

SEQ ID NO: 190216 - DNA, 35 bp, Artificial Sequence
  Synthetic oligonucleotide
gctcacacacatgtccgccgtgtttactcaccgct

SEQ ID NO: 190217 - DNA, 32 bp, Artificial Sequence
  Synthetic oligonucleotide
gtgctaaacaaaagcctccgccgcccaatgct

SEQ ID NO: 190218 - DNA, 35 bp, Artificial Sequence
  Synthetic oligonucleotide
agaccagccgttcaccctggtcatcatatctatct

SEQ ID NO: 190219 - DNA, 35 bp, Artificial Sequence
  Synthetic oligonucleotide
agtgccggtcttcagccctgtcacttcaccactct

SEQ ID NO: 190220 - DNA, 35 bp, Artificial Sequence
  Synthetic oligonucleotide
gtctacggcgattgatgccttccttctccatgtct

SEQ ID NO: 190221 - DNA, 35 bp, Artificial Sequence
  Synthetic oligonucleotide
gctgaccactgttccattatatgatttccttccgt

SEQ ID NO: 190222 - DNA, 35 bp, Artificial Sequence
  Synthetic oligonucleotide
gcaagggagggggttactcggggagaggcaagtgt

SEQ ID NO: 190223 - DNA, 35 bp, Artificial Sequence
  Synthetic oligonucleotide
gcaccctacttgttaatctcgtctacactatcctt

SEQ ID NO: 190224 - DNA, 35 bp, Artificial Sequence
  Synthetic oligonucleotide
gtgtcagacctcctaccaccccgctcctgtatctt

SEQ ID NO: 190225 - DNA, 35 bp, Artificial Sequence
  Synthetic oligonucleotide
tcgatcaagccacctatatctgtacctcatttctt

SEQ ID NO: 190226 - DNA, 35 bp, Artificial Sequence
  Synthetic oligonucleotide
tgttcacgcctcgctcataacgatccgtccacgtt

SEQ ID NO: 190227 - DNA, 35 bp, Artificial Sequence
  Synthetic oligonucleotide
tttgcaccacgcctcgccaacccttggtgtccttt

SEQ ID NO: 190228 - DNA, 35 bp, Artificial Sequence
  Synthetic oligonucleotide
atgatcgaactgcccgcgcgagcgctccctgcttt

SEQ ID NO: 190229 - DNA, 36 bp, Artificial Sequence
  Synthetic oligonucleotide
tcgcaccgctacagctattcctttcccgcacgcaaa

SEQ ID NO: 190230 - DNA, 35 bp, Artificial Sequence
  Synthetic oligonucleotide
atcgtactcgttcgacgggtcttcatcgcccccaa

SEQ ID NO: 190231 - DNA, 36 bp, Artificial Sequence
  Synthetic oligonucleotide
tagcgctcacgtcgttcccgtttgcaccctctcgaa

SEQ ID NO: 190232 - DNA, 35 bp, Artificial Sequence
  Synthetic oligonucleotide
tgtgcatcgccacattgcctctcacctggcctgaa

SEQ ID NO: 190233 - DNA, 36 bp, Artificial Sequence
  Synthetic oligonucleotide
tgccatcgccatgtgccctgcaacatctcttcctaa

SEQ ID NO: 190234 - DNA, 35 bp, Artificial Sequence
  Synthetic oligonucleotide
aattcgccccgcccccttaagactccgcggtaaca

SEQ ID NO: 190235 - DNA, 36 bp, Artificial Sequence
  Synthetic oligonucleotide
gtaccaccctcaagcgtcgtttgctcgcgtcgcaca

SEQ ID NO: 190236 - DNA, 36 bp, Artificial Sequence
  Synthetic oligonucleotide
gccgaccaaacgcctgccctcgtatactcattcaca

SEQ ID NO: 190237 - DNA, 35 bp, Artificial Sequence
  Synthetic oligonucleotide
gtgacgtgtcgggaaggtgggacggcacagggaca

SEQ ID NO: 190238 - DNA, 35 bp, Artificial Sequence
  Synthetic oligonucleotide
tgacgaccctcctgcttatatctattcgagtccca

SEQ ID NO: 190239 - DNA, 35 bp, Artificial Sequence
  Synthetic oligonucleotide
cacgcgggcggggggaggaaaggaagggaaagcca

SEQ ID NO: 190240 - DNA, 36 bp, Artificial Sequence
  Synthetic oligonucleotide
ttcaagctgttgttgctcatgtccgttccgtcgcca

SEQ ID NO: 190241 - DNA, 35 bp, Artificial Sequence
  Synthetic oligonucleotide
tcaggagctgctacacgctgattttgtgccctcca

SEQ ID NO: 190242 - DNA, 36 bp, Artificial Sequence
  Synthetic oligonucleotide
tgcaccgccgcccccattctttaggtcacgtttcca

SEQ ID NO: 190243 - DNA, 36 bp, Artificial Sequence
  Synthetic oligonucleotide
gcccatccgcctgttactatgaaggctccactcgca

SEQ ID NO: 190244 - DNA, 36 bp, Artificial Sequence
  Synthetic oligonucleotide
acaagccgttcattccaactcgtgccattctcatca

SEQ ID NO: 190245 - DNA, 35 bp, Artificial Sequence
  Synthetic oligonucleotide
tccgccaccccgcagctgtctgaaaagcgccctca

SEQ ID NO: 190246 - DNA, 35 bp, Artificial Sequence
  Synthetic oligonucleotide
tccaccccccttcgtccggctaagcatgtgcctca

SEQ ID NO: 190247 - DNA, 35 bp, Artificial Sequence
  Synthetic oligonucleotide
acacaccctctgcttctaaccggcctaggacttca

SEQ ID NO: 190248 - DNA, 36 bp, Artificial Sequence
  Synthetic oligonucleotide
actacgccctcacgagcaatttttgccataccttca

SEQ ID NO: 190249 - DNA, 36 bp, Artificial Sequence
  Synthetic oligonucleotide
tgcacgccccagtttctgttacgtcttcctccttca

SEQ ID NO: 190250 - DNA, 35 bp, Artificial Sequence
  Synthetic oligonucleotide
atcttcccaactggtctcctaagccacacgcttca

SEQ ID NO: 190251 - DNA, 36 bp, Artificial Sequence
  Synthetic oligonucleotide
tccggtcccatctcaaaggccgtttacatagtttca

SEQ ID NO: 190252 - DNA, 37 bp, Artificial Sequence
  Synthetic oligonucleotide
agacaggcggacggggtggtgcaggggccgggaaaga

SEQ ID NO: 190253 - DNA, 36 bp, Artificial Sequence
  Synthetic oligonucleotide
tgacccacgcccccctttactgccctagtgttaaga

SEQ ID NO: 190254 - DNA, 37 bp, Artificial Sequence
  Synthetic oligonucleotide
gttccgcccccgctccccgattaagcgctttgagaga

SEQ ID NO: 190255 - DNA, 37 bp, Artificial Sequence
  Synthetic oligonucleotide
ttgggggtgggaagaggggaggtaccacggggataga

SEQ ID NO: 190256 - DNA, 37 bp, Artificial Sequence
  Synthetic oligonucleotide
tagccaccccgactcgttctggaaccattcaccacga

SEQ ID NO: 190257 - DNA, 35 bp, Artificial Sequence
  Synthetic oligonucleotide
actcgacctccacctgcctcgctaagattctacga

SEQ ID NO: 190258 - DNA, 37 bp, Artificial Sequence
  Synthetic oligonucleotide
ttgcgtgagccacctcagtgtttctggttccccccga

SEQ ID NO: 190259 - DNA, 37 bp, Artificial Sequence
  Synthetic oligonucleotide
gtggccccatcaccctctctgaactgcctatagccga

SEQ ID NO: 190260 - DNA, 37 bp, Artificial Sequence
  Synthetic oligonucleotide
gattcccccacaggtgctgcttaaactcgcccgccga

SEQ ID NO: 190261 - DNA, 37 bp, Artificial Sequence
  Synthetic oligonucleotide
tgatgtgacagggatgtaaagggaaaaagggaagcga

SEQ ID NO: 190262 - DNA, 35 bp, Artificial Sequence
  Synthetic oligonucleotide
aacccccgccgatgattccgccacacagtcagcga

SEQ ID NO: 190263 - DNA, 37 bp, Artificial Sequence
  Synthetic oligonucleotide
tgctccgtatcctatgcaccatcctcgcgattcgcga

SEQ ID NO: 190264 - DNA, 37 bp, Artificial Sequence
  Synthetic oligonucleotide
tttgcccctcgctgcctaccgcctgacgattgatcga

SEQ ID NO: 190265 - DNA, 35 bp, Artificial Sequence
  Synthetic oligonucleotide
aacgctggacaaattgcgcgctccatcacactcga

SEQ ID NO: 190266 - DNA, 37 bp, Artificial Sequence
  Synthetic oligonucleotide
gactgtgctcctcgatggcaatgctccttctcttcga

SEQ ID NO: 190267 - DNA, 37 bp, Artificial Sequence
  Synthetic oligonucleotide
gcgggggggtgacaatgggttgggactgggagaagga

SEQ ID NO: 190268 - DNA, 35 bp, Artificial Sequence
  Synthetic oligonucleotide
gtcctacccgtccattctttcatcgcaccacagga

SEQ ID NO: 190269 - DNA, 37 bp, Artificial Sequence
  Synthetic oligonucleotide
atggtgggcgggtgcatgggggcgggcgactctagga

SEQ ID NO: 190270 - DNA, 35 bp, Artificial Sequence
  Synthetic oligonucleotide
atgccaccacttctccttcggcccgtgaacacgga

SEQ ID NO: 190271 - DNA, 37 bp, Artificial Sequence
  Synthetic oligonucleotide
gagtaccggggggtgaacgaagagggagcttaaggga

SEQ ID NO: 190272 - DNA, 37 bp, Artificial Sequence
  Synthetic oligonucleotide
gacttggaaggggggtacgtgggctggccaacgggga

SEQ ID NO: 190273 - DNA, 35 bp, Artificial Sequence
  Synthetic oligonucleotide
ggggttggcggcccttatcgcgatggaggcgggga

SEQ ID NO: 190274 - DNA, 36 bp, Artificial Sequence
  Synthetic oligonucleotide
atagggaagcagacatacacaggaggaaggggggga

SEQ ID NO: 190275 - DNA, 37 bp, Artificial Sequence
  Synthetic oligonucleotide
atgactagggccgagagtaggaacagggtggggggga

SEQ ID NO: 190276 - DNA, 37 bp, Artificial Sequence
  Synthetic oligonucleotide
taccaccacaattgtccgccaagggcctactcctgga

SEQ ID NO: 190277 - DNA, 38 bp, Artificial Sequence
  Synthetic oligonucleotide
agaccgccacccgccgttgcgaatgaccccctacatga

SEQ ID NO: 190278 - DNA, 38 bp, Artificial Sequence
  Synthetic oligonucleotide
tgccaccaccttgatgctagtccttaacgcccccatga

SEQ ID NO: 190279 - DNA, 38 bp, Artificial Sequence
  Synthetic oligonucleotide
acgcaccagcccgacctgccattacaactcactcatga

SEQ ID NO: 190280 - DNA, 38 bp, Artificial Sequence
  Synthetic oligonucleotide
gtctgcccccgcttgccactgtgcctccgacctcatga

SEQ ID NO: 190281 - DNA, 37 bp, Artificial Sequence
  Synthetic oligonucleotide
tgcggggagggaggaacgggtaatcggcaaggtatga

SEQ ID NO: 190282 - DNA, 36 bp, Artificial Sequence
  Synthetic oligonucleotide
gtccagaagggaaggaagttgaggagaagggtatga

SEQ ID NO: 190283 - DNA, 38 bp, Artificial Sequence
  Synthetic oligonucleotide
tagcaagggcgggtaggtaaaagggcgggtatcactga

SEQ ID NO: 190284 - DNA, 38 bp, Artificial Sequence
  Synthetic oligonucleotide
aagacccctcccgatcatgttcattaatgcccacctga

SEQ ID NO: 190285 - DNA, 36 bp, Artificial Sequence
  Synthetic oligonucleotide
tacgggagggagtaggagggagttagaggtcgctga

SEQ ID NO: 190286 - DNA, 38 bp, Artificial Sequence
  Synthetic oligonucleotide
atgccggggatctgcccttattgctcctctccatctga

SEQ ID NO: 190287 - DNA, 37 bp, Artificial Sequence
  Synthetic oligonucleotide
gtgggggacccgggaggggggtacgaaggagtagtga

SEQ ID NO: 190288 - DNA, 38 bp, Artificial Sequence
  Synthetic oligonucleotide
tcagcgcgccgaccccctttttgtacactgccctgtga

SEQ ID NO: 190289 - DNA, 34 bp, Artificial Sequence
  Synthetic oligonucleotide
ttctcacatccggctcatgctcctcgatccttga

SEQ ID NO: 190290 - DNA, 38 bp, Artificial Sequence
  Synthetic oligonucleotide
actttcaccgtcctctgttgctactacactccgcttga

SEQ ID NO: 190291 - DNA, 38 bp, Artificial Sequence
  Synthetic oligonucleotide
ggatgccctcgatctgatcccctctccagtgccgttga

SEQ ID NO: 190292 - DNA, 38 bp, Artificial Sequence
  Synthetic oligonucleotide
tgagtggaggacgggggtaacgaagcgtgacaggttga

SEQ ID NO: 190293 - DNA, 36 bp, Artificial Sequence
  Synthetic oligonucleotide
gactgggttcagcatttcccgtccttcctctgttga

SEQ ID NO: 190294 - DNA, 38 bp, Artificial Sequence
  Synthetic oligonucleotide
tgaacagggggggaggcgacggaacgggtagactttga

SEQ ID NO: 190295 - DNA, 38 bp, Artificial Sequence
  Synthetic oligonucleotide
gtcgcagacacgatcgcgtaaccgctacctacttttga

SEQ ID NO: 190296 - DNA, 37 bp, Artificial Sequence
  Synthetic oligonucleotide
tcaccccgcccccccatgcttgatagaaaccgctata

SEQ ID NO: 190297 - DNA, 36 bp, Artificial Sequence
  Synthetic oligonucleotide
acctggacgcctccaccgtggttcatttccccccta

SEQ ID NO: 190298 - DNA, 36 bp, Artificial Sequence
  Synthetic oligonucleotide
ggtgctaccttctcgtatgttcctcgtgttccccta

SEQ ID NO: 190299 - DNA, 36 bp, Artificial Sequence
  Synthetic oligonucleotide
ggagtgggtggatagagggaatgtgagggctaggta

SEQ ID NO: 190300 - DNA, 35 bp, Artificial Sequence
  Synthetic oligonucleotide
gccaactgcaacatgaaacacggttcctgccctta

SEQ ID NO: 190301 - DNA, 36 bp, Artificial Sequence
  Synthetic oligonucleotide
tcgttcgacccgactgccgcatcgcacaccatctta

SEQ ID NO: 190302 - DNA, 35 bp, Artificial Sequence
  Synthetic oligonucleotide
tatgccacggccatcatatacacgaaccccaccac

SEQ ID NO: 190303 - DNA, 35 bp, Artificial Sequence
  Synthetic oligonucleotide
aattggccaccccgtggtaataatcccccttccac

SEQ ID NO: 190304 - DNA, 35 bp, Artificial Sequence
  Synthetic oligonucleotide
gtcacctgcccccgctcgcttatctacgtttgcac

SEQ ID NO: 190305 - DNA, 35 bp, Artificial Sequence
  Synthetic oligonucleotide
ttgcgtaccatcgccgaacctcggtccttttcgac

SEQ ID NO: 190306 - DNA, 35 bp, Artificial Sequence
  Synthetic oligonucleotide
gcgagactgggggggcgattgatggaagggtatac

SEQ ID NO: 190307 - DNA, 35 bp, Artificial Sequence
  Synthetic oligonucleotide
tctgacgatccccggtgctccctcgtgtttactac

SEQ ID NO: 190308 - DNA, 36 bp, Artificial Sequence
  Synthetic oligonucleotide
gacgtaatggcagccctcgctcgctgtaccctctac

SEQ ID NO: 190309 - DNA, 35 bp, Artificial Sequence
  Synthetic oligonucleotide
aacccgacgcttttcttgagtattgctcctcgtac

SEQ ID NO: 190310 - DNA, 35 bp, Artificial Sequence
  Synthetic oligonucleotide
gataacgtagccgttctatcttctgggccccttac

SEQ ID NO: 190311 - DNA, 35 bp, Artificial Sequence
  Synthetic oligonucleotide
acctcctccgtcagacgtcaagccgcccttaaccc

SEQ ID NO: 190312 - DNA, 35 bp, Artificial Sequence
  Synthetic oligonucleotide
agcaccttcaggcccattaaccacggtttcgcccc

SEQ ID NO: 190313 - DNA, 35 bp, Artificial Sequence
  Synthetic oligonucleotide
aagcagtcgagcacgtgcctgttgcccacctcccc

SEQ ID NO: 190314 - DNA, 35 bp, Artificial Sequence
  Synthetic oligonucleotide
tgctctcgcacgacagtcagttcgtccctcttccc

SEQ ID NO: 190315 - DNA, 35 bp, Artificial Sequence
  Synthetic oligonucleotide
cccggtcgtacattccgttgccagccccggttccc

SEQ ID NO: 190316 - DNA, 36 bp, Artificial Sequence
  Synthetic oligonucleotide
tccatccttcccgtaccttcaaggtgggcttacgcc

SEQ ID NO: 190317 - DNA, 35 bp, Artificial Sequence
  Synthetic oligonucleotide
gatgcgtaggacccggcttcctatatttacgctcc

SEQ ID NO: 190318 - DNA, 35 bp, Artificial Sequence
  Synthetic oligonucleotide
gtgactgtgtcatacatgcccaccgtccctattcc

SEQ ID NO: 190319 - DNA, 35 bp, Artificial Sequence
  Synthetic oligonucleotide
taacgcctcggtcctgaaccggcttatgtacttcc

SEQ ID NO: 190320 - DNA, 34 bp, Artificial Sequence
  Synthetic oligonucleotide
atcgaccgtccacctgccgtcattcaccggttcc

SEQ ID NO: 190321 - DNA, 35 bp, Artificial Sequence
  Synthetic oligonucleotide
gccaaacgcccggacgttttttcactccttgttcc

SEQ ID NO: 190322 - DNA, 35 bp, Artificial Sequence
  Synthetic oligonucleotide
tcagccagcctttgctcagtgctcctcgcatttcc

SEQ ID NO: 190323 - DNA, 35 bp, Artificial Sequence
  Synthetic oligonucleotide
accaacacgttatctgtcgcgcaggctctctttcc

SEQ ID NO: 190324 - DNA, 35 bp, Artificial Sequence
  Synthetic oligonucleotide
ttgccgccacccttcctctctggtcaacattacgc

SEQ ID NO: 190325 - DNA, 35 bp, Artificial Sequence
  Synthetic oligonucleotide
ggtgacctcttctcgtttggctaccgtttcaccgc

SEQ ID NO: 190326 - DNA, 36 bp, Artificial Sequence
  Synthetic oligonucleotide
ttcatgccgttcaatcccacccgccttttctgccgc

SEQ ID NO: 190327 - DNA, 35 bp, Artificial Sequence
  Synthetic oligonucleotide
aaccccatcagaatagcggtcagactctcttccgc

SEQ ID NO: 190328 - DNA, 35 bp, Artificial Sequence
  Synthetic oligonucleotide
atgccggcacagccttaccggaacctcttgctcgc

SEQ ID NO: 190329 - DNA, 35 bp, Artificial Sequence
  Synthetic oligonucleotide
gcctccgtagcctgccttttcggtaacgatttcgc

SEQ ID NO: 190330 - DNA, 35 bp, Artificial Sequence
  Synthetic oligonucleotide
tccgcccctcaccatggtaacatacgccctctggc

SEQ ID NO: 190331 - DNA, 35 bp, Artificial Sequence
  Synthetic oligonucleotide
acaacaaccgtagcctttcgcgtcaccatgcctgc

SEQ ID NO: 190332 - DNA, 35 bp, Artificial Sequence
  Synthetic oligonucleotide
tgaaccgccccgaccattatttgctgtcatctatc

SEQ ID NO: 190333 - DNA, 29 bp, Artificial Sequence
  Synthetic oligonucleotide
tagttccgcctcacatgcctcctgcactc

SEQ ID NO: 190334 - DNA, 35 bp, Artificial Sequence
  Synthetic oligonucleotide
tacccgcccgtaagtttcgcttacgttggaacctc

SEQ ID NO: 190335 - DNA, 35 bp, Artificial Sequence
  Synthetic oligonucleotide
acgcagacccgaacgggtcgctcgaaccttgcctc

SEQ ID NO: 190336 - DNA, 35 bp, Artificial Sequence
  Synthetic oligonucleotide
ttatgctataccagcgtgaccttcctatcgtcctc

SEQ ID NO: 190337 - DNA, 35 bp, Artificial Sequence
  Synthetic oligonucleotide
gcatcaccgctttcgaaaccgcccgtccctggctc

SEQ ID NO: 190338 - DNA, 35 bp, Artificial Sequence
  Synthetic oligonucleotide
gtggttccgcagtgcctattatctatactatcgtc

SEQ ID NO: 190339 - DNA, 35 bp, Artificial Sequence
  Synthetic oligonucleotide
gtgccatcgtaggtctccccgtattaccgaaggtc

SEQ ID NO: 190340 - DNA, 35 bp, Artificial Sequence
  Synthetic oligonucleotide
aacccgtctccatcagttctgtcaaacaacgcttc

SEQ ID NO: 190341 - DNA, 35 bp, Artificial Sequence
  Synthetic oligonucleotide
tttggtccggcctttatatatcgcctctaccgttc

SEQ ID NO: 190342 - DNA, 35 bp, Artificial Sequence
  Synthetic oligonucleotide
acggacgactcggccttgtttcacctccatttaag

SEQ ID NO: 190343 - DNA, 35 bp, Artificial Sequence
  Synthetic oligonucleotide
gaaaggagggagattgctaagaggggggttagcag

SEQ ID NO: 190344 - DNA, 35 bp, Artificial Sequence
  Synthetic oligonucleotide
tcgaaaacaacccccgctccactctgcgcactgag

SEQ ID NO: 190345 - DNA, 35 bp, Artificial Sequence
  Synthetic oligonucleotide
taatctcgcccccattattgactattgttctaccg

SEQ ID NO: 190346 - DNA, 35 bp, Artificial Sequence
  Synthetic oligonucleotide
gaagggtgggccgggatgtggggatgggccgagcg

SEQ ID NO: 190347 - DNA, 35 bp, Artificial Sequence
  Synthetic oligonucleotide
tttgccacctctgtcatccgagtcctatccatgcg

SEQ ID NO: 190348 - DNA, 35 bp, Artificial Sequence
  Synthetic oligonucleotide
gcaacctacaccccttagtaccacacgagttctcg

SEQ ID NO: 190349 - DNA, 35 bp, Artificial Sequence
  Synthetic oligonucleotide
ggtgtggggggaggaagtaacgtgacggcgccagg

SEQ ID NO: 190350 - DNA, 35 bp, Artificial Sequence
  Synthetic oligonucleotide
gtgaacccatccgcacctccccgtccgtttcacgg

SEQ ID NO: 190351 - DNA, 35 bp, Artificial Sequence
  Synthetic oligonucleotide
gtgatgacgggtgggcgagaagcttccggggcggg

SEQ ID NO: 190352 - DNA, 35 bp, Artificial Sequence
  Synthetic oligonucleotide
attgccgtttgtgactgtcctttacgtttcccctg

SEQ ID NO: 190353 - DNA, 35 bp, Artificial Sequence
  Synthetic oligonucleotide
atgaagagacacaggggagtaggaaggggtagctg

SEQ ID NO: 190354 - DNA, 35 bp, Artificial Sequence
  Synthetic oligonucleotide
atgctagacgtcgagttgaacccgctcctcctctg

SEQ ID NO: 190355 - DNA, 35 bp, Artificial Sequence
  Synthetic oligonucleotide
actcccccgcccgcttagtggacatatactaagtg

SEQ ID NO: 190356 - DNA, 35 bp, Artificial Sequence
  Synthetic oligonucleotide
actgcacccccttacctggcaacgtaactctcgtg

SEQ ID NO: 190357 - DNA, 35 bp, Artificial Sequence
  Synthetic oligonucleotide
gagggcgtagcgaacggaaggttaggggaagggtg

SEQ ID NO: 190358 - DNA, 35 bp, Artificial Sequence
  Synthetic oligonucleotide
tgccttccaccctctgtttacatttttcgcatgtg

SEQ ID NO: 190359 - DNA, 35 bp, Artificial Sequence
  Synthetic oligonucleotide
tgtagccgccccatctatcgttaccatcgctcttg

SEQ ID NO: 190360 - DNA, 35 bp, Artificial Sequence
  Synthetic oligonucleotide
accatcaccgctagtcgccgggccattatctcttg

SEQ ID NO: 190361 - DNA, 35 bp, Artificial Sequence
  Synthetic oligonucleotide
gtgaggcgttcatgtgggaaggcggagggggcgat

SEQ ID NO: 190362 - DNA, 35 bp, Artificial Sequence
  Synthetic oligonucleotide
tgagtccgagcccccgatttgcgtgctacctaact

SEQ ID NO: 190363 - DNA, 35 bp, Artificial Sequence
  Synthetic oligonucleotide
ttcccgttccatgacaatcgttactatcacacact

SEQ ID NO: 190364 - DNA, 35 bp, Artificial Sequence
  Synthetic oligonucleotide
gcatgtcgccaggcatttagtacttgctccaccct

SEQ ID NO: 190365 - DNA, 35 bp, Artificial Sequence
  Synthetic oligonucleotide
tgcactgcatccacctatcgctctaacctgtccct

SEQ ID NO: 190366 - DNA, 35 bp, Artificial Sequence
  Synthetic oligonucleotide
ttccactccgacgccgagactctcgatactagcct

SEQ ID NO: 190367 - DNA, 33 bp, Artificial Sequence
  Synthetic oligonucleotide
gaacagtgcgcctgtcccctatcccaactgcct

SEQ ID NO: 190368 - DNA, 35 bp, Artificial Sequence
  Synthetic oligonucleotide
tccacactacttctggtgcatttatctcgccctct

SEQ ID NO: 190369 - DNA, 35 bp, Artificial Sequence
  Synthetic oligonucleotide
actccgcatgcacgccgctaccgaacttcatctct

SEQ ID NO: 190370 - DNA, 35 bp, Artificial Sequence
  Synthetic oligonucleotide
gcccaccccgccctgctgaagccgatacctagtct

SEQ ID NO: 190371 - DNA, 35 bp, Artificial Sequence
  Synthetic oligonucleotide
gaccgatggatggatgggggcggtggaatgccagt

SEQ ID NO: 190372 - DNA, 35 bp, Artificial Sequence
  Synthetic oligonucleotide
tctatccccgtccccacttaagcccccacgtccgt

SEQ ID NO: 190373 - DNA, 35 bp, Artificial Sequence
  Synthetic oligonucleotide
ggggagaagctaggggtggtggtttagatgagcgt

SEQ ID NO: 190374 - DNA, 35 bp, Artificial Sequence
  Synthetic oligonucleotide
ttagcgtcctgtctgtctcataccacacttctcgt

SEQ ID NO: 190375 - DNA, 35 bp, Artificial Sequence
  Synthetic oligonucleotide
ttgcccctcgcttagccctgttttttacggccctt

SEQ ID NO: 190376 - DNA, 35 bp, Artificial Sequence
  Synthetic oligonucleotide
ttcagcatccctccggcgattcctccttgccagtt

SEQ ID NO: 190377 - DNA, 35 bp, Artificial Sequence
  Synthetic oligonucleotide
tcccagtcgcctcggtccatgttccaagtcttgtt

SEQ ID NO: 190378 - DNA, 35 bp, Artificial Sequence
  Synthetic oligonucleotide
gccccacccgccattgactgcattaactctccttt

SEQ ID NO: 190379 - DNA, 35 bp, Artificial Sequence
  Synthetic oligonucleotide
tcgatcgcctcttccctgttgcattttggctcttt

SEQ ID NO: 190380 - DNA, 35 bp, Artificial Sequence
  Synthetic oligonucleotide
gcccacatctcttttgtcttgccgacaacggtttt

SEQ ID NO: 190381 - DNA, 35 bp, Artificial Sequence
  Synthetic oligonucleotide
gcccccccgtggtttaaaactgccccaacattttt

SEQ ID NO: 190382 - DNA, 36 bp, Artificial Sequence
  Synthetic oligonucleotide
tccccgccccccatcttcatccagagtcagtttaaa

SEQ ID NO: 190383 - DNA, 35 bp, Artificial Sequence
  Synthetic oligonucleotide
aaggagccgggaaaaggaggggtagggataatgaa

SEQ ID NO: 190384 - DNA, 36 bp, Artificial Sequence
  Synthetic oligonucleotide
agcttaatcgcaggcaggaggggggcaggggttgaa

SEQ ID NO: 190385 - DNA, 35 bp, Artificial Sequence
  Synthetic oligonucleotide
ggggggtcgggtggggtggtgggcagtctgttgaa

SEQ ID NO: 190386 - DNA, 35 bp, Artificial Sequence
  Synthetic oligonucleotide
gccaggatcgggcgcgatggactgggtgttttgaa

SEQ ID NO: 190387 - DNA, 35 bp, Artificial Sequence
  Synthetic oligonucleotide
tgcgaccccctccaatgactagtcgtctctcctaa

SEQ ID NO: 190388 - DNA, 35 bp, Artificial Sequence
  Synthetic oligonucleotide
gcccatggtcctccagtttcgcccgacccttgtaa

SEQ ID NO: 190389 - DNA, 35 bp, Artificial Sequence
  Synthetic oligonucleotide
attcgccgccctcgcatcgtgcctcgcccaattaa

SEQ ID NO: 190390 - DNA, 36 bp, Artificial Sequence
  Synthetic oligonucleotide
tcaatgcgatcccacaaacttatgccctgtccttaa

SEQ ID NO: 190391 - DNA, 35 bp, Artificial Sequence
  Synthetic oligonucleotide
agcctagccgcctccaccgatagccacgactcaca

SEQ ID NO: 190392 - DNA, 36 bp, Artificial Sequence
  Synthetic oligonucleotide
tccaggggagtaaagggggaagggactgggctgaca

SEQ ID NO: 190393 - DNA, 35 bp, Artificial Sequence
  Synthetic oligonucleotide
atgggagggatggggttaggacgggcacattgaca

SEQ ID NO: 190394 - DNA, 34 bp, Artificial Sequence
  Synthetic oligonucleotide
aaccacacctgctttggtttcactaaccgataca

SEQ ID NO: 190395 - DNA, 35 bp, Artificial Sequence
  Synthetic oligonucleotide
gaccacatgcatttcctcgccgcctgttctataca

SEQ ID NO: 190396 - DNA, 36 bp, Artificial Sequence
  Synthetic oligonucleotide
agcgacagccgttccgttcgcgcactgcatacacca

SEQ ID NO: 190397 - DNA, 36 bp, Artificial Sequence
  Synthetic oligonucleotide
ttcgcaaccactccatgctgttactacgttaaccca

SEQ ID NO: 190398 - DNA, 36 bp, Artificial Sequence
  Synthetic oligonucleotide
accacgccttgccccctctacacttgctatcggcca

SEQ ID NO: 190399 - DNA, 35 bp, Artificial Sequence
  Synthetic oligonucleotide
gtcctgccccctccacgtagtttgactcgcttcca

SEQ ID NO: 190400 - DNA, 36 bp, Artificial Sequence
  Synthetic oligonucleotide
gaaacgtagggtagaatgaaaagacgggggagggca

SEQ ID NO: 190401 - DNA, 35 bp, Artificial Sequence
  Synthetic oligonucleotide
tacgctacaatgtcgttctttccttttccttggca

SEQ ID NO: 190402 - DNA, 35 bp, Artificial Sequence
  Synthetic oligonucleotide
gccatcaccgctactgtcttacgctacccctatca

SEQ ID NO: 190403 - DNA, 36 bp, Artificial Sequence
  Synthetic oligonucleotide
tccatcccatctgaagccctgccctgtgtttggtca

SEQ ID NO: 190404 - DNA, 36 bp, Artificial Sequence
  Synthetic oligonucleotide
gtccacccccgtgggtacatcaaccgtcacacttca

SEQ ID NO: 190405 - DNA, 35 bp, Artificial Sequence
  Synthetic oligonucleotide
tgtgttgacgccccggaccgctaatcgaaccttca

SEQ ID NO: 190406 - DNA, 37 bp, Artificial Sequence
  Synthetic oligonucleotide
gtcgacctccgctccttcttctccgcgtttacacaga

SEQ ID NO: 190407 - DNA, 37 bp, Artificial Sequence
  Synthetic oligonucleotide
gtaagggggacagaagggagggacacaggagatcaga

SEQ ID NO: 190408 - DNA, 37 bp, Artificial Sequence
  Synthetic oligonucleotide
tgactcaccccgcccaagtctcattccgttgacgaga

SEQ ID NO: 190409 - DNA, 37 bp, Artificial Sequence
  Synthetic oligonucleotide
ttctcgtcgcctgcccctcttatcaccctgtcggaga

SEQ ID NO: 190410 - DNA, 37 bp, Artificial Sequence
  Synthetic oligonucleotide
gcccccccgcgtgatgcgactcctctccttctctaga

SEQ ID NO: 190411 - DNA, 35 bp, Artificial Sequence
  Synthetic oligonucleotide
ggccccatcccggccgcgtaacaccaccttcacga

SEQ ID NO: 190412 - DNA, 35 bp, Artificial Sequence
  Synthetic oligonucleotide
tgcaacccacatgcgttcaccaccccgctcaccga

SEQ ID NO: 190413 - DNA, 36 bp, Artificial Sequence
  Synthetic oligonucleotide
gcgcatgctcagcgatttaccttcctcggcccccga

SEQ ID NO: 190414 - DNA, 36 bp, Artificial Sequence
  Synthetic oligonucleotide
gcacggtcacttgtcgtacttcttgctatttcccga

SEQ ID NO: 190415 - DNA, 37 bp, Artificial Sequence
  Synthetic oligonucleotide
tgagagtcatcgatgtaattccctcgcctacctccga

SEQ ID NO: 190416 - DNA, 37 bp, Artificial Sequence
  Synthetic oligonucleotide
acccaccgcgccttgtaccattcctattgcccagcga

SEQ ID NO: 190417 - DNA, 37 bp, Artificial Sequence
  Synthetic oligonucleotide
tcaagtcatccgcttcctgtctcacctcgccctgcga

SEQ ID NO: 190418 - DNA, 37 bp, Artificial Sequence
  Synthetic oligonucleotide
gccccgtccactgccatccgtgccgccgaacactcga

SEQ ID NO: 190419 - DNA, 36 bp, Artificial Sequence
  Synthetic oligonucleotide
atcgagtgatgaggagttaaagggtaggtgaaagga

SEQ ID NO: 190420 - DNA, 37 bp, Artificial Sequence
  Synthetic oligonucleotide
cactgcgaactagcttcgtgtgttgtaccatcccgga

SEQ ID NO: 190421 - DNA, 37 bp, Artificial Sequence
  Synthetic oligonucleotide
gtgcgctcagaaaatcgggtgggaagtccgggaggga

SEQ ID NO: 190422 - DNA, 37 bp, Artificial Sequence
  Synthetic oligonucleotide
tgtggggcgtcgtcacagggagggtgtgctgctggga

SEQ ID NO: 190423 - DNA, 37 bp, Artificial Sequence
  Synthetic oligonucleotide
aaacgccgggatggggagggtttagggatgcactgga

SEQ ID NO: 190424 - DNA, 37 bp, Artificial Sequence
  Synthetic oligonucleotide
gcctgggaacacgggggggtgagggactggtagtgga

SEQ ID NO: 190425 - DNA, 37 bp, Artificial Sequence
  Synthetic oligonucleotide
ggagcggggcaggacgggcgagcgaagggtgggtgga

SEQ ID NO: 190426 - DNA, 38 bp, Artificial Sequence
  Synthetic oligonucleotide
ggggaagggaggacgcggatgaggggaagcggggatga

SEQ ID NO: 190427 - DNA, 38 bp, Artificial Sequence
  Synthetic oligonucleotide
ggggggaggaggaaggtgattggtcggacgggatatga

SEQ ID NO: 190428 - DNA, 37 bp, Artificial Sequence
  Synthetic oligonucleotide
tgctcgccatgttctgattgccacaccccctctatga

SEQ ID NO: 190429 - DNA, 37 bp, Artificial Sequence
  Synthetic oligonucleotide
acccagccaacaccagatcatcggcccatccccctga

SEQ ID NO: 190430 - DNA, 37 bp, Artificial Sequence
  Synthetic oligonucleotide
tgcgagtgccgacgatgatatgccccctctacgctga

SEQ ID NO: 190431 - DNA, 38 bp, Artificial Sequence
  Synthetic oligonucleotide
tgccacctggcacacggctgtactaccgacccatctga

SEQ ID NO: 190432 - DNA, 35 bp, Artificial Sequence
  Synthetic oligonucleotide
gttccaacctcattgacgctcttgtaccactctga

SEQ ID NO: 190433 - DNA, 38 bp, Artificial Sequence
  Synthetic oligonucleotide
tcagtcaccctcgtgcaagtcctcacccatttcagtga

SEQ ID NO: 190434 - DNA, 38 bp, Artificial Sequence
  Synthetic oligonucleotide
aacgtcactctcacccttctaccacccacgtcacgtga

SEQ ID NO: 190435 - DNA, 35 bp, Artificial Sequence
  Synthetic oligonucleotide
ttatgcctgtcccatgctgcctccctactcggtga

SEQ ID NO: 190436 - DNA, 38 bp, Artificial Sequence
  Synthetic oligonucleotide
gtgcatggactgcagggggaggccgggaagcagggtga

SEQ ID NO: 190437 - DNA, 38 bp, Artificial Sequence
  Synthetic oligonucleotide
gggacaggggcatggggaagcagggaggcagggggtga

SEQ ID NO: 190438 - DNA, 38 bp, Artificial Sequence
  Synthetic oligonucleotide
tccccaccaatgcgccatcgcgtcagtcccacctgtga

SEQ ID NO: 190439 - DNA, 38 bp, Artificial Sequence
  Synthetic oligonucleotide
gagacggggagacgaaagggggggtgcattgggtgtga

SEQ ID NO: 190440 - DNA, 38 bp, Artificial Sequence
  Synthetic oligonucleotide
tgtgatcgcgccctgccccttacttcacgcccttgtga

SEQ ID NO: 190441 - DNA, 36 bp, Artificial Sequence
  Synthetic oligonucleotide
gaacctcctccatcccgtgcatcccgatcacattga

SEQ ID NO: 190442 - DNA, 37 bp, Artificial Sequence
  Synthetic oligonucleotide
gcattatcgcccgcctgttacaccgccgtgccattga

SEQ ID NO: 190443 - DNA, 38 bp, Artificial Sequence
  Synthetic oligonucleotide
gtcacctagattgccccccagctcgtcgcttcacttga

SEQ ID NO: 190444 - DNA, 37 bp, Artificial Sequence
  Synthetic oligonucleotide
tgtgatcgggcctgtcgcttactcctgccttacttga

SEQ ID NO: 190445 - DNA, 38 bp, Artificial Sequence
  Synthetic oligonucleotide
gaaggggggaaggcgagcatgagggaatactggcttga

SEQ ID NO: 190446 - DNA, 38 bp, Artificial Sequence
  Synthetic oligonucleotide
ggacccgcattgcttttgtctgctcctcccccatttga

SEQ ID NO: 190447 - DNA, 35 bp, Artificial Sequence
  Synthetic oligonucleotide
tatccgtcacgccctcacatagatttacctcgata

SEQ ID NO: 190448 - DNA, 36 bp, Artificial Sequence
  Synthetic oligonucleotide
tatctaccacctcgcatgccggttgacgaacctata

SEQ ID NO: 190449 - DNA, 36 bp, Artificial Sequence
  Synthetic oligonucleotide
agcgctgaccgctgatcttcccgttcacttgcccta

SEQ ID NO: 190450 - DNA, 36 bp, Artificial Sequence
  Synthetic oligonucleotide
acgccaatgtcccatgctccgccaaccgtgatccta

SEQ ID NO: 190451 - DNA, 36 bp, Artificial Sequence
  Synthetic oligonucleotide
tcctcatccgccctagctccattatcatagacgcta

SEQ ID NO: 190452 - DNA, 35 bp, Artificial Sequence
  Synthetic oligonucleotide
tacggttgcacagaactttccatcccgtttctcta

SEQ ID NO: 190453 - DNA, 35 bp, Artificial Sequence
  Synthetic oligonucleotide
atcgtgcgcatagggtggcgggtgggcgttaagta

SEQ ID NO: 190454 - DNA, 36 bp, Artificial Sequence
  Synthetic oligonucleotide
gcccagagacgggagggacgggaaggggaagttgta

SEQ ID NO: 190455 - DNA, 35 bp, Artificial Sequence
  Synthetic oligonucleotide
gaaagccgggcccccgtacgtgaccacacccctta

SEQ ID NO: 190456 - DNA, 36 bp, Artificial Sequence
  Synthetic oligonucleotide
gactacacgtacatgaactcgctcccgaccccctta

SEQ ID NO: 190457 - DNA, 35 bp, Artificial Sequence
  Synthetic oligonucleotide
tgagagccatcgcccctgtttgcttattcgcctta

SEQ ID NO: 190458 - DNA, 36 bp, Artificial Sequence
  Synthetic oligonucleotide
gtcccccgtcctaggtttttcgtattccccctgtta

SEQ ID NO: 190459 - DNA, 35 bp, Artificial Sequence
  Synthetic oligonucleotide
accgacacggttccgtctcttttattacgctacac

SEQ ID NO: 190460 - DNA, 35 bp, Artificial Sequence
  Synthetic oligonucleotide
tccccctccccatgtatgatcacgcgaaacgccac

SEQ ID NO: 190461 - DNA, 35 bp, Artificial Sequence
  Synthetic oligonucleotide
gccagggccacgctagttctataggcctctttcac

SEQ ID NO: 190462 - DNA, 35 bp, Artificial Sequence
  Synthetic oligonucleotide
ttgcaccggacgttaccggctgacttctttcttac

SEQ ID NO: 190463 - DNA, 34 bp, Artificial Sequence
  Synthetic oligonucleotide
tcccagccggacgttatctccgctgcactccacc

SEQ ID NO: 190464 - DNA, 35 bp, Artificial Sequence
  Synthetic oligonucleotide
gatgcctgtctcgtacctgttaaatcttgcatacc

SEQ ID NO: 190465 - DNA, 35 bp, Artificial Sequence
  Synthetic oligonucleotide
tagcagtgcctgcacctccactagagctttacccc

SEQ ID NO: 190466 - DNA, 35 bp, Artificial Sequence
  Synthetic oligonucleotide
acaccacccgccccacttaaagcgtccggcccccc

SEQ ID NO: 190467 - DNA, 35 bp, Artificial Sequence
  Synthetic oligonucleotide
tcctggcgcgatgtctccaccgtaaacatcccccc

SEQ ID NO: 190468 - DNA, 35 bp, Artificial Sequence
  Synthetic oligonucleotide
tatgcctgcccctggccaatggtcccgacctcccc

SEQ ID NO: 190469 - DNA, 35 bp, Artificial Sequence
  Synthetic oligonucleotide
tcgacccattggatgtcccccttaccgcgtggccc

SEQ ID NO: 190470 - DNA, 35 bp, Artificial Sequence
  Synthetic oligonucleotide
atcgcgcacacgactattatcctactctacttccc

SEQ ID NO: 190471 - DNA, 35 bp, Artificial Sequence
  Synthetic oligonucleotide
acaccacctcaccatctgtgcttcttacactggcc

SEQ ID NO: 190472 - DNA, 34 bp, Artificial Sequence
  Synthetic oligonucleotide
tcactcaacctcatcgcagacgcgtaatccatcc

SEQ ID NO: 190473 - DNA, 35 bp, Artificial Sequence
  Synthetic oligonucleotide
atacgttgccccgatcgcgagtttattccttctcc

SEQ ID NO: 190474 - DNA, 35 bp, Artificial Sequence
  Synthetic oligonucleotide
ttccgccgcttttatctgttccacttcgagcgtcc

SEQ ID NO: 190475 - DNA, 35 bp, Artificial Sequence
  Synthetic oligonucleotide
tccactcctgtgcccttcgatagcataacctccgc

SEQ ID NO: 190476 - DNA, 35 bp, Artificial Sequence
  Synthetic oligonucleotide
gacctcctgcccgactgtccggaagtaaattccgc

SEQ ID NO: 190477 - DNA, 35 bp, Artificial Sequence
  Synthetic oligonucleotide
gcccgccccgcccgtcgttcaccctttactcttgc

SEQ ID NO: 190478 - DNA, 35 bp, Artificial Sequence
  Synthetic oligonucleotide
tatgcaacgccctctcccctccttcagccgcaatc

SEQ ID NO: 190479 - DNA, 35 bp, Artificial Sequence
  Synthetic oligonucleotide
tgtaccccctcgatcgctcaccgtgctggctcatc

SEQ ID NO: 190480 - DNA, 35 bp, Artificial Sequence
  Synthetic oligonucleotide
atgcatgcggtacgcattcgggctcccatttcatc

SEQ ID NO: 190481 - DNA, 35 bp, Artificial Sequence
  Synthetic oligonucleotide
tgttaccctcggccttccatgacttttttcttatc

SEQ ID NO: 190482 - DNA, 35 bp, Artificial Sequence
  Synthetic oligonucleotide
gtctccctccttcacgagtacgggcggaccccctc

SEQ ID NO: 190483 - DNA, 35 bp, Artificial Sequence
  Synthetic oligonucleotide
tcatacgcgcagaatgtcggcagtttcccccgctc

SEQ ID NO: 190484 - DNA, 35 bp, Artificial Sequence
  Synthetic oligonucleotide
gattacacgcctgctgccaccgcatcagttcgctc

SEQ ID NO: 190485 - DNA, 35 bp, Artificial Sequence
  Synthetic oligonucleotide
atgcccccttcattcagctccatgcgctcaatctc

SEQ ID NO: 190486 - DNA, 35 bp, Artificial Sequence
  Synthetic oligonucleotide
tgcacgtactttggccggtatgttgttctcctctc

SEQ ID NO: 190487 - DNA, 35 bp, Artificial Sequence
  Synthetic oligonucleotide
agcgcatcggatctttcattcgcccatatcccgtc

SEQ ID NO: 190488 - DNA, 35 bp, Artificial Sequence
  Synthetic oligonucleotide
gcctgtcgctcgttgcagtttccctattcgcattc

SEQ ID NO: 190489 - DNA, 35 bp, Artificial Sequence
  Synthetic oligonucleotide
tccaacccctgtagtttgtatcctgtcgactcttc

SEQ ID NO: 190490 - DNA, 35 bp, Artificial Sequence
  Synthetic oligonucleotide
actagtcgccccagactagattcgccaccccgttc

SEQ ID NO: 190491 - DNA, 35 bp, Artificial Sequence
  Synthetic oligonucleotide
tgacgctggcctaatcctctgctctacgcccgttc

SEQ ID NO: 190492 - DNA, 35 bp, Artificial Sequence
  Synthetic oligonucleotide
aatgcaccacggcgccctctatctcatatatgttc

SEQ ID NO: 190493 - DNA, 35 bp, Artificial Sequence
  Synthetic oligonucleotide
aagccatgggggcgggaaaaggggtcaaggatgag

SEQ ID NO: 190494 - DNA, 35 bp, Artificial Sequence
  Synthetic oligonucleotide
tgctaatacggaggggcgggagagggcgggtcacg

SEQ ID NO: 190495 - DNA, 35 bp, Artificial Sequence
  Synthetic oligonucleotide
taccaccacctcgtaagctttcgcgctgttttacg

SEQ ID NO: 190496 - DNA, 35 bp, Artificial Sequence
  Synthetic oligonucleotide
tccctgcgagatcctgtggcatacatccttctccg

SEQ ID NO: 190497 - DNA, 35 bp, Artificial Sequence
  Synthetic oligonucleotide
actccttacgccgtattgccatccgttttatcgcg

SEQ ID NO: 190498 - DNA, 35 bp, Artificial Sequence
  Synthetic oligonucleotide
gcacggccattcgatcctgtccctatagtactgcg

SEQ ID NO: 190499 - DNA, 35 bp, Artificial Sequence
  Synthetic oligonucleotide
tcacatccctcgttcttttcggatcgcctctctcg

SEQ ID NO: 190500 - DNA, 35 bp, Artificial Sequence
  Synthetic oligonucleotide
atgagagggtcgcaaagggggagcaggattcaagg

SEQ ID NO: 190501 - DNA, 35 bp, Artificial Sequence
  Synthetic oligonucleotide
aattcgcgccctctgcttatctcataatctacctg

SEQ ID NO: 190502 - DNA, 35 bp, Artificial Sequence
  Synthetic oligonucleotide
acttgcacgctatccccttcattctcccatccctg

SEQ ID NO: 190503 - DNA, 35 bp, Artificial Sequence
  Synthetic oligonucleotide
gtgactccgctgtatctgccccccctcgtttgttg

SEQ ID NO: 190504 - DNA, 35 bp, Artificial Sequence
  Synthetic oligonucleotide
gaccgccacatctccattatctgtacggtttcaat

SEQ ID NO: 190505 - DNA, 35 bp, Artificial Sequence
  Synthetic oligonucleotide
ttacaccctcggctcgtagttctcgtcacccgaat

SEQ ID NO: 190506 - DNA, 35 bp, Artificial Sequence
  Synthetic oligonucleotide
tccgcgccctctagactatcataccatcaccttat

SEQ ID NO: 190507 - DNA, 35 bp, Artificial Sequence
  Synthetic oligonucleotide
aagtaaccccgtcgcctgcacttggccacctaact

SEQ ID NO: 190508 - DNA, 35 bp, Artificial Sequence
  Synthetic oligonucleotide
tcatacaccctgtaccaccagtccgccattggact

SEQ ID NO: 190509 - DNA, 35 bp, Artificial Sequence
  Synthetic oligonucleotide
aagcctgccaccatttagtgctctcatttcctact

SEQ ID NO: 190510 - DNA, 35 bp, Artificial Sequence
  Synthetic oligonucleotide
gaccagtagtcgttcccgagctccctccacgacct

SEQ ID NO: 190511 - DNA, 35 bp, Artificial Sequence
  Synthetic oligonucleotide
tgtggcccttcctgcttgtttcactttatcgacct

SEQ ID NO: 190512 - DNA, 34 bp, Artificial Sequence
  Synthetic oligonucleotide
ttcatgaagccctacccgactgttctgctaccct

SEQ ID NO: 190513 - DNA, 35 bp, Artificial Sequence
  Synthetic oligonucleotide
gccaccggcctttaaagggcattacgacctcccct

SEQ ID NO: 190514 - DNA, 35 bp, Artificial Sequence
  Synthetic oligonucleotide
gacgcattcgaccacctcatcgtattagtccgcct

SEQ ID NO: 190515 - DNA, 35 bp, Artificial Sequence
  Synthetic oligonucleotide
aggaaccgcccagacgcaatccatcttcagctgct

SEQ ID NO: 190516 - DNA, 35 bp, Artificial Sequence
  Synthetic oligonucleotide
tcttgccaaatccgttccgtcatgcgtacacctct

SEQ ID NO: 190517 - DNA, 36 bp, Artificial Sequence
  Synthetic oligonucleotide
tactctcagtgtgtgccactaccccttcttacctct

SEQ ID NO: 190518 - DNA, 35 bp, Artificial Sequence
  Synthetic oligonucleotide
gactcgggtgtctattgccctccctttccaacggt

SEQ ID NO: 190519 - DNA, 35 bp, Artificial Sequence
  Synthetic oligonucleotide
ggacccaccccatctgtcatgagatcctagcgatt

SEQ ID NO: 190520 - DNA, 35 bp, Artificial Sequence
  Synthetic oligonucleotide
atgttgtgccctggccggtcattttttgcctcctt

SEQ ID NO: 190521 - DNA, 35 bp, Artificial Sequence
  Synthetic oligonucleotide
tctgctgcaccatctttgatactatcgcgtttctt

SEQ ID NO: 190522 - DNA, 35 bp, Artificial Sequence
  Synthetic oligonucleotide
gacatcatccctggtatgactcaaccgcctccttt

SEQ ID NO: 190523 - DNA, 35 bp, Artificial Sequence
  Synthetic oligonucleotide
gacaactgggcgcaaggggggggaacgggcggaaa

SEQ ID NO: 190524 - DNA, 35 bp, Artificial Sequence
  Synthetic oligonucleotide
gcaggggggggagggatgggagagcgtgagctaaa

SEQ ID NO: 190525 - DNA, 35 bp, Artificial Sequence
  Synthetic oligonucleotide
gcaaccccagctgcccaactcactacctaccgcaa

SEQ ID NO: 190526 - DNA, 36 bp, Artificial Sequence
  Synthetic oligonucleotide
tccacctatcaccattgttaatgcccgccggatcaa

SEQ ID NO: 190527 - DNA, 35 bp, Artificial Sequence
  Synthetic oligonucleotide
tcctccgcccccattgtgcaccacttcgtagttaa

SEQ ID NO: 190528 - DNA, 35 bp, Artificial Sequence
  Synthetic oligonucleotide
actcgcccaccctcgcccgtcgaatgaccttacca

SEQ ID NO: 190529 - DNA, 34 bp, Artificial Sequence
  Synthetic oligonucleotide
tgagtcgagtatatgtcgtcctgcccttgcccca

SEQ ID NO: 190530 - DNA, 36 bp, Artificial Sequence
  Synthetic oligonucleotide
gatgattgttcagctctgtccctcgccatgctccca

SEQ ID NO: 190531 - DNA, 36 bp, Artificial Sequence
  Synthetic oligonucleotide
ggatgccgtgctggtcccgtcgtcctctctactcca

SEQ ID NO: 190532 - DNA, 35 bp, Artificial Sequence
  Synthetic oligonucleotide
gatcaggccggggggcggtaacaaggaatggggca

SEQ ID NO: 190533 - DNA, 35 bp, Artificial Sequence
  Synthetic oligonucleotide
acgtgaggaggatagggtggtagagaaagaatgca

SEQ ID NO: 190534 - DNA, 36 bp, Artificial Sequence
  Synthetic oligonucleotide
gccgagcttcccatgcatttttgaatttgcccctca

SEQ ID NO: 190535 - DNA, 36 bp, Artificial Sequence
  Synthetic oligonucleotide
atcgctgtacgtatcctgctctgtttcaccgcctca

SEQ ID NO: 190536 - DNA, 36 bp, Artificial Sequence
  Synthetic oligonucleotide
tggtaccgcccctgttttcaagtaattcgcccgtca

SEQ ID NO: 190537 - DNA, 35 bp, Artificial Sequence
  Synthetic oligonucleotide
gtcaccctccctgagtaaccgacgctattttgtca

SEQ ID NO: 190538 - DNA, 35 bp, Artificial Sequence
  Synthetic oligonucleotide
atcgacgtccggcgcctacatcgtttcattcttca

SEQ ID NO: 190539 - DNA, 35 bp, Artificial Sequence
  Synthetic oligonucleotide
gagatgaaatctgatgcgctactcaccacctttca

SEQ ID NO: 190540 - DNA, 36 bp, Artificial Sequence
  Synthetic oligonucleotide
gatcatctcacctgccctaccgtgccacttgtttca

SEQ ID NO: 190541 - DNA, 37 bp, Artificial Sequence
  Synthetic oligonucleotide
gccatatgtcgagtgggtaagggcggggcggaaaaga

SEQ ID NO: 190542 - DNA, 37 bp, Artificial Sequence
  Synthetic oligonucleotide
actccatccccatgctctgcgcctcatagacccaaga

SEQ ID NO: 190543 - DNA, 37 bp, Artificial Sequence
  Synthetic oligonucleotide
gggatggggagttggacataggattgcacggggaaga

SEQ ID NO: 190544 - DNA, 37 bp, Artificial Sequence
  Synthetic oligonucleotide
accgggagggttggggcagggttagacaaatgacaga

SEQ ID NO: 190545 - DNA, 37 bp, Artificial Sequence
  Synthetic oligonucleotide
tcaggaaggatggagggcgggcgttccggagggcaga

SEQ ID NO: 190546 - DNA, 37 bp, Artificial Sequence
  Synthetic oligonucleotide
gaggaagtaggaaggcacagtggggagtgatgggaga

SEQ ID NO: 190547 - DNA, 37 bp, Artificial Sequence
  Synthetic oligonucleotide
gagaatgaggaggacgggggggtaagctagttggaga

SEQ ID NO: 190548 - DNA, 37 bp, Artificial Sequence
  Synthetic oligonucleotide
actgacccgtcgtttcttccgtccgtccccaatgaga

SEQ ID NO: 190549 - DNA, 37 bp, Artificial Sequence
  Synthetic oligonucleotide
ttggtgccgtcattttatgctaccctcacctcctaga

SEQ ID NO: 190550 - DNA, 37 bp, Artificial Sequence
  Synthetic oligonucleotide
agaggtgggctggggtgggagggacttaatacaacga

SEQ ID NO: 190551 - DNA, 37 bp, Artificial Sequence
  Synthetic oligonucleotide
tcccatcatccttcgtgcccgccactgctcatgacga

SEQ ID NO: 190552 - DNA, 37 bp, Artificial Sequence
  Synthetic oligonucleotide
gtcaaccagagcgcactagcccgccgcttccctacga

SEQ ID NO: 190553 - DNA, 37 bp, Artificial Sequence
  Synthetic oligonucleotide
tccccactccgttttcgtccgcgctcggtctaaccga

SEQ ID NO: 190554 - DNA, 35 bp, Artificial Sequence
  Synthetic oligonucleotide
tagccatccctccgttcttgtgccatcttgcccga

SEQ ID NO: 190555 - DNA, 37 bp, Artificial Sequence
  Synthetic oligonucleotide
acagcaccataacacaagtgcctgctacccttcccga

SEQ ID NO: 190556 - DNA, 37 bp, Artificial Sequence
  Synthetic oligonucleotide
ggagacacggggggaaggaggtccggagcaaacgcga

SEQ ID NO: 190557 - DNA, 37 bp, Artificial Sequence
  Synthetic oligonucleotide
taccatctgtattgctccacgtccctcatctccgcga

SEQ ID NO: 190558 - DNA, 36 bp, Artificial Sequence
  Synthetic oligonucleotide
ttgaccgtacattctgtttcacctcgaccccctcga

SEQ ID NO: 190559 - DNA, 31 bp, Artificial Sequence
  Synthetic oligonucleotide
tcatacacgccgccccacctcttcgcttcga

SEQ ID NO: 190560 - DNA, 37 bp, Artificial Sequence
  Synthetic oligonucleotide
gcccttcccctttgcgcatgttacagctcttcttcga

SEQ ID NO: 190561 - DNA, 37 bp, Artificial Sequence
  Synthetic oligonucleotide
accgccccttgattgcctcgtctagctccgttacgga

SEQ ID NO: 190562 - DNA, 36 bp, Artificial Sequence
  Synthetic oligonucleotide
aagtggagggaagggcacagagatggtaaacgggga

SEQ ID NO: 190563 - DNA, 37 bp, Artificial Sequence
  Synthetic oligonucleotide
gccagtccacctgcgtgccttcccgcctacctttgga

SEQ ID NO: 190564 - DNA, 38 bp, Artificial Sequence
  Synthetic oligonucleotide
aagcgggacagggcatgtatgggcgggagagcacatga

SEQ ID NO: 190565 - DNA, 36 bp, Artificial Sequence
  Synthetic oligonucleotide
tgattccgccactaactgcatcttctgacttcatga

SEQ ID NO: 190566 - DNA, 38 bp, Artificial Sequence
  Synthetic oligonucleotide
gcgtaactagatggtcggaaggaggaggggggggatga

SEQ ID NO: 190567 - DNA, 38 bp, Artificial Sequence
  Synthetic oligonucleotide
gtgcaataaagccagtgagggaggggaggctgggatga

SEQ ID NO: 190568 - DNA, 38 bp, Artificial Sequence
  Synthetic oligonucleotide
tagtagaacctcagcctgctccctttcctgtaccctga

SEQ ID NO: 190569 - DNA, 35 bp, Artificial Sequence
  Synthetic oligonucleotide
ttgcatccctccccgcttcattacgcttcgcctga

SEQ ID NO: 190570 - DNA, 38 bp, Artificial Sequence
  Synthetic oligonucleotide
tcctacccaccacagtgtgcctttcgatgctccgctga

SEQ ID NO: 190571 - DNA, 38 bp, Artificial Sequence
  Synthetic oligonucleotide
atcactacagcatgtgtgcttctccccgttctcgctga

SEQ ID NO: 190572 - DNA, 38 bp, Artificial Sequence
  Synthetic oligonucleotide
agaccatgtcgcggcacaatccatcattccacctctga

SEQ ID NO: 190573 - DNA, 38 bp, Artificial Sequence
  Synthetic oligonucleotide
tcttccgcccatggtgcctggccttatacactctctga

SEQ ID NO: 190574 - DNA, 38 bp, Artificial Sequence
  Synthetic oligonucleotide
ggtacatcgagggggggggcgagactagggagaagtga

SEQ ID NO: 190575 - DNA, 38 bp, Artificial Sequence
  Synthetic oligonucleotide
aagcgacggggggcaagtggagggcgtggatggagtga

SEQ ID NO: 190576 - DNA, 37 bp, Artificial Sequence
  Synthetic oligonucleotide
gggtagtccccgctgctcctatccgatcctgacgtga

SEQ ID NO: 190577 - DNA, 38 bp, Artificial Sequence
  Synthetic oligonucleotide
gtacgcccccttctgctgcctgtaagctcatttcgtga

SEQ ID NO: 190578 - DNA, 38 bp, Artificial Sequence
  Synthetic oligonucleotide
acgtggaaaggggaaatgagagggctagggggtggtga

SEQ ID NO: 190579 - DNA, 38 bp, Artificial Sequence
  Synthetic oligonucleotide
aagggggaaaatcaggaggggaacatgggagggtgtga

SEQ ID NO: 190580 - DNA, 38 bp, Artificial Sequence
  Synthetic oligonucleotide
tagccgcacgctccctgcaccgtttacatcatcattga

SEQ ID NO: 190581 - DNA, 38 bp, Artificial Sequence
  Synthetic oligonucleotide
tactccgtacattctgtttttacatacacactccttga

SEQ ID NO: 190582 - DNA, 38 bp, Artificial Sequence
  Synthetic oligonucleotide
ttcagctctgccgttcctctagcgcattatcctcttga

SEQ ID NO: 190583 - DNA, 38 bp, Artificial Sequence
  Synthetic oligonucleotide
gtcacaccgcccatgcccctatagttgccttctgttga

SEQ ID NO: 190584 - DNA, 36 bp, Artificial Sequence
  Synthetic oligonucleotide
gactcgcgtttgtctgcttcgcgccttcctttttga

SEQ ID NO: 190585 - DNA, 36 bp, Artificial Sequence
  Synthetic oligonucleotide
tcccatgcccggtgctctactgcgtgctaatctata

SEQ ID NO: 190586 - DNA, 37 bp, Artificial Sequence
  Synthetic oligonucleotide
gccctttgcccgccgtatcgttaatcggaaccgccta

SEQ ID NO: 190587 - DNA, 35 bp, Artificial Sequence
  Synthetic oligonucleotide
tgaccgccctggcttgcatgtccataccactccta

SEQ ID NO: 190588 - DNA, 36 bp, Artificial Sequence
  Synthetic oligonucleotide
actgccatggcggacggtcataggccctctcatcta

SEQ ID NO: 190589 - DNA, 35 bp, Artificial Sequence
  Synthetic oligonucleotide
tatccgtaaggatgcgtcgggtacacctccctcta

SEQ ID NO: 190590 - DNA, 36 bp, Artificial Sequence
  Synthetic oligonucleotide
agtctcgggcgggaggggaagggtaggcgtcctcta

SEQ ID NO: 190591 - DNA, 36 bp, Artificial Sequence
  Synthetic oligonucleotide
tttacacacacattgccctgttcatcctttggtcta

SEQ ID NO: 190592 - DNA, 36 bp, Artificial Sequence
  Synthetic oligonucleotide
ggggtcggggcgggaaggggtaatcatatagtagta

SEQ ID NO: 190593 - DNA, 35 bp, Artificial Sequence
  Synthetic oligonucleotide
acagacagcactcagccagcgctgctcctcctgta

SEQ ID NO: 190594 - DNA, 35 bp, Artificial Sequence
  Synthetic oligonucleotide
agtgacaccctagcagcctcttaattatgccctta

SEQ ID NO: 190595 - DNA, 35 bp, Artificial Sequence
  Synthetic oligonucleotide
tacaccgctactcctttttcagtggacctttctta

SEQ ID NO: 190596 - DNA, 36 bp, Artificial Sequence
  Synthetic oligonucleotide
gaccgcccgcttgttagcgtctctcttctctgttta

SEQ ID NO: 190597 - DNA, 35 bp, Artificial Sequence
  Synthetic oligonucleotide
gactacacgccggagtatccaccgcccattgcaac

SEQ ID NO: 190598 - DNA, 35 bp, Artificial Sequence
  Synthetic oligonucleotide
tacgactccaccgccatatactggtacaccgtcac

SEQ ID NO: 190599 - DNA, 35 bp, Artificial Sequence
  Synthetic oligonucleotide
tccacgggaagtcgggaaagataggaggagacgac

SEQ ID NO: 190600 - DNA, 35 bp, Artificial Sequence
  Synthetic oligonucleotide
tcgctggtcaatcattgcatccccggaccaccgac

SEQ ID NO: 190601 - DNA, 35 bp, Artificial Sequence
  Synthetic oligonucleotide
gaggatggacgccctctccgttctacctactgtac

SEQ ID NO: 190602 - DNA, 35 bp, Artificial Sequence
  Synthetic oligonucleotide
gttctcgatcccacctgttgtagtccccataaacc

SEQ ID NO: 190603 - DNA, 35 bp, Artificial Sequence
  Synthetic oligonucleotide
aaggtgcgcacagcgttgcctgtctttcatccacc

SEQ ID NO: 190604 - DNA, 35 bp, Artificial Sequence
  Synthetic oligonucleotide
tctcctcacccccagactcttgatagggaactacc

SEQ ID NO: 190605 - DNA, 35 bp, Artificial Sequence
  Synthetic oligonucleotide
gtggctgtagcgttcgttatcgccacatccttacc

SEQ ID NO: 190606 - DNA, 35 bp, Artificial Sequence
  Synthetic oligonucleotide
ttcacgctcccatcaagcccatttagacgcttccc

SEQ ID NO: 190607 - DNA, 35 bp, Artificial Sequence
  Synthetic oligonucleotide
gttgccagtcatacccgtccccgatgtccgttccc

SEQ ID NO: 190608 - DNA, 35 bp, Artificial Sequence
  Synthetic oligonucleotide
gaggccaccccgcaatgcagccatttccacccgcc

SEQ ID NO: 190609 - DNA, 35 bp, Artificial Sequence
  Synthetic oligonucleotide
gttccaatgccgacccacttgtttccagttctgcc

SEQ ID NO: 190610 - DNA, 35 bp, Artificial Sequence
  Synthetic oligonucleotide
gtgcgctccatcttcgtccctggataactcaatcc

SEQ ID NO: 190611 - DNA, 35 bp, Artificial Sequence
  Synthetic oligonucleotide
gtacctgcctccgtcccttaaagtctacccattcc

SEQ ID NO: 190612 - DNA, 35 bp, Artificial Sequence
  Synthetic oligonucleotide
tacgccacctgaaccgatcggtttcacgtacttcc

SEQ ID NO: 190613 - DNA, 35 bp, Artificial Sequence
  Synthetic oligonucleotide
gacgcctcaattatgcccaggtccagcccccttcc

SEQ ID NO: 190614 - DNA, 35 bp, Artificial Sequence
  Synthetic oligonucleotide
tttgtgcctcgcctgattatccctgcggcccttcc

SEQ ID NO: 190615 - DNA, 35 bp, Artificial Sequence
  Synthetic oligonucleotide
gtccgcccacctagtttgcttagggcacctcttcc

SEQ ID NO: 190616 - DNA, 35 bp, Artificial Sequence
  Synthetic oligonucleotide
tgacgccccagcacactgttccgcttatgccttgc

SEQ ID NO: 190617 - DNA, 35 bp, Artificial Sequence
  Synthetic oligonucleotide
atgccatcagccgttctttcccgctctccttcctc

SEQ ID NO: 190618 - DNA, 35 bp, Artificial Sequence
  Synthetic oligonucleotide
atcgtacgcatatctgttggctgtttcccgtgctc

SEQ ID NO: 190619 - DNA, 35 bp, Artificial Sequence
  Synthetic oligonucleotide
tccgccacgccaactcctatttcacgctgtctctc

SEQ ID NO: 190620 - DNA, 35 bp, Artificial Sequence
  Synthetic oligonucleotide
ttgaacatccgcctctaccatgccgatcgggtctc

SEQ ID NO: 190621 - DNA, 35 bp, Artificial Sequence
  Synthetic oligonucleotide
aatgtgcgggttacgatctactgcctgcctttctc

SEQ ID NO: 190622 - DNA, 35 bp, Artificial Sequence
  Synthetic oligonucleotide
tccctccgcctacaatctttgcgtgttcctgggtc

SEQ ID NO: 190623 - DNA, 35 bp, Artificial Sequence
  Synthetic oligonucleotide
actgagcgccattacctattacggcttctaccttc

SEQ ID NO: 190624 - DNA, 35 bp, Artificial Sequence
  Synthetic oligonucleotide
gtggcaagagtcctggtctttgtccctaccccttc

SEQ ID NO: 190625 - DNA, 35 bp, Artificial Sequence
  Synthetic oligonucleotide
tgccggtcccttgtcttgcttttcgaccccagttc

SEQ ID NO: 190626 - DNA, 35 bp, Artificial Sequence
  Synthetic oligonucleotide
tccggacaagggtgaggaggggggtgagaccgttc

SEQ ID NO: 190627 - DNA, 35 bp, Artificial Sequence
  Synthetic oligonucleotide
atgggtggcgggtgggaaaagacaccactctgtag

SEQ ID NO: 190628 - DNA, 29 bp, Artificial Sequence
  Synthetic oligonucleotide
atactttgcctcagctctcctgactcccg

SEQ ID NO: 190629 - DNA, 35 bp, Artificial Sequence
  Synthetic oligonucleotide
gaaagggagggtggagatgggcggaaacccacgcg

SEQ ID NO: 190630 - DNA, 35 bp, Artificial Sequence
  Synthetic oligonucleotide
gggtggcgggggggttttgtggatggcacatcgcg

SEQ ID NO: 190631 - DNA, 35 bp, Artificial Sequence
  Synthetic oligonucleotide
accgtatgtcactttggcctttcgctgtttactcg

SEQ ID NO: 190632 - DNA, 35 bp, Artificial Sequence
  Synthetic oligonucleotide
gcacgaaaaggggcgaatactgggaacagaagggg

SEQ ID NO: 190633 - DNA, 35 bp, Artificial Sequence
  Synthetic oligonucleotide
tcgtgtgcacacacgcgtcgctccttctaacctgg

SEQ ID NO: 190634 - DNA, 35 bp, Artificial Sequence
  Synthetic oligonucleotide
tagtcgccctccagaaagccccataccccctaatg

SEQ ID NO: 190635 - DNA, 35 bp, Artificial Sequence
  Synthetic oligonucleotide
gaggggggtgagggtggaattgtatactgtgcttg

SEQ ID NO: 190636 - DNA, 35 bp, Artificial Sequence
  Synthetic oligonucleotide
tcacgactcccgctgcctcctccatcatgctcttg

SEQ ID NO: 190637 - DNA, 35 bp, Artificial Sequence
  Synthetic oligonucleotide
acacgcgtatcggtcccctcccctgaattgcgcat

SEQ ID NO: 190638 - DNA, 35 bp, Artificial Sequence
  Synthetic oligonucleotide
atgtaggaggggatggggtagggtggtgactgtat

SEQ ID NO: 190639 - DNA, 35 bp, Artificial Sequence
  Synthetic oligonucleotide
tacacctccgctttgcaataacgcctgagttaact

SEQ ID NO: 190640 - DNA, 35 bp, Artificial Sequence
  Synthetic oligonucleotide
ttaccgcactgggaggtccgaattgtgccctatct

SEQ ID NO: 190641 - DNA, 35 bp, Artificial Sequence
  Synthetic oligonucleotide
acccttcaccggtgcctgattgccgcctgctatct

SEQ ID NO: 190642 - DNA, 35 bp, Artificial Sequence
  Synthetic oligonucleotide
tccaccctacctacatatgccgcaaatttgcgtct

SEQ ID NO: 190643 - DNA, 35 bp, Artificial Sequence
  Synthetic oligonucleotide
attgccattgtgagtgcgtcctacccgccgcttct

SEQ ID NO: 190644 - DNA, 35 bp, Artificial Sequence
  Synthetic oligonucleotide
tccgatgcacacatggtttccctcttgcctcttct

SEQ ID NO: 190645 - DNA, 35 bp, Artificial Sequence
  Synthetic oligonucleotide
gcactcctccgcaccagccctgcctgtttaccagt

SEQ ID NO: 190646 - DNA, 35 bp, Artificial Sequence
  Synthetic oligonucleotide
tctagccccttccccacttaagcccccacgtccgt

SEQ ID NO: 190647 - DNA, 35 bp, Artificial Sequence
  Synthetic oligonucleotide
tccaccatcactccgatttaacgacgccgtcttgt

SEQ ID NO: 190648 - DNA, 35 bp, Artificial Sequence
  Synthetic oligonucleotide
tgataacgcctgtcctgctgtcattcccagccatt

SEQ ID NO: 190649 - DNA, 35 bp, Artificial Sequence
  Synthetic oligonucleotide
gatcccgccggcgacggcttagtcgcttacacctt

SEQ ID NO: 190650 - DNA, 35 bp, Artificial Sequence
  Synthetic oligonucleotide
gttgccctacgatcattaaggccctctttctcgtt

SEQ ID NO: 190651 - DNA, 35 bp, Artificial Sequence
  Synthetic oligonucleotide
gccccccccgccttgaattgttctctgtccaggtt

SEQ ID NO: 190652 - DNA, 35 bp, Artificial Sequence
  Synthetic oligonucleotide
acacgctcacccggtaatttctgccctgctatgtt

SEQ ID NO: 190653 - DNA, 35 bp, Artificial Sequence
  Synthetic oligonucleotide
tgccatcttcgctccgtgaggctacgctctccttt

SEQ ID NO: 190654 - DNA, 36 bp, Artificial Sequence
  Synthetic oligonucleotide
atcccccgcggaacacgcgtatcctgcccggtccaa

SEQ ID NO: 190655 - DNA, 36 bp, Artificial Sequence
  Synthetic oligonucleotide
gttgggctgatgggggatcgggggagggctagtcaa

SEQ ID NO: 190656 - DNA, 36 bp, Artificial Sequence
  Synthetic oligonucleotide
atcgcgccctgttctaagcgtaggctctctcttcaa

SEQ ID NO: 190657 - DNA, 36 bp, Artificial Sequence
  Synthetic oligonucleotide
gaatagtgacagtggggggggggcaaagggcagtaa

SEQ ID NO: 190658 - DNA, 35 bp, Artificial Sequence
  Synthetic oligonucleotide
gtagagctcgggcggtgcggtgggaaaggggaaca

SEQ ID NO: 190659 - DNA, 36 bp, Artificial Sequence
  Synthetic oligonucleotide
tcagagctcccgccctcgatgtttcccacgttaaca

SEQ ID NO: 190660 - DNA, 36 bp, Artificial Sequence
  Synthetic oligonucleotide
tcttgcccctaggttataccgccacaattccaccca

SEQ ID NO: 190661 - DNA, 36 bp, Artificial Sequence
  Synthetic oligonucleotide
gctaggcgtccacatgggtccccgcttcatccccca

SEQ ID NO: 190662 - DNA, 36 bp, Artificial Sequence
  Synthetic oligonucleotide
tacgccctgcggctatgttttcgcacccctgcccca

SEQ ID NO: 190663 - DNA, 35 bp, Artificial Sequence
  Synthetic oligonucleotide
gcgccccctctatcatgccttggccgcctcgtcca

SEQ ID NO: 190664 - DNA, 35 bp, Artificial Sequence
  Synthetic oligonucleotide
aagtgcgcccccacctgtgcatgtgtcttcgtcca

SEQ ID NO: 190665 - DNA, 36 bp, Artificial Sequence
  Synthetic oligonucleotide
gtccaccgactatcgtacctgaactcatttcactca

SEQ ID NO: 190666 - DNA, 36 bp, Artificial Sequence
  Synthetic oligonucleotide
ggtggcatctcggccgctagttttgatccgccctca

SEQ ID NO: 190667 - DNA, 36 bp, Artificial Sequence
  Synthetic oligonucleotide
gaccccacagacttgtgggctatcactggaccttca

SEQ ID NO: 190668 - DNA, 36 bp, Artificial Sequence
  Synthetic oligonucleotide
gcccgctgacgtatttcggggccggtcttcccttca

SEQ ID NO: 190669 - DNA, 36 bp, Artificial Sequence
  Synthetic oligonucleotide
gtccacctccctcgactgcgatagacactcgcttca

SEQ ID NO: 190670 - DNA, 36 bp, Artificial Sequence
  Synthetic oligonucleotide
ttcagtgtccgagtcccccccccaagtttcgtttca

SEQ ID NO: 190671 - DNA, 37 bp, Artificial Sequence
  Synthetic oligonucleotide
tgatgctctgcacctttgcccccgcccgttcgtaaga

SEQ ID NO: 190672 - DNA, 37 bp, Artificial Sequence
  Synthetic oligonucleotide
atagtggtgggatgagtgggagggtaggggacggaga

SEQ ID NO: 190673 - DNA, 37 bp, Artificial Sequence
  Synthetic oligonucleotide
gccattgtagaggggggatggggatgtcggtgggaga

SEQ ID NO: 190674 - DNA, 36 bp, Artificial Sequence
  Synthetic oligonucleotide
tagccacctccgacctcccaatgagcgtccacacga

SEQ ID NO: 190675 - DNA, 37 bp, Artificial Sequence
  Synthetic oligonucleotide
tacgacgggtgggatagggggcgaagcaaggcgacga

SEQ ID NO: 190676 - DNA, 36 bp, Artificial Sequence
  Synthetic oligonucleotide
atcccccgcctttttgaacgctaccaccgtatacga

SEQ ID NO: 190677 - DNA, 36 bp, Artificial Sequence
  Synthetic oligonucleotide
gacccgcgaaaggaagggaggaacggtgggttacga

SEQ ID NO: 190678 - DNA, 37 bp, Artificial Sequence
  Synthetic oligonucleotide
aacgaccgtcctgcccccgatgcgtcagacgcaccga

SEQ ID NO: 190679 - DNA, 36 bp, Artificial Sequence
  Synthetic oligonucleotide
gcacgcgcccgactttcttactaaagcttcctccga

SEQ ID NO: 190680 - DNA, 36 bp, Artificial Sequence
  Synthetic oligonucleotide
gaaggagacgtggggaaagcggggtggttagcgcga

SEQ ID NO: 190681 - DNA, 37 bp, Artificial Sequence
  Synthetic oligonucleotide
tttgcaccactcccgtgctacctccattttttatcga

SEQ ID NO: 190682 - DNA, 37 bp, Artificial Sequence
  Synthetic oligonucleotide
agtctcccctccgcttatattgagccccgcaactcga

SEQ ID NO: 190683 - DNA, 37 bp, Artificial Sequence
  Synthetic oligonucleotide
gcacccctcccatcccgacgatctgcctttcactcga

SEQ ID NO: 190684 - DNA, 36 bp, Artificial Sequence
  Synthetic oligonucleotide
ggactctcccaggcgaccccactgcagatatttcga

SEQ ID NO: 190685 - DNA, 37 bp, Artificial Sequence
  Synthetic oligonucleotide
gagccatggaggtgggggagggaaagaagccaacgga

SEQ ID NO: 190686 - DNA, 37 bp, Artificial Sequence
  Synthetic oligonucleotide
tctcggagaggggggtttcagaatcggaggggacgga

SEQ ID NO: 190687 - DNA, 37 bp, Artificial Sequence
  Synthetic oligonucleotide
ttgtacccgccatcttttcccgcattgtcttcgcgga

SEQ ID NO: 190688 - DNA, 37 bp, Artificial Sequence
  Synthetic oligonucleotide
tggaagggaaggaaaactggggcatactggaacggga

SEQ ID NO: 190689 - DNA, 37 bp, Artificial Sequence
  Synthetic oligonucleotide
gtcaaggtgggaagaggagagcgagggactatgggga

SEQ ID NO: 190690 - DNA, 35 bp, Artificial Sequence
  Synthetic oligonucleotide
gatgaggacgaggggcgagggcggtaaattgggga

SEQ ID NO: 190691 - DNA, 37 bp, Artificial Sequence
  Synthetic oligonucleotide
ggggaggcgagccgagggaagataaggggtggtggga

SEQ ID NO: 190692 - DNA, 36 bp, Artificial Sequence
  Synthetic oligonucleotide
tccagtgccgcccacctactaatgcccccgaatgga

SEQ ID NO: 190693 - DNA, 37 bp, Artificial Sequence
  Synthetic oligonucleotide
tgaacgtcgtaggagtaaaacggaggggaggggtgga

SEQ ID NO: 190694 - DNA, 36 bp, Artificial Sequence
  Synthetic oligonucleotide
aaatgggggacgaggggtaaggggcttcattcatga

SEQ ID NO: 190695 - DNA, 38 bp, Artificial Sequence
  Synthetic oligonucleotide
acctgcccctgcttgccctgcgtaatgcccgcttatga

SEQ ID NO: 190696 - DNA, 38 bp, Artificial Sequence
  Synthetic oligonucleotide
acgccaccatcatccctacacctgttagtcactactga

SEQ ID NO: 190697 - DNA, 38 bp, Artificial Sequence
  Synthetic oligonucleotide
tgtcccgccccatttcttgttagcgcgtgttctactga

SEQ ID NO: 190698 - DNA, 37 bp, Artificial Sequence
  Synthetic oligonucleotide
gcgcccccacttccctattagcacgtcgctcacctga

SEQ ID NO: 190699 - DNA, 36 bp, Artificial Sequence
  Synthetic oligonucleotide
gcgcccacgccccttttgctgaaccatacagcctga

SEQ ID NO: 190700 - DNA, 37 bp, Artificial Sequence
  Synthetic oligonucleotide
gccgagccctcaccatacttactgccttacatgctga

SEQ ID NO: 190701 - DNA, 38 bp, Artificial Sequence
  Synthetic oligonucleotide
acaccggcaggtgttctccgcctacctctttttgctga

SEQ ID NO: 190702 - DNA, 37 bp, Artificial Sequence
  Synthetic oligonucleotide
gctcctcccccctgaccggtcaagacagttgatctga

SEQ ID NO: 190703 - DNA, 37 bp, Artificial Sequence
  Synthetic oligonucleotide
gcccaccctcctcgtttgagcccataaacctcagtga

SEQ ID NO: 190704 - DNA, 38 bp, Artificial Sequence
  Synthetic oligonucleotide
gccgccgccgcacttgtctccatcctccgtgtccgtga

SEQ ID NO: 190705 - DNA, 38 bp, Artificial Sequence
  Synthetic oligonucleotide
cacgcctctaacggttatcgtgcatttcttcccattga

SEQ ID NO: 190706 - DNA, 38 bp, Artificial Sequence
  Synthetic oligonucleotide
gccaccaccatcacattattctgagggcacgcccttga

SEQ ID NO: 190707 - DNA, 38 bp, Artificial Sequence
  Synthetic oligonucleotide
ggaacagggcgggtgggagtggatccgcgtagcgttga

SEQ ID NO: 190708 - DNA, 38 bp, Artificial Sequence
  Synthetic oligonucleotide
gggaacaggggaggagcacgcagggggagaggctttga

SEQ ID NO: 190709 - DNA, 37 bp, Artificial Sequence
  Synthetic oligonucleotide
tgcccgaaccctatcttaacgcagccactctctttga

SEQ ID NO: 190710 - DNA, 36 bp, Artificial Sequence
  Synthetic oligonucleotide
gatgggtgggtcgggacgggtgctccccttctttga

SEQ ID NO: 190711 - DNA, 38 bp, Artificial Sequence
  Synthetic oligonucleotide
acagaagcggtcgggaggaggatggacggggagtttga

SEQ ID NO: 190712 - DNA, 36 bp, Artificial Sequence
  Synthetic oligonucleotide
acctccctctgggttgtccatacacctactacacta

SEQ ID NO: 190713 - DNA, 36 bp, Artificial Sequence
  Synthetic oligonucleotide
aactccccgcctgtacatgcataggtcaatgcacta

SEQ ID NO: 190714 - DNA, 36 bp, Artificial Sequence
  Synthetic oligonucleotide
gcaacagtcacaacttcatcggggtctcgtttacta

SEQ ID NO: 190715 - DNA, 35 bp, Artificial Sequence
  Synthetic oligonucleotide
tacgcacgcgcaccacattttatgttacctgccta

SEQ ID NO: 190716 - DNA, 36 bp, Artificial Sequence
  Synthetic oligonucleotide
gttgcgcggtcatactgacctcctggccatccgcta

SEQ ID NO: 190717 - DNA, 36 bp, Artificial Sequence
  Synthetic oligonucleotide
actcattgcctccatctgttcccccctacttcgcta

SEQ ID NO: 190718 - DNA, 35 bp, Artificial Sequence
  Synthetic oligonucleotide
ttggtcgccctgtccgttgccggcgtacacttcta

SEQ ID NO: 190719 - DNA, 36 bp, Artificial Sequence
  Synthetic oligonucleotide
acccccattcgccgcatttggtcctattctcactta

SEQ ID NO: 190720 - DNA, 36 bp, Artificial Sequence
  Synthetic oligonucleotide
gacgcaccgccaccccactaaaggtcacactactta

SEQ ID NO: 190721 - DNA, 35 bp, Artificial Sequence
  Synthetic oligonucleotide
ttggtagtcgcgaccactccctctcagcccgttta

SEQ ID NO: 190722 - DNA, 35 bp, Artificial Sequence
  Synthetic oligonucleotide
atgcgtgaggagcggaggggagcagaaaggataac

SEQ ID NO: 190723 - DNA, 35 bp, Artificial Sequence
  Synthetic oligonucleotide
gacttgtccctggctcattcgcaacatcattacac

SEQ ID NO: 190724 - DNA, 35 bp, Artificial Sequence
  Synthetic oligonucleotide
ttactgcacagtgactttactgcgtccacttacac

SEQ ID NO: 190725 - DNA, 35 bp, Artificial Sequence
  Synthetic oligonucleotide
gtgtcagccatgctctggctcgccacttgtcccac

SEQ ID NO: 190726 - DNA, 35 bp, Artificial Sequence
  Synthetic oligonucleotide
agcacccccttccgatgtttcatcgcacgatccac

SEQ ID NO: 190727 - DNA, 35 bp, Artificial Sequence
  Synthetic oligonucleotide
gatcgacgcctcgtaattgtgccgctctacctcac

SEQ ID NO: 190728 - DNA, 35 bp, Artificial Sequence
  Synthetic oligonucleotide
tgtcctcttcctgccgtcatgtctttcgccccgac

SEQ ID NO: 190729 - DNA, 35 bp, Artificial Sequence
  Synthetic oligonucleotide
tacccatcctcaacaccattctctctggtcgtgac

SEQ ID NO: 190730 - DNA, 35 bp, Artificial Sequence
  Synthetic oligonucleotide
ttcgtagccatgtttccgctgctcccgttcaatac

SEQ ID NO: 190731 - DNA, 35 bp, Artificial Sequence
  Synthetic oligonucleotide
tgccatgttgtccgtctggtgtctccatgctctac

SEQ ID NO: 190732 - DNA, 35 bp, Artificial Sequence
  Synthetic oligonucleotide
ggtccacaggcccgtctcattcacaccgtctctac

SEQ ID NO: 190733 - DNA, 35 bp, Artificial Sequence
  Synthetic oligonucleotide
gaccggaggtcacatctatctccccgcagtatccc

SEQ ID NO: 190734 - DNA, 35 bp, Artificial Sequence
  Synthetic oligonucleotide
gctggagcacccacccgcggttttcggacactccc

SEQ ID NO: 190735 - DNA, 35 bp, Artificial Sequence
  Synthetic oligonucleotide
atgccgtatccctctcggtgctttagttcgttccc

SEQ ID NO: 190736 - DNA, 35 bp, Artificial Sequence
  Synthetic oligonucleotide
gcctcaatcaacgctgtgttcgcgcattcccatcc

SEQ ID NO: 190737 - DNA, 35 bp, Artificial Sequence
  Synthetic oligonucleotide
gagccctgcccgcaaatcgataccactcatgatcc

SEQ ID NO: 190738 - DNA, 35 bp, Artificial Sequence
  Synthetic oligonucleotide
tctcactcgtcacctggccgttcagccacctatcc

SEQ ID NO: 190739 - DNA, 35 bp, Artificial Sequence
  Synthetic oligonucleotide
gtacgtgtctgaactgcctaacggctctctcctcc

SEQ ID NO: 190740 - DNA, 35 bp, Artificial Sequence
  Synthetic oligonucleotide
tcgaccaccgccgcgcttgctaatcaatcctctcc

SEQ ID NO: 190741 - DNA, 35 bp, Artificial Sequence
  Synthetic oligonucleotide
ccgtgcccgccggcatacttgttatcgcgctctcc

SEQ ID NO: 190742 - DNA, 35 bp, Artificial Sequence
  Synthetic oligonucleotide
gttgtccctgctacggtggtccgggtcacccttcc

SEQ ID NO: 190743 - DNA, 35 bp, Artificial Sequence
  Synthetic oligonucleotide
atgacagccacagtcctaccttcacctacgcttcc

SEQ ID NO: 190744 - DNA, 35 bp, Artificial Sequence
  Synthetic oligonucleotide
atctcccgtccagagtctctgcaatcacggcttcc

SEQ ID NO: 190745 - DNA, 35 bp, Artificial Sequence
  Synthetic oligonucleotide
tgccctcgtgcaccaatggctccttgatcggttcc

SEQ ID NO: 190746 - DNA, 35 bp, Artificial Sequence
  Synthetic oligonucleotide
gtagtgctcgctgaccgcctgtagctattttttcc

SEQ ID NO: 190747 - DNA, 35 bp, Artificial Sequence
  Synthetic oligonucleotide
agtcccatcatatacgttctacataccaccctcgc

SEQ ID NO: 190748 - DNA, 35 bp, Artificial Sequence
  Synthetic oligonucleotide
tcagaggtgccaacacgcattcccacctttttggc

SEQ ID NO: 190749 - DNA, 35 bp, Artificial Sequence
  Synthetic oligonucleotide
actccccttagggccctgtttaatatcgcccgtgc

SEQ ID NO: 190750 - DNA, 35 bp, Artificial Sequence
  Synthetic oligonucleotide
tcacacccgcagattccattcctctccctttgtgc

SEQ ID NO: 190751 - DNA, 35 bp, Artificial Sequence
  Synthetic oligonucleotide
ggtcacgctgccagagcttcgtcatctcgctcatc

SEQ ID NO: 190752 - DNA, 35 bp, Artificial Sequence
  Synthetic oligonucleotide
atctggctgttctgcctgtttaccttgcccttatc

SEQ ID NO: 190753 - DNA, 35 bp, Artificial Sequence
  Synthetic oligonucleotide
gcctcctgtagaatgaatacgccgggccccatctc

SEQ ID NO: 190754 - DNA, 35 bp, Artificial Sequence
  Synthetic oligonucleotide
gtgatccatcaggcgccctgcgtaaatcgcatctc

SEQ ID NO: 190755 - DNA, 35 bp, Artificial Sequence
  Synthetic oligonucleotide
atccatccgggtgtgttcccggccacttatctctc

SEQ ID NO: 190756 - DNA, 35 bp, Artificial Sequence
  Synthetic oligonucleotide
gcgctccactcgccgcttgaaattctagtcacgtc

SEQ ID NO: 190757 - DNA, 35 bp, Artificial Sequence
  Synthetic oligonucleotide
ttagcccccgtcccatatcgctctattcccccttc

SEQ ID NO: 190758 - DNA, 35 bp, Artificial Sequence
  Synthetic oligonucleotide
gcacaccctaccgtaagatcctcgcgcttctcttc

SEQ ID NO: 190759 - DNA, 35 bp, Artificial Sequence
  Synthetic oligonucleotide
taagacgagaagagggaggtccgggagaagtgcag

SEQ ID NO: 190760 - DNA, 35 bp, Artificial Sequence
  Synthetic oligonucleotide
gaacacgtggagaaaggaattgggatggcgatcag

SEQ ID NO: 190761 - DNA, 35 bp, Artificial Sequence
  Synthetic oligonucleotide
actgggaaggggggtggggtgttaagccaggctag

SEQ ID NO: 190762 - DNA, 35 bp, Artificial Sequence
  Synthetic oligonucleotide
accgcctaccaggtgctctcgtcgacttcccttag

SEQ ID NO: 190763 - DNA, 35 bp, Artificial Sequence
  Synthetic oligonucleotide
gttgccccgcttggctgtcctgacttctcaaaccg

SEQ ID NO: 190764 - DNA, 35 bp, Artificial Sequence
  Synthetic oligonucleotide
ttgcacgctcccggattccccttatcttttcaccg

SEQ ID NO: 190765 - DNA, 35 bp, Artificial Sequence
  Synthetic oligonucleotide
gtcgcggtgcggttttgttctgttactcctgcccg

SEQ ID NO: 190766 - DNA, 35 bp, Artificial Sequence
  Synthetic oligonucleotide
tcaccatcctacaagtccccgcttcttttaaagcg

SEQ ID NO: 190767 - DNA, 35 bp, Artificial Sequence
  Synthetic oligonucleotide
acacgcatagttcgagctaagcctttcacccctcg

SEQ ID NO: 190768 - DNA, 35 bp, Artificial Sequence
  Synthetic oligonucleotide
tagcatcacatctacctgatcattggtccatctcg

SEQ ID NO: 190769 - DNA, 35 bp, Artificial Sequence
  Synthetic oligonucleotide
actcattccgccctgaccgtgcttttactatctcg

SEQ ID NO: 190770 - DNA, 34 bp, Artificial Sequence
  Synthetic oligonucleotide
tagcccccccgtcattcacgatcccatcccttcg

SEQ ID NO: 190771 - DNA, 35 bp, Artificial Sequence
  Synthetic oligonucleotide
acaatgcctcctaagcctcaacccctccatgttcg

SEQ ID NO: 190772 - DNA, 35 bp, Artificial Sequence
  Synthetic oligonucleotide
tgattccgctcccaccgttttatatcgcccctggg

SEQ ID NO: 190773 - DNA, 35 bp, Artificial Sequence
  Synthetic oligonucleotide
tgagagtaggtgaagggtagggagaggtcgaatgg

SEQ ID NO: 190774 - DNA, 35 bp, Artificial Sequence
  Synthetic oligonucleotide
ttcgcgcctcctgaatctacgattaccttccctgg

SEQ ID NO: 190775 - DNA, 35 bp, Artificial Sequence
  Synthetic oligonucleotide
ttcaagaggaggggagaaggaacggtacggagtgg

SEQ ID NO: 190776 - DNA, 35 bp, Artificial Sequence
  Synthetic oligonucleotide
gtggggcacggaagattaacgggtaggaggggatg

SEQ ID NO: 190777 - DNA, 35 bp, Artificial Sequence
  Synthetic oligonucleotide
atcctctacccgggtgccctcatttgcgttgcctg

SEQ ID NO: 190778 - DNA, 35 bp, Artificial Sequence
  Synthetic oligonucleotide
gtaggggggtggaaaagaaaaagaaggtaggtctg

SEQ ID NO: 190779 - DNA, 35 bp, Artificial Sequence
  Synthetic oligonucleotide
ggagccacacctctggcccgaactgttttcccttg

SEQ ID NO: 190780 - DNA, 35 bp, Artificial Sequence
  Synthetic oligonucleotide
gagggaagtgggatggaggcggaaatcgggtcttg

SEQ ID NO: 190781 - DNA, 35 bp, Artificial Sequence
  Synthetic oligonucleotide
acacaccacctaacatgttcgccgttccgttcttg

SEQ ID NO: 190782 - DNA, 35 bp, Artificial Sequence
  Synthetic oligonucleotide
tcattcaactctataccccgtgactatcgctccat

SEQ ID NO: 190783 - DNA, 35 bp, Artificial Sequence
  Synthetic oligonucleotide
gcaagacaccagctgcccgccataacacctcgact

SEQ ID NO: 190784 - DNA, 35 bp, Artificial Sequence
  Synthetic oligonucleotide
aagcacctcactccaccggtcagctcgcgcgccct

SEQ ID NO: 190785 - DNA, 35 bp, Artificial Sequence
  Synthetic oligonucleotide
acaccatcacgctatgcttgtcttaactgtcgcct

SEQ ID NO: 190786 - DNA, 35 bp, Artificial Sequence
  Synthetic oligonucleotide
gccctacattcgctcgtccttatcgccacatgcct

SEQ ID NO: 190787 - DNA, 35 bp, Artificial Sequence
  Synthetic oligonucleotide
agtaccatccggggccccaactatcttcaggtcct

SEQ ID NO: 190788 - DNA, 35 bp, Artificial Sequence
  Synthetic oligonucleotide
gttcaagtccgacgccagttgtctcgggccttcct

SEQ ID NO: 190789 - DNA, 35 bp, Artificial Sequence
  Synthetic oligonucleotide
gtcatgacacggcacctccatatctcgcctttgct

SEQ ID NO: 190790 - DNA, 35 bp, Artificial Sequence
  Synthetic oligonucleotide
agattgccctgccctgcatctgttcccgaccctct

SEQ ID NO: 190791 - DNA, 35 bp, Artificial Sequence
  Synthetic oligonucleotide
acccctcgcatcctgcctttattgtgacttaaagt

SEQ ID NO: 190792 - DNA, 35 bp, Artificial Sequence
  Synthetic oligonucleotide
gccaccccattgctttttgagtttctctctccagt

SEQ ID NO: 190793 - DNA, 35 bp, Artificial Sequence
  Synthetic oligonucleotide
acacccctactgctcgttttaatcccaactgtagt

SEQ ID NO: 190794 - DNA, 35 bp, Artificial Sequence
  Synthetic oligonucleotide
gttaacccgcccgtatcgttcgacacatttaccgt

SEQ ID NO: 190795 - DNA, 35 bp, Artificial Sequence
  Synthetic oligonucleotide
gttagcgcccctgatcagctccggccccacctcgt

SEQ ID NO: 190796 - DNA, 35 bp, Artificial Sequence
  Synthetic oligonucleotide
atccctctgcttaccagctcgtgctctttaacggt

SEQ ID NO: 190797 - DNA, 35 bp, Artificial Sequence
  Synthetic oligonucleotide
gtgtcccagcctgttccgttccacccatgcccggt

SEQ ID NO: 190798 - DNA, 35 bp, Artificial Sequence
  Synthetic oligonucleotide
tccactcaatactgtcgatccatacccctcgatgt

SEQ ID NO: 190799 - DNA, 35 bp, Artificial Sequence
  Synthetic oligonucleotide
gtaccatgctcgccacgccgtttacactgataatt

SEQ ID NO: 190800 - DNA, 35 bp, Artificial Sequence
  Synthetic oligonucleotide
gtagtgcgagggcgccttaactgttccacctcatt

SEQ ID NO: 190801 - DNA, 35 bp, Artificial Sequence
  Synthetic oligonucleotide
ataaaccgcctcgcccttctgtcttatcggtcatt

SEQ ID NO: 190802 - DNA, 35 bp, Artificial Sequence
  Synthetic oligonucleotide
ttaggcgggggggtgagggtgagcagggtgtgatt

SEQ ID NO: 190803 - DNA, 35 bp, Artificial Sequence
  Synthetic oligonucleotide
tttatccgacgccactgtgattctttgtccacctt

SEQ ID NO: 190804 - DNA, 35 bp, Artificial Sequence
  Synthetic oligonucleotide
tgccgcacgcccaatgcgtaattcgcccccccctt

SEQ ID NO: 190805 - DNA, 35 bp, Artificial Sequence
  Synthetic oligonucleotide
tccgacacgcccagttgcgagtgtccgctctcctt

SEQ ID NO: 190806 - DNA, 35 bp, Artificial Sequence
  Synthetic oligonucleotide
ttgcacggcgactcgcgcactcgattaccactctt

SEQ ID NO: 190807 - DNA, 31 bp, Artificial Sequence
  Synthetic oligonucleotide
ttccacgccatttccctgcacttcccaggtt

SEQ ID NO: 190808 - DNA, 35 bp, Artificial Sequence
  Synthetic oligonucleotide
acgtgccctgcttgccccctgtttcgaccgccttt

SEQ ID NO: 190809 - DNA, 35 bp, Artificial Sequence
  Synthetic oligonucleotide
ttcatccgtcgtcaagcgcggttaactgttccttt

SEQ ID NO: 190810 - DNA, 36 bp, Artificial Sequence
  Synthetic oligonucleotide
gacgcctcatctggaacacgcctttcttccatacaa

SEQ ID NO: 190811 - DNA, 35 bp, Artificial Sequence
  Synthetic oligonucleotide
taccctccacgctcccagccacgtttggcttacaa

SEQ ID NO: 190812 - DNA, 35 bp, Artificial Sequence
  Synthetic oligonucleotide
ttccccgtccgtctcggttatcgtcgtccctccaa

SEQ ID NO: 190813 - DNA, 36 bp, Artificial Sequence
  Synthetic oligonucleotide
gacggctcgtggaacggtcggaggaggggcggggaa

SEQ ID NO: 190814 - DNA, 35 bp, Artificial Sequence
  Synthetic oligonucleotide
gccaatcggctcatggtggaggggtggggtgggaa

SEQ ID NO: 190815 - DNA, 36 bp, Artificial Sequence
  Synthetic oligonucleotide
agcccgcactcacgtatctctgcctatccctcgtaa

SEQ ID NO: 190816 - DNA, 35 bp, Artificial Sequence
  Synthetic oligonucleotide
gccatccgggccacccctgctcccttctgctgtaa

SEQ ID NO: 190817 - DNA, 35 bp, Artificial Sequence
  Synthetic oligonucleotide
tcccggaacgtcactcttcgttttgggcctccaca

SEQ ID NO: 190818 - DNA, 36 bp, Artificial Sequence
  Synthetic oligonucleotide
accgagcgtccagttctccaccctcgactctgcaca

SEQ ID NO: 190819 - DNA, 36 bp, Artificial Sequence
  Synthetic oligonucleotide
tgaacactccgaagctgctactgccgcctacttaca

SEQ ID NO: 190820 - DNA, 35 bp, Artificial Sequence
  Synthetic oligonucleotide
tgtcccatccctccatcacatcgcgttctatacca

SEQ ID NO: 190821 - DNA, 36 bp, Artificial Sequence
  Synthetic oligonucleotide
ttgcgacctccgctattaattcgtctcgcgcaccca

SEQ ID NO: 190822 - DNA, 35 bp, Artificial Sequence
  Synthetic oligonucleotide
gttgctcagcatgccgcctcgttacacccacgcca

SEQ ID NO: 190823 - DNA, 35 bp, Artificial Sequence
  Synthetic oligonucleotide
gcgaacccccccaattcctttagtgacctaggcca

SEQ ID NO: 190824 - DNA, 36 bp, Artificial Sequence
  Synthetic oligonucleotide
gtgctaagccctgctcttggtatcgccctcctgcca

SEQ ID NO: 190825 - DNA, 35 bp, Artificial Sequence
  Synthetic oligonucleotide
gttacggtcgccaatccatcggtcacttcttgcca

SEQ ID NO: 190826 - DNA, 36 bp, Artificial Sequence
  Synthetic oligonucleotide
atgcacgtgtcagactcgttcccgtcgccttatcca

SEQ ID NO: 190827 - DNA, 35 bp, Artificial Sequence
  Synthetic oligonucleotide
gccgaccaccgacctcatattctcgatctactcca

SEQ ID NO: 190828 - DNA, 36 bp, Artificial Sequence
  Synthetic oligonucleotide
gatggaggtaatagtaggggtcaggggacaggggca

SEQ ID NO: 190829 - DNA, 35 bp, Artificial Sequence
  Synthetic oligonucleotide
tcacttcaccccacatccgcgccttccggttggca

SEQ ID NO: 190830 - DNA, 36 bp, Artificial Sequence
  Synthetic oligonucleotide
gcgaaacaccacgctgaccgtctctaagacccctca

SEQ ID NO: 190831 - DNA, 35 bp, Artificial Sequence
  Synthetic oligonucleotide
ttcctccaccacagttgtgcacacaatcatattca

SEQ ID NO: 190832 - DNA, 37 bp, Artificial Sequence
  Synthetic oligonucleotide
gacaacgaggaaggcgcgcagggataggaaaatcaga

SEQ ID NO: 190833 - DNA, 36 bp, Artificial Sequence
  Synthetic oligonucleotide
acgcccagtcgtttctgccccttctcgccttggaga

SEQ ID NO: 190834 - DNA, 37 bp, Artificial Sequence
  Synthetic oligonucleotide
aggggagcatggtgggggcaggagggcaaatctgaga

SEQ ID NO: 190835 - DNA, 37 bp, Artificial Sequence
  Synthetic oligonucleotide
ggtgtgcaaccggggagaagagggcacggcacataga

SEQ ID NO: 190836 - DNA, 36 bp, Artificial Sequence
  Synthetic oligonucleotide
gccctccgtacgaccgttcaattcacgcaccctaga

SEQ ID NO: 190837 - DNA, 36 bp, Artificial Sequence
  Synthetic oligonucleotide
gccctcccacgattcgtcctgccgtttatcgaacga

SEQ ID NO: 190838 - DNA, 37 bp, Artificial Sequence
  Synthetic oligonucleotide
ggacggggcaaggaggaatggaccaagtagggtacga

SEQ ID NO: 190839 - DNA, 37 bp, Artificial Sequence
  Synthetic oligonucleotide
acatccacttagttgatatataccccccgtccaccga

SEQ ID NO: 190840 - DNA, 37 bp, Artificial Sequence
  Synthetic oligonucleotide
ttgggtgcggagcaaaagtaacgggggaggggcccga

SEQ ID NO: 190841 - DNA, 36 bp, Artificial Sequence
  Synthetic oligonucleotide
gcaccaacagctccatgttctctgctcttgtcccga

SEQ ID NO: 190842 - DNA, 37 bp, Artificial Sequence
  Synthetic oligonucleotide
ggtcaacctccctgctcatcgatctgctcgtcgccga

SEQ ID NO: 190843 - DNA, 36 bp, Artificial Sequence
  Synthetic oligonucleotide
atcatcctgcaccgctataccttctcacgtctccga

SEQ ID NO: 190844 - DNA, 36 bp, Artificial Sequence
  Synthetic oligonucleotide
gtaaacgcagtctcaatgccgcctgtactccctcga

SEQ ID NO: 190845 - DNA, 37 bp, Artificial Sequence
  Synthetic oligonucleotide
actgagccgatttgccgccttaccgaccctccctcga

SEQ ID NO: 190846 - DNA, 37 bp, Artificial Sequence
  Synthetic oligonucleotide
gaagggggcaatggggggtgaaatagagggtagtcga

SEQ ID NO: 190847 - DNA, 37 bp, Artificial Sequence
  Synthetic oligonucleotide
tagcacactctatgtcccctcacccatcactcgtcga

SEQ ID NO: 190848 - DNA, 38 bp, Artificial Sequence
  Synthetic oligonucleotide
agtcacggctgtagtctaccttagcgcttctccttcga

SEQ ID NO: 190849 - DNA, 37 bp, Artificial Sequence
  Synthetic oligonucleotide
tttcgacagagcacgggaatgggcgggggcggaagga

SEQ ID NO: 190850 - DNA, 35 bp, Artificial Sequence
  Synthetic oligonucleotide
aaggaggggaagggggagtcggggtgtatcccgga

SEQ ID NO: 190851 - DNA, 37 bp, Artificial Sequence
  Synthetic oligonucleotide
tctccccaccgctgggttcctcacgccacttggcgga

SEQ ID NO: 190852 - DNA, 35 bp, Artificial Sequence
  Synthetic oligonucleotide
tagccgggaacggggggggggagtattaagtcgga

SEQ ID NO: 190853 - DNA, 37 bp, Artificial Sequence
  Synthetic oligonucleotide
tcatacctgcctcccccatcgagcgtccctgaaggga

SEQ ID NO: 190854 - DNA, 36 bp, Artificial Sequence
  Synthetic oligonucleotide
tcacgtggcgacacgaggggcggatagggatgggga

SEQ ID NO: 190855 - DNA, 37 bp, Artificial Sequence
  Synthetic oligonucleotide
gacggagaggggaagggacgggggagagtagtgggga

SEQ ID NO: 190856 - DNA, 37 bp, Artificial Sequence
  Synthetic oligonucleotide
gaccaggatccatctgcacgccttccttcctgtggga

SEQ ID NO: 190857 - DNA, 38 bp, Artificial Sequence
  Synthetic oligonucleotide
gttaagggaagggaaggaggaagaacaagggagatgga

SEQ ID NO: 190858 - DNA, 37 bp, Artificial Sequence
  Synthetic oligonucleotide
accgagggtctagggtggggcgggaggtgaacctgga

SEQ ID NO: 190859 - DNA, 37 bp, Artificial Sequence
  Synthetic oligonucleotide
gagcgatgggtggagaagggagggcaggctggaatga

SEQ ID NO: 190860 - DNA, 35 bp, Artificial Sequence
  Synthetic oligonucleotide
actacatgcctactgcgcccttcccccacatatga

SEQ ID NO: 190861 - DNA, 38 bp, Artificial Sequence
  Synthetic oligonucleotide
tgacccccatcacccgggcatatctcgacatcctatga

SEQ ID NO: 190862 - DNA, 36 bp, Artificial Sequence
  Synthetic oligonucleotide
gtggggcgcgcatagtctattctccgctccacctga

SEQ ID NO: 190863 - DNA, 37 bp, Artificial Sequence
  Synthetic oligonucleotide
gttggacagctacgaactgatccgctaccccccctga

SEQ ID NO: 190864 - DNA, 38 bp, Artificial Sequence
  Synthetic oligonucleotide
tgcatcctccttcgtatggctcccgtccgttcccctga

SEQ ID NO: 190865 - DNA, 38 bp, Artificial Sequence
  Synthetic oligonucleotide
ggtggggtaggagagggggggaaacgtgaggcctctga

SEQ ID NO: 190866 - DNA, 38 bp, Artificial Sequence
  Synthetic oligonucleotide
atgccagcccgcccgccgtgcttttttacaacaattga

SEQ ID NO: 190867 - DNA, 38 bp, Artificial Sequence
  Synthetic oligonucleotide
ggagagagcatatgcatagggggtggagggtaacttga

SEQ ID NO: 190868 - DNA, 37 bp, Artificial Sequence
  Synthetic oligonucleotide
acgacccccgctccgacattgttaagtcgccccttga

SEQ ID NO: 190869 - DNA, 38 bp, Artificial Sequence
  Synthetic oligonucleotide
acatgcgcctcattcagctgtaccatccccgcccttga

SEQ ID NO: 190870 - DNA, 37 bp, Artificial Sequence
  Synthetic oligonucleotide
gttcggttgtccgaacgtacctcccgacttcccttga

SEQ ID NO: 190871 - DNA, 38 bp, Artificial Sequence
  Synthetic oligonucleotide
gatggtgtggcagtcggagaagaggatggaggtgttga

SEQ ID NO: 190872 - DNA, 35 bp, Artificial Sequence
  Synthetic oligonucleotide
gatggcctcacaatttctttacacccagcctttga

SEQ ID NO: 190873 - DNA, 38 bp, Artificial Sequence
  Synthetic oligonucleotide
gagggtgcaacctcccgccgatactcgcccgcctttga

SEQ ID NO: 190874 - DNA, 35 bp, Artificial Sequence
  Synthetic oligonucleotide
tatcaccacgaactttatattcgtctctcgcccta

SEQ ID NO: 190875 - DNA, 35 bp, Artificial Sequence
  Synthetic oligonucleotide
caccacccacagaaccttacccaatcccgttgcta

SEQ ID NO: 190876 - DNA, 36 bp, Artificial Sequence
  Synthetic oligonucleotide
tgtgtacgcgttcacctagtttggccgcactctcta

SEQ ID NO: 190877 - DNA, 36 bp, Artificial Sequence
  Synthetic oligonucleotide
gcaaagcgccaccgtcgttcgttctcttgttctcta

SEQ ID NO: 190878 - DNA, 36 bp, Artificial Sequence
  Synthetic oligonucleotide
tctgcccaactgttaatgcctatacgtccccactta

SEQ ID NO: 190879 - DNA, 35 bp, Artificial Sequence
  Synthetic oligonucleotide
ttcgctcacatccttctcgccattgacggacttta

SEQ ID NO: 190880 - DNA, 35 bp, Artificial Sequence
  Synthetic oligonucleotide
accaactctcgatcctgtcccaccacggtgaccac

SEQ ID NO: 190881 - DNA, 35 bp, Artificial Sequence
  Synthetic oligonucleotide
tagtcatcttggccacacgacgctcctgttcccac

SEQ ID NO: 190882 - DNA, 35 bp, Artificial Sequence
  Synthetic oligonucleotide
acccttcccggcttacggtttaaaagccttctcac

SEQ ID NO: 190883 - DNA, 35 bp, Artificial Sequence
  Synthetic oligonucleotide
atccgtgcgcatttccgtgcgggccatattcctac

SEQ ID NO: 190884 - DNA, 35 bp, Artificial Sequence
  Synthetic oligonucleotide
gcctgggtggcttggcgcgtaaacgtcctctctac

SEQ ID NO: 190885 - DNA, 35 bp, Artificial Sequence
  Synthetic oligonucleotide
ttcatcacatcccgtgtggcgatccacgcaattac

SEQ ID NO: 190886 - DNA, 35 bp, Artificial Sequence
  Synthetic oligonucleotide
gatcctgaccactccatgctctattacgtaccacc

SEQ ID NO: 190887 - DNA, 35 bp, Artificial Sequence
  Synthetic oligonucleotide
gcccctcgtgtccggttcaattgtctcggttcacc

SEQ ID NO: 190888 - DNA, 35 bp, Artificial Sequence
  Synthetic oligonucleotide
tgcacacctgcctgctctcccccctggaccctacc

SEQ ID NO: 190889 - DNA, 34 bp, Artificial Sequence
  Synthetic oligonucleotide
tgcctcccgaggttatgttcattgtctccccccc

SEQ ID NO: 190890 - DNA, 35 bp, Artificial Sequence
  Synthetic oligonucleotide
aggtggtcccacagcggcatcgatacatgctcccc

SEQ ID NO: 190891 - DNA, 36 bp, Artificial Sequence
  Synthetic oligonucleotide
agctcccctacactgcctgtaatcttataccagccc

SEQ ID NO: 190892 - DNA, 35 bp, Artificial Sequence
  Synthetic oligonucleotide
tcccccgccctgcctggttacatccataagagccc

SEQ ID NO: 190893 - DNA, 35 bp, Artificial Sequence
  Synthetic oligonucleotide
tccatcctgacctgtttctccgagcccaattgccc

SEQ ID NO: 190894 - DNA, 35 bp, Artificial Sequence
  Synthetic oligonucleotide
tttcacccccgtccttggaatgggccacgttgccc

SEQ ID NO: 190895 - DNA, 35 bp, Artificial Sequence
  Synthetic oligonucleotide
tgagctccaacccggtccagcctgtcctctccgcc

SEQ ID NO: 190896 - DNA, 35 bp, Artificial Sequence
  Synthetic oligonucleotide
acttcacctggcacgtttgactcgcaccgctcgcc

SEQ ID NO: 190897 - DNA, 35 bp, Artificial Sequence
  Synthetic oligonucleotide
tagactcccacagaactgaccgacgtacattggcc

SEQ ID NO: 190898 - DNA, 36 bp, Artificial Sequence
  Synthetic oligonucleotide
tagtgcattaatctgctgccgattccaagccctgcc

SEQ ID NO: 190899 - DNA, 35 bp, Artificial Sequence
  Synthetic oligonucleotide
tgtgccgtacactcgtctgtcgtaccacccttgcc

SEQ ID NO: 190900 - DNA, 35 bp, Artificial Sequence
  Synthetic oligonucleotide
gatcagtgcacatccggattccacctaaagcctcc

SEQ ID NO: 190901 - DNA, 35 bp, Artificial Sequence
  Synthetic oligonucleotide
tcatttgcaatcgcagtcctgcccgacgctgttcc

SEQ ID NO: 190902 - DNA, 35 bp, Artificial Sequence
  Synthetic oligonucleotide
gaaggcccgttcccctctgttttacgcacacgcgc

SEQ ID NO: 190903 - DNA, 35 bp, Artificial Sequence
  Synthetic oligonucleotide
ggagccccattcgtaccgacaccttcgtttctcgc

SEQ ID NO: 190904 - DNA, 35 bp, Artificial Sequence
  Synthetic oligonucleotide
aacgcactcctcatcgaacgattaaccgacttcgc

SEQ ID NO: 190905 - DNA, 35 bp, Artificial Sequence
  Synthetic oligonucleotide
tgtaacgacaactgtagtttattgctccccttcgc

SEQ ID NO: 190906 - DNA, 35 bp, Artificial Sequence
  Synthetic oligonucleotide
acacactcctagacacgtgcccccccgttcttcgc

SEQ ID NO: 190907 - DNA, 35 bp, Artificial Sequence
  Synthetic oligonucleotide
atgtacagcacttcgaggcctcccatcccgcttgc

SEQ ID NO: 190908 - DNA, 35 bp, Artificial Sequence
  Synthetic oligonucleotide
gttactgccgattatgccttgcgtcttcttccatc

SEQ ID NO: 190909 - DNA, 35 bp, Artificial Sequence
  Synthetic oligonucleotide
tctcgcacagccgtaccgtgtccgtgcccatcatc

SEQ ID NO: 190910 - DNA, 35 bp, Artificial Sequence
  Synthetic oligonucleotide
acgtgccggctcagcatacatccgcctcgttgatc

SEQ ID NO: 190911 - DNA, 35 bp, Artificial Sequence
  Synthetic oligonucleotide
ggtccaccccctttgatttttgtcggcaaacactc

SEQ ID NO: 190912 - DNA, 35 bp, Artificial Sequence
  Synthetic oligonucleotide
tacgtggtgtatacgtgtccactcaccaccccctc

SEQ ID NO: 190913 - DNA, 35 bp, Artificial Sequence
  Synthetic oligonucleotide
acagctgtgccatcacgtgcctgcgtaacttcctc

SEQ ID NO: 190914 - DNA, 35 bp, Artificial Sequence
  Synthetic oligonucleotide
gccaacacacgccttggggccatgcccttttgctc

SEQ ID NO: 190915 - DNA, 35 bp, Artificial Sequence
  Synthetic oligonucleotide
gtcaccacctcttcccttgctgagctactcacgtc

SEQ ID NO: 190916 - DNA, 35 bp, Artificial Sequence
  Synthetic oligonucleotide
taacgccgttcgtggcccacaagcactctctcgtc

SEQ ID NO: 190917 - DNA, 35 bp, Artificial Sequence
  Synthetic oligonucleotide
ttgtcaatgcgcttcttgccgtatcgttcactgtc

SEQ ID NO: 190918 - DNA, 35 bp, Artificial Sequence
  Synthetic oligonucleotide
tctgtggccactgatcgtatgttgcgtcctccttc

SEQ ID NO: 190919 - DNA, 35 bp, Artificial Sequence
  Synthetic oligonucleotide
tcccactcccctttcgggctatgagaaacttgttc

SEQ ID NO: 190920 - DNA, 35 bp, Artificial Sequence
  Synthetic oligonucleotide
attgcccccctcgatgcttcgcggtacctgatttc

SEQ ID NO: 190921 - DNA, 35 bp, Artificial Sequence
  Synthetic oligonucleotide
tgacccacctccctttggtactaagctccattcag

SEQ ID NO: 190922 - DNA, 35 bp, Artificial Sequence
  Synthetic oligonucleotide
gaggaaaaggcgagtggaccgacggaaagggcgag

SEQ ID NO: 190923 - DNA, 35 bp, Artificial Sequence
  Synthetic oligonucleotide
acacgggcccgaatcgcccgcggtcccccctcccg

SEQ ID NO: 190924 - DNA, 35 bp, Artificial Sequence
  Synthetic oligonucleotide
gcctgcctacgcacggttcctctgactgtcttccg

SEQ ID NO: 190925 - DNA, 35 bp, Artificial Sequence
  Synthetic oligonucleotide
gatatgcgatagggacggggggtggaagttgctcg

SEQ ID NO: 190926 - DNA, 35 bp, Artificial Sequence
  Synthetic oligonucleotide
gagagtgacaaatgcaggggggtacgaggggctgg

SEQ ID NO: 190927 - DNA, 35 bp, Artificial Sequence
  Synthetic oligonucleotide
tgtggtcgcgtgaatcccccactaccttgttactg

SEQ ID NO: 190928 - DNA, 36 bp, Artificial Sequence
  Synthetic oligonucleotide
ggtgtacaggtcgaaagggggagggataggatagtg

SEQ ID NO: 190929 - DNA, 35 bp, Artificial Sequence
  Synthetic oligonucleotide
gaacgaaaaggaggggggtttgagtacgcgaattg

SEQ ID NO: 190930 - DNA, 35 bp, Artificial Sequence
  Synthetic oligonucleotide
tcattagcacggctatcacgtacctttccatcttg

SEQ ID NO: 190931 - DNA, 35 bp, Artificial Sequence
  Synthetic oligonucleotide
aagtggaaaggagtgagcgggggtggagggttaat

SEQ ID NO: 190932 - DNA, 35 bp, Artificial Sequence
  Synthetic oligonucleotide
atcctccctcctggccctctgtatagattgcccat

SEQ ID NO: 190933 - DNA, 35 bp, Artificial Sequence
  Synthetic oligonucleotide
accctgtcctccgcaaattgttttatctccaggat

SEQ ID NO: 190934 - DNA, 35 bp, Artificial Sequence
  Synthetic oligonucleotide
tccatctccattcatgttgacctatcgacgatact

SEQ ID NO: 190935 - DNA, 35 bp, Artificial Sequence
  Synthetic oligonucleotide
gcccgcacgatcgcattccatttcaaggtacacct

SEQ ID NO: 190936 - DNA, 35 bp, Artificial Sequence
  Synthetic oligonucleotide
tacagtcgccccctgtgttgctcccacttccccct

SEQ ID NO: 190937 - DNA, 35 bp, Artificial Sequence
  Synthetic oligonucleotide
ttgcgcacgccgcctattctgtgcttggccgccct

SEQ ID NO: 190938 - DNA, 35 bp, Artificial Sequence
  Synthetic oligonucleotide
gccccagcctgttgttattcccgccgttactccct

SEQ ID NO: 190939 - DNA, 34 bp, Artificial Sequence
  Synthetic oligonucleotide
ttgaccggacctccacgaaaagtgcccatatgct

SEQ ID NO: 190940 - DNA, 34 bp, Artificial Sequence
  Synthetic oligonucleotide
gcgtcccacatgcccttccatggtctttcacggt

SEQ ID NO: 190941 - DNA, 35 bp, Artificial Sequence
  Synthetic oligonucleotide
atgtgcctcctcccccctccagcctctaatcatgt

SEQ ID NO: 190942 - DNA, 35 bp, Artificial Sequence
  Synthetic oligonucleotide
tcgacgcacggtcatttagttcctcgcggtcctgt

SEQ ID NO: 190943 - DNA, 28 bp, Artificial Sequence
  Synthetic oligonucleotide
tcgtgccccatcaatcattcccgcgatt

SEQ ID NO: 190944 - DNA, 35 bp, Artificial Sequence
  Synthetic oligonucleotide
atgttctgtgcccccccactttgatgcctgcactt

SEQ ID NO: 190945 - DNA, 35 bp, Artificial Sequence
  Synthetic oligonucleotide
tgaccgctcctgccttctcgaccgcctggatcctt

SEQ ID NO: 190946 - DNA, 35 bp, Artificial Sequence
  Synthetic oligonucleotide
tgagcgcagtgccgcccactttcgttatcatgctt

SEQ ID NO: 190947 - DNA, 35 bp, Artificial Sequence
  Synthetic oligonucleotide
gcatcagctcatccattcaacaccacacgctgctt

SEQ ID NO: 190948 - DNA, 35 bp, Artificial Sequence
  Synthetic oligonucleotide
gccccacccgccatttactgcattaacgctccttt

SEQ ID NO: 190949 - DNA, 36 bp, Artificial Sequence
  Synthetic oligonucleotide
gagcccgcacggagaagggaatggggaaattggaaa

SEQ ID NO: 190950 - DNA, 33 bp, Artificial Sequence
  Synthetic oligonucleotide
tgtgtatggtgggggggaggtaacctgggaaca

SEQ ID NO: 190951 - DNA, 35 bp, Artificial Sequence
  Synthetic oligonucleotide
tgccccgtaacggactgcagttcgttctatcacca

SEQ ID NO: 190952 - DNA, 36 bp, Artificial Sequence
  Synthetic oligonucleotide
ggaactgctcacgtactccgccggcctgttatacca

SEQ ID NO: 190953 - DNA, 36 bp, Artificial Sequence
  Synthetic oligonucleotide
gaacccaccgcccttggttaggcctaaaatcaccca

SEQ ID NO: 190954 - DNA, 35 bp, Artificial Sequence
  Synthetic oligonucleotide
ggagccacaagcgcctacatcgcctacaccgccca

SEQ ID NO: 190955 - DNA, 36 bp, Artificial Sequence
  Synthetic oligonucleotide
tcgacctgtcccagtcttacggttccgttcatccca

SEQ ID NO: 190956 - DNA, 34 bp, Artificial Sequence
  Synthetic oligonucleotide
acgctccacccgaccgaatgaacgcttgctccca

SEQ ID NO: 190957 - DNA, 36 bp, Artificial Sequence
  Synthetic oligonucleotide
actcagggagggaaggtgagagagagggacgcgcca

SEQ ID NO: 190958 - DNA, 36 bp, Artificial Sequence
  Synthetic oligonucleotide
aacgccccctctatgtacccatggtgcccttgtcca

SEQ ID NO: 190959 - DNA, 36 bp, Artificial Sequence
  Synthetic oligonucleotide
tcagatctcatccactgtctcttcgcttaccacgca

SEQ ID NO: 190960 - DNA, 36 bp, Artificial Sequence
  Synthetic oligonucleotide
tcacaccgcccgacgcaacgatacgcgttttacgca

SEQ ID NO: 190961 - DNA, 36 bp, Artificial Sequence
  Synthetic oligonucleotide
agccacgccgacgccacccgccattgtctatgtgca

SEQ ID NO: 190962 - DNA, 36 bp, Artificial Sequence
  Synthetic oligonucleotide
gccaggggtggtaggtcggggttttgcggtggatca

SEQ ID NO: 190963 - DNA, 36 bp, Artificial Sequence
  Synthetic oligonucleotide
taagcgccgctccctgccagcaccaggtccatctca

SEQ ID NO: 190964 - DNA, 36 bp, Artificial Sequence
  Synthetic oligonucleotide
ttgcgcgctcacaccgtcactcacctcccgaattca

SEQ ID NO: 190965 - DNA, 36 bp, Artificial Sequence
  Synthetic oligonucleotide
acatgcatggggttagaggagggaccggggacaaga

SEQ ID NO: 190966 - DNA, 36 bp, Artificial Sequence
  Synthetic oligonucleotide
gcactactgccctctacgtctacaccacgatcacga

SEQ ID NO: 190967 - DNA, 35 bp, Artificial Sequence
  Synthetic oligonucleotide
agtccgcacacgccaccatccataatcatcgacga

SEQ ID NO: 190968 - DNA, 37 bp, Artificial Sequence
  Synthetic oligonucleotide
aacgggagagacatacggggcgggcgggatgggacga

SEQ ID NO: 190969 - DNA, 37 bp, Artificial Sequence
  Synthetic oligonucleotide
gagtcacgggatcggggctagtgggagggaggtacga

SEQ ID NO: 190970 - DNA, 37 bp, Artificial Sequence
  Synthetic oligonucleotide
tcagctggccggcctcacttaactgcactattcccga

SEQ ID NO: 190971 - DNA, 37 bp, Artificial Sequence
  Synthetic oligonucleotide
tactcgctctctgtccattgcatcccgaatcttccga

SEQ ID NO: 190972 - DNA, 37 bp, Artificial Sequence
  Synthetic oligonucleotide
accttagcccccacatgagttgcaccctcctttccga

SEQ ID NO: 190973 - DNA, 37 bp, Artificial Sequence
  Synthetic oligonucleotide
accacccgcccgacgcgcaatcgcagtttgaccgcga

SEQ ID NO: 190974 - DNA, 37 bp, Artificial Sequence
  Synthetic oligonucleotide
tgtgcctaaatccgggttataccgcgccactcctcga

SEQ ID NO: 190975 - DNA, 36 bp, Artificial Sequence
  Synthetic oligonucleotide
tcacgtgtccggccccacttagccactatttctcga

SEQ ID NO: 190976 - DNA, 37 bp, Artificial Sequence
  Synthetic oligonucleotide
gaaggaggggtgaggtggcgcacaaaacgaaggtcga

SEQ ID NO: 190977 - DNA, 37 bp, Artificial Sequence
  Synthetic oligonucleotide
acctgcacttgacctctctatcgtaccctcctcagga

SEQ ID NO: 190978 - DNA, 36 bp, Artificial Sequence
  Synthetic oligonucleotide
gaggaaggagcggtggcacgtgggttcggaggagga

SEQ ID NO: 190979 - DNA, 35 bp, Artificial Sequence
  Synthetic oligonucleotide
ggggacagtggatgagaggtggagtggatgtagga

SEQ ID NO: 190980 - DNA, 36 bp, Artificial Sequence
  Synthetic oligonucleotide
agtgtaagcgggggggttacggagaggggttacgga

SEQ ID NO: 190981 - DNA, 37 bp, Artificial Sequence
  Synthetic oligonucleotide
ttggaggagaagggataaagtgcgtactgcggaggga

SEQ ID NO: 190982 - DNA, 37 bp, Artificial Sequence
  Synthetic oligonucleotide
ttggtcgggcatcgaaagttcttagggcgggtgggga

SEQ ID NO: 190983 - DNA, 36 bp, Artificial Sequence
  Synthetic oligonucleotide
tcatgggaggcgaaaggcaggggggcaggactggga

SEQ ID NO: 190984 - DNA, 37 bp, Artificial Sequence
  Synthetic oligonucleotide
ttgtggggggcaaaagggtgtggagggcatgctggga

SEQ ID NO: 190985 - DNA, 37 bp, Artificial Sequence
  Synthetic oligonucleotide
gaaccggcctggtactgcccgccccccctcacgtgga

SEQ ID NO: 190986 - DNA, 35 bp, Artificial Sequence
  Synthetic oligonucleotide
tcaccccaccgtacatactgtactaggcccttgga

SEQ ID NO: 190987 - DNA, 37 bp, Artificial Sequence
  Synthetic oligonucleotide
attcacccctacgctgttagcgcagtccccgccctga

SEQ ID NO: 190988 - DNA, 37 bp, Artificial Sequence
  Synthetic oligonucleotide
gctgtgcatcccactttggctttcgacctggccctga

SEQ ID NO: 190989 - DNA, 37 bp, Artificial Sequence
  Synthetic oligonucleotide
gcaggccttcttgctgcacagccttgttcatccctga

SEQ ID NO: 190990 - DNA, 37 bp, Artificial Sequence
  Synthetic oligonucleotide
aggaaccatcaactgctaccatactacgccatcctga

SEQ ID NO: 190991 - DNA, 36 bp, Artificial Sequence
  Synthetic oligonucleotide
gcaacactgattcaggcgtaccatctgccttcctga

SEQ ID NO: 190992 - DNA, 38 bp, Artificial Sequence
  Synthetic oligonucleotide
gacagcacctattctatcgccctctacctcctggctga

SEQ ID NO: 190993 - DNA, 37 bp, Artificial Sequence
  Synthetic oligonucleotide
taggaccccccccatgttcgcctgagcattttgctga

SEQ ID NO: 190994 - DNA, 38 bp, Artificial Sequence
  Synthetic oligonucleotide
gagacaccatggagggtgaggaaagggggatagtctga

SEQ ID NO: 190995 - DNA, 36 bp, Artificial Sequence
  Synthetic oligonucleotide
gagtgggtgggtgggaagtggggcccagtagtctga

SEQ ID NO: 190996 - DNA, 37 bp, Artificial Sequence
  Synthetic oligonucleotide
agaaatgcacgaagggggataggagctggagaagtga

SEQ ID NO: 190997 - DNA, 37 bp, Artificial Sequence
  Synthetic oligonucleotide
tagatggcggtgagcggggtgaaatgggggagcgtga

SEQ ID NO: 190998 - DNA, 35 bp, Artificial Sequence
  Synthetic oligonucleotide
actacacactcccatgattaacatccacttggtga

SEQ ID NO: 190999 - DNA, 38 bp, Artificial Sequence
  Synthetic oligonucleotide
gagggggaggcaacgggtacgcggggaacaaggtgtga

SEQ ID NO: 191000 - DNA, 38 bp, Artificial Sequence
  Synthetic oligonucleotide
gtcgacgcctgcccggacacctccgcttatctgattga

SEQ ID NO: 191001 - DNA, 37 bp, Artificial Sequence
  Synthetic oligonucleotide
aacctcatcagtccgattctactgcgctgccccttga

SEQ ID NO: 191002 - DNA, 38 bp, Artificial Sequence
  Synthetic oligonucleotide
actcgaccctcaatgtatttgccccgatactcccttga

SEQ ID NO: 191003 - DNA, 36 bp, Artificial Sequence
  Synthetic oligonucleotide
tccacattgccctgttacttgccgagccttggttga

SEQ ID NO: 191004 - DNA, 38 bp, Artificial Sequence
  Synthetic oligonucleotide
gaccatcctccgtgttattttggcctctcttatgttga

SEQ ID NO: 191005 - DNA, 37 bp, Artificial Sequence
  Synthetic oligonucleotide
tgtggcccctgacctagtactgctgcaccttgtttga

SEQ ID NO: 191006 - DNA, 36 bp, Artificial Sequence
  Synthetic oligonucleotide
gcccctgccctccagctcggtatcgctgccataata

SEQ ID NO: 191007 - DNA, 35 bp, Artificial Sequence
  Synthetic oligonucleotide
aactgggagcagtgggatgcagggatggggcgata

SEQ ID NO: 191008 - DNA, 36 bp, Artificial Sequence
  Synthetic oligonucleotide
gaggaaggtgggggtgagaacgaccggacagggata

SEQ ID NO: 191009 - DNA, 36 bp, Artificial Sequence
  Synthetic oligonucleotide
gactcgcctgccccggacagtctgtagcactcccta

SEQ ID NO: 191010 - DNA, 35 bp, Artificial Sequence
  Synthetic oligonucleotide
agacacgcctcctttggccgtatcccgaaatccta

SEQ ID NO: 191011 - DNA, 35 bp, Artificial Sequence
  Synthetic oligonucleotide
atgcttgtgtatgcgttgcctcacgttccatccta

SEQ ID NO: 191012 - DNA, 36 bp, Artificial Sequence
  Synthetic oligonucleotide
ttgcatcctcgttcgtttgatcgagccttccctcta

SEQ ID NO: 191013 - DNA, 36 bp, Artificial Sequence
  Synthetic oligonucleotide
ttgaacagatggagctcatgggggaggaggagcgta

SEQ ID NO: 191014 - DNA, 35 bp, Artificial Sequence
  Synthetic oligonucleotide
aacgatcagaggggacaagatggaggatgggcgta

SEQ ID NO: 191015 - DNA, 36 bp, Artificial Sequence
  Synthetic oligonucleotide
gcactaccgtatggtcttttcctacacctgcttgta

SEQ ID NO: 191016 - DNA, 35 bp, Artificial Sequence
  Synthetic oligonucleotide
tatggcctctgcccccacctgccgatatgaaacac

SEQ ID NO: 191017 - DNA, 35 bp, Artificial Sequence
  Synthetic oligonucleotide
ttatcccgtcgccagaattcctttgactccgccac

SEQ ID NO: 191018 - DNA, 35 bp, Artificial Sequence
  Synthetic oligonucleotide
tccagccatattcgttgagcctatacccgtgccac

SEQ ID NO: 191019 - DNA, 35 bp, Artificial Sequence
  Synthetic oligonucleotide
gctgggacctcagttccgctgtttctgttatccac

SEQ ID NO: 191020 - DNA, 35 bp, Artificial Sequence
  Synthetic oligonucleotide
gacctgcctccgaacccactccttaatcaggtgac

SEQ ID NO: 191021 - DNA, 35 bp, Artificial Sequence
  Synthetic oligonucleotide
tgcgtgtggaccagtaatgtcatcgcctctcctac

SEQ ID NO: 191022 - DNA, 35 bp, Artificial Sequence
  Synthetic oligonucleotide
ggaaccgccactccatgtcaatcttgtccgtctac

SEQ ID NO: 191023 - DNA, 35 bp, Artificial Sequence
  Synthetic oligonucleotide
tcactggacaccttatacggtagtaacgttacacc

SEQ ID NO: 191024 - DNA, 35 bp, Artificial Sequence
  Synthetic oligonucleotide
acgaccccatagaactttacgatccgcgttacacc

SEQ ID NO: 191025 - DNA, 35 bp, Artificial Sequence
  Synthetic oligonucleotide
tagtgatcagcgcagccagttctgtactcgccacc

SEQ ID NO: 191026 - DNA, 35 bp, Artificial Sequence
  Synthetic oligonucleotide
tcttgcctcctcgccccactcgccagtttgccacc

SEQ ID NO: 191027 - DNA, 35 bp, Artificial Sequence
  Synthetic oligonucleotide
gtgccccaatgcctaaattggtattaccccgtacc

SEQ ID NO: 191028 - DNA, 35 bp, Artificial Sequence
  Synthetic oligonucleotide
tgtctcatcatggcctcctaagcacccagtttacc

SEQ ID NO: 191029 - DNA, 35 bp, Artificial Sequence
  Synthetic oligonucleotide
tcaccaaagcgcatcctatctggcttttccaaccc

SEQ ID NO: 191030 - DNA, 35 bp, Artificial Sequence
  Synthetic oligonucleotide
atggcgaccgccatatagtacccactcctacaccc

SEQ ID NO: 191031 - DNA, 35 bp, Artificial Sequence
  Synthetic oligonucleotide
tcgccaccctccgtcctgtttccacatctgcaccc

SEQ ID NO: 191032 - DNA, 35 bp, Artificial Sequence
  Synthetic oligonucleotide
agcacgcctccgccctcgtttgctcgatctccccc

SEQ ID NO: 191033 - DNA, 35 bp, Artificial Sequence
  Synthetic oligonucleotide
tacgtcattaccaccccgatgatcagctgttcccc

SEQ ID NO: 191034 - DNA, 35 bp, Artificial Sequence
  Synthetic oligonucleotide
acccatcccgctgtctttaatggtttcccacgccc

SEQ ID NO: 191035 - DNA, 35 bp, Artificial Sequence
  Synthetic oligonucleotide
gtgcactgcccgcggttgtgggcatccgacctccc

SEQ ID NO: 191036 - DNA, 35 bp, Artificial Sequence
  Synthetic oligonucleotide
gcacggactcatcagacggccctcgcacttttccc

SEQ ID NO: 191037 - DNA, 35 bp, Artificial Sequence
  Synthetic oligonucleotide
tacacccgtggtttttgcaaggtctcttttgcgcc

SEQ ID NO: 191038 - DNA, 35 bp, Artificial Sequence
  Synthetic oligonucleotide
accaccgctcggcgtgagttttcttgcccctcgcc

SEQ ID NO: 191039 - DNA, 35 bp, Artificial Sequence
  Synthetic oligonucleotide
gatccctcaggccctagctccgcgccactgtcgcc

SEQ ID NO: 191040 - DNA, 35 bp, Artificial Sequence
  Synthetic oligonucleotide
gacgacccctgccgtagggatcctgcttccatgcc

SEQ ID NO: 191041 - DNA, 35 bp, Artificial Sequence
  Synthetic oligonucleotide
gatcccttcaccgcttgatcccacggttacctgcc

SEQ ID NO: 191042 - DNA, 35 bp, Artificial Sequence
  Synthetic oligonucleotide
tgcggtccacactgttttttttgccgtcccctgcc

SEQ ID NO: 191043 - DNA, 35 bp, Artificial Sequence
  Synthetic oligonucleotide
gagtacgtcttcagtcgcgccctagccatcttgcc

SEQ ID NO: 191044 - DNA, 35 bp, Artificial Sequence
  Synthetic oligonucleotide
ttgcggctcgccctcacctccatgcgcttgttgcc

SEQ ID NO: 191045 - DNA, 35 bp, Artificial Sequence
  Synthetic oligonucleotide
gagagaggcaacgcatttcgtacttgctcccatcc

SEQ ID NO: 191046 - DNA, 35 bp, Artificial Sequence
  Synthetic oligonucleotide
tgttgctgctcagcaccccgtttctcctgcactcc

SEQ ID NO: 191047 - DNA, 35 bp, Artificial Sequence
  Synthetic oligonucleotide
tccacggtcagttccactcgtaatggcctccctcc

SEQ ID NO: 191048 - DNA, 35 bp, Artificial Sequence
  Synthetic oligonucleotide
gcttatcccggtcagatacgcattcgccactgtcc

SEQ ID NO: 191049 - DNA, 35 bp, Artificial Sequence
  Synthetic oligonucleotide
agttagggctcccatttgttcactctggctattcc

SEQ ID NO: 191050 - DNA, 34 bp, Artificial Sequence
  Synthetic oligonucleotide
tgctcaccaggtccatagccttaatgtatcttcc

SEQ ID NO: 191051 - DNA, 35 bp, Artificial Sequence
  Synthetic oligonucleotide
tcattgggcgattgtttgtccccagtcctctttcc

SEQ ID NO: 191052 - DNA, 35 bp, Artificial Sequence
  Synthetic oligonucleotide
ggtccttcttcgcccgtattctgcccagtctttcc

SEQ ID NO: 191053 - DNA, 35 bp, Artificial Sequence
  Synthetic oligonucleotide
tgttatgacggtgtgatcactgtccccttgtttcc

SEQ ID NO: 191054 - DNA, 35 bp, Artificial Sequence
  Synthetic oligonucleotide
attggcccgccgctacctcacgacttcttctatgc

SEQ ID NO: 191055 - DNA, 35 bp, Artificial Sequence
  Synthetic oligonucleotide
aacgtacacccggaatcgatctcttccctgcttgc

SEQ ID NO: 191056 - DNA, 35 bp, Artificial Sequence
  Synthetic oligonucleotide
atcggacggcgcatcccccgcaacctgtatccatc

SEQ ID NO: 191057 - DNA, 35 bp, Artificial Sequence
  Synthetic oligonucleotide
gcaacaagcacacatttggcgttatggctcacctc

SEQ ID NO: 191058 - DNA, 35 bp, Artificial Sequence
  Synthetic oligonucleotide
tgttgcctgttacacgttgatccgctctatacctc

SEQ ID NO: 191059 - DNA, 35 bp, Artificial Sequence
  Synthetic oligonucleotide
ggttacggcaccaatattgcatcggttcactcctc

SEQ ID NO: 191060 - DNA, 35 bp, Artificial Sequence
  Synthetic oligonucleotide
gtactaccgatcgcatcataactcactcactgctc

SEQ ID NO: 191061 - DNA, 35 bp, Artificial Sequence
  Synthetic oligonucleotide
gaaacacccccgtcctttgtgcttcggtcactctc

SEQ ID NO: 191062 - DNA, 35 bp, Artificial Sequence
  Synthetic oligonucleotide
tatcgccctctgacttgctcagagctctgcctctc

SEQ ID NO: 191063 - DNA, 35 bp, Artificial Sequence
  Synthetic oligonucleotide
gttgatcgtccgccaccctgacgaatgtcgttctc

SEQ ID NO: 191064 - DNA, 35 bp, Artificial Sequence
  Synthetic oligonucleotide
gacgatccaaatcgtataccgctactccatccgtc

SEQ ID NO: 191065 - DNA, 35 bp, Artificial Sequence
  Synthetic oligonucleotide
tcattggcaccttcgccttgttacgtgctcccttc

SEQ ID NO: 191066 - DNA, 35 bp, Artificial Sequence
  Synthetic oligonucleotide
tgtacgtagcccgagattctacttgtcgtcccttc

SEQ ID NO: 191067 - DNA, 35 bp, Artificial Sequence
  Synthetic oligonucleotide
aacataaccctctcgctgtgccttactagtccttc

SEQ ID NO: 191068 - DNA, 35 bp, Artificial Sequence
  Synthetic oligonucleotide
gatgacaatgggtaggttggaacggtgagaaaaag

SEQ ID NO: 191069 - DNA, 35 bp, Artificial Sequence
  Synthetic oligonucleotide
gctggatcgtaggagcgggtcaaggaagggggaag

SEQ ID NO: 191070 - DNA, 35 bp, Artificial Sequence
  Synthetic oligonucleotide
tgaggtccgcacctcttaatgccccctgttttacg

SEQ ID NO: 191071 - DNA, 35 bp, Artificial Sequence
  Synthetic oligonucleotide
gttggcacccatgttttttctaccccccctgtgcg

SEQ ID NO: 191072 - DNA, 34 bp, Artificial Sequence
  Synthetic oligonucleotide
agctcccttcacgtgcagtgtcacgcctccctcg

SEQ ID NO: 191073 - DNA, 35 bp, Artificial Sequence
  Synthetic oligonucleotide
ttaccccacatggattctgacctccgccttgctcg

SEQ ID NO: 191074 - DNA, 35 bp, Artificial Sequence
  Synthetic oligonucleotide
gtagaggaaggggggaaactgcaatagcacaaagg

SEQ ID NO: 191075 - DNA, 35 bp, Artificial Sequence
  Synthetic oligonucleotide
gtaaactccctgccctcacagcttgcctgcaacgg

SEQ ID NO: 191076 - DNA, 35 bp, Artificial Sequence
  Synthetic oligonucleotide
tgtaacatgccgttgtcctcctccaccgccgccgg

SEQ ID NO: 191077 - DNA, 35 bp, Artificial Sequence
  Synthetic oligonucleotide
tcgcgaccttgccgatcttctttaccatgtacctg

SEQ ID NO: 191078 - DNA, 35 bp, Artificial Sequence
  Synthetic oligonucleotide
accactcagatcgtcgcctccttttcccctcgctg

SEQ ID NO: 191079 - DNA, 35 bp, Artificial Sequence
  Synthetic oligonucleotide
acgaggagggggggtacgtgtgttttggggaagtg

SEQ ID NO: 191080 - DNA, 35 bp, Artificial Sequence
  Synthetic oligonucleotide
tttgacacgtaccgctctcttactctctccacttg

SEQ ID NO: 191081 - DNA, 35 bp, Artificial Sequence
  Synthetic oligonucleotide
gttcccgccccgaattatcgtatcgttcccttttg

SEQ ID NO: 191082 - DNA, 35 bp, Artificial Sequence
  Synthetic oligonucleotide
gcgtcgaggccgccgccgttacttagtcccttaat

SEQ ID NO: 191083 - DNA, 35 bp, Artificial Sequence
  Synthetic oligonucleotide
tacgactccttctgttgacgctcgcttttgcccat

SEQ ID NO: 191084 - DNA, 34 bp, Artificial Sequence
  Synthetic oligonucleotide
gacctgagatctcgccgtggctattatgctccat

SEQ ID NO: 191085 - DNA, 34 bp, Artificial Sequence
  Synthetic oligonucleotide
acgagggagattgaaccgaggggggggggagcat

SEQ ID NO: 191086 - DNA, 35 bp, Artificial Sequence
  Synthetic oligonucleotide
caccctgcttactttgcttacgatcgtacgtgcct

SEQ ID NO: 191087 - DNA, 35 bp, Artificial Sequence
  Synthetic oligonucleotide
agatcgtgtcgcctgtgcctttgttatcgtttcct

SEQ ID NO: 191088 - DNA, 35 bp, Artificial Sequence
  Synthetic oligonucleotide
tcaccggcggatcgcctatttaatctccacccgct

SEQ ID NO: 191089 - DNA, 35 bp, Artificial Sequence
  Synthetic oligonucleotide
gtggacgcagtatctcatagctcctggatgcctct

SEQ ID NO: 191090 - DNA, 35 bp, Artificial Sequence
  Synthetic oligonucleotide
tagcatcgagagattgtaagccctgccccccacgt

SEQ ID NO: 191091 - DNA, 35 bp, Artificial Sequence
  Synthetic oligonucleotide
tcaatgcctgcgccctctccactaaacgttctcgt

SEQ ID NO: 191092 - DNA, 35 bp, Artificial Sequence
  Synthetic oligonucleotide
tcaccgccattccgccagcctttcgcccacctggt

SEQ ID NO: 191093 - DNA, 35 bp, Artificial Sequence
  Synthetic oligonucleotide
gactagcagataagtatcccgccctccacgcctgt

SEQ ID NO: 191094 - DNA, 35 bp, Artificial Sequence
  Synthetic oligonucleotide
gcccccccctgctccaattgtatatcattggctgt

SEQ ID NO: 191095 - DNA, 34 bp, Artificial Sequence
  Synthetic oligonucleotide
taccggcccacgttcggtcagtttccttctctgt

SEQ ID NO: 191096 - DNA, 35 bp, Artificial Sequence
  Synthetic oligonucleotide
gggtgagccacaagctgccttcaattcctctcgtt

SEQ ID NO: 191097 - DNA, 35 bp, Artificial Sequence
  Synthetic oligonucleotide
atacccgccaattcccttgtaccgtcccaggattt

SEQ ID NO: 191098 - DNA, 35 bp, Artificial Sequence
  Synthetic oligonucleotide
gtgtggccaccttactccctggttctcgatctttt

SEQ ID NO: 191099 - DNA, 35 bp, Artificial Sequence
  Synthetic oligonucleotide
tgatgattccgactcctgataccgccccgtgacaa

SEQ ID NO: 191100 - DNA, 35 bp, Artificial Sequence
  Synthetic oligonucleotide
gttgccctccggtcctgaaatatataaccgcccaa

SEQ ID NO: 191101 - DNA, 35 bp, Artificial Sequence
  Synthetic oligonucleotide
acgcgtgacctcctctcctgtgctgcttactccaa

SEQ ID NO: 191102 - DNA, 35 bp, Artificial Sequence
  Synthetic oligonucleotide
gatgccccgcctccttatgcctcttgaagggcgaa

SEQ ID NO: 191103 - DNA, 36 bp, Artificial Sequence
  Synthetic oligonucleotide
acccccgattcactgcgacgcatctttaccttcgaa

SEQ ID NO: 191104 - DNA, 36 bp, Artificial Sequence
  Synthetic oligonucleotide
aacgccctcgctgactacctttccacttctgcctaa

SEQ ID NO: 191105 - DNA, 36 bp, Artificial Sequence
  Synthetic oligonucleotide
gcgcatcactacctccgtgcaccagttccctcctaa

SEQ ID NO: 191106 - DNA, 36 bp, Artificial Sequence
  Synthetic oligonucleotide
tcccgaccccgcctatcctgtggtagcccttcgaca

SEQ ID NO: 191107 - DNA, 35 bp, Artificial Sequence
  Synthetic oligonucleotide
tcatcaccaactgtcggacccttgacccatctaca

SEQ ID NO: 191108 - DNA, 36 bp, Artificial Sequence
  Synthetic oligonucleotide
accttatcccgccaatgttccgcatcccatgtacca

SEQ ID NO: 191109 - DNA, 34 bp, Artificial Sequence
  Synthetic oligonucleotide
ttaatgccgccgcccacagcctattcgtgtacca

SEQ ID NO: 191110 - DNA, 36 bp, Artificial Sequence
  Synthetic oligonucleotide
tccgcccgttacgttcgcactatcattgattaccca

SEQ ID NO: 191111 - DNA, 36 bp, Artificial Sequence
  Synthetic oligonucleotide
atggtacgtccaggttagttttcacgccattcccca

SEQ ID NO: 191112 - DNA, 36 bp, Artificial Sequence
  Synthetic oligonucleotide
gttactgccttccccgtatgtttgacgtctggccca

SEQ ID NO: 191113 - DNA, 36 bp, Artificial Sequence
  Synthetic oligonucleotide
tccgcctcaccccactcaatgtccgtaggttgccca

SEQ ID NO: 191114 - DNA, 35 bp, Artificial Sequence
  Synthetic oligonucleotide
aactccaccagatcagctcacttgggcttctccca

SEQ ID NO: 191115 - DNA, 36 bp, Artificial Sequence
  Synthetic oligonucleotide
gacagggcctgcctgaactcctccccgcgttgtcca

SEQ ID NO: 191116 - DNA, 35 bp, Artificial Sequence
  Synthetic oligonucleotide
taaaagggggaagcatagaaaaggggtcggaggca

SEQ ID NO: 191117 - DNA, 36 bp, Artificial Sequence
  Synthetic oligonucleotide
gagataccgggcggaagaggcgggagaaggacggca

SEQ ID NO: 191118 - DNA, 36 bp, Artificial Sequence
  Synthetic oligonucleotide
gatagggggcggttcaaaagaatatggggggcggca

SEQ ID NO: 191119 - DNA, 36 bp, Artificial Sequence
  Synthetic oligonucleotide
tgctccacatctgtatagtcctttcacctccctgca

SEQ ID NO: 191120 - DNA, 35 bp, Artificial Sequence
  Synthetic oligonucleotide
ggaaacatcacattgcctgcgcgcccctccgatca

SEQ ID NO: 191121 - DNA, 35 bp, Artificial Sequence
  Synthetic oligonucleotide
gttgcagagtaggtgcttgaacccttccttcctca

SEQ ID NO: 191122 - DNA, 35 bp, Artificial Sequence
  Synthetic oligonucleotide
tacacgccgaagtgtaggtccctcaacatctctca

SEQ ID NO: 191123 - DNA, 35 bp, Artificial Sequence
  Synthetic oligonucleotide
accagaggccaatcttagttcatcccccgctgtca

SEQ ID NO: 191124 - DNA, 36 bp, Artificial Sequence
  Synthetic oligonucleotide
tgccgcacactctcgctatagttgctccccgcttca

SEQ ID NO: 191125 - DNA, 36 bp, Artificial Sequence
  Synthetic oligonucleotide
tgaccgcccctgcccatacagtgacacagaagttca

SEQ ID NO: 191126 - DNA, 36 bp, Artificial Sequence
  Synthetic oligonucleotide
agccagtccgcacatcctgccaacgtaaccggttca

SEQ ID NO: 191127 - DNA, 37 bp, Artificial Sequence
  Synthetic oligonucleotide
ggaggggggcaagagaagagggtaagaggagtaaaga

SEQ ID NO: 191128 - DNA, 37 bp, Artificial Sequence
  Synthetic oligonucleotide
attcgcctcagcctaccgtgcgctctctctatccaga

SEQ ID NO: 191129 - DNA, 37 bp, Artificial Sequence
  Synthetic oligonucleotide
agatagtaggaaggcaaggaacgtagggacaggcaga

SEQ ID NO: 191130 - DNA, 37 bp, Artificial Sequence
  Synthetic oligonucleotide
attgcgcgcaatcatacccgctcccccttggtaacga

SEQ ID NO: 191131 - DNA, 36 bp, Artificial Sequence
  Synthetic oligonucleotide
gtccccgtacactgactccaccggtaacctctacga

SEQ ID NO: 191132 - DNA, 36 bp, Artificial Sequence
  Synthetic oligonucleotide
aattgcaagtggggggggggcacggggacattacga

SEQ ID NO: 191133 - DNA, 37 bp, Artificial Sequence
  Synthetic oligonucleotide
aacagcaacgctggcccatgttccgtcctatatccga

SEQ ID NO: 191134 - DNA, 37 bp, Artificial Sequence
  Synthetic oligonucleotide
gcctgtgacagctattgctttctctccatgtttccga

SEQ ID NO: 191135 - DNA, 37 bp, Artificial Sequence
  Synthetic oligonucleotide
tgtcccaactgcttgttctgttctgtcctcttatcga

SEQ ID NO: 191136 - DNA, 36 bp, Artificial Sequence
  Synthetic oligonucleotide
gtcaccccgcttttgaactaccgtccatgatctcga

SEQ ID NO: 191137 - DNA, 37 bp, Artificial Sequence
  Synthetic oligonucleotide
ggagccgtagggtaggagaggagagatgggccgtcga

SEQ ID NO: 191138 - DNA, 37 bp, Artificial Sequence
  Synthetic oligonucleotide
ggtcaatcctccgcccctggtaagtcctgcagaagga

SEQ ID NO: 191139 - DNA, 37 bp, Artificial Sequence
  Synthetic oligonucleotide
tccccactccccattctaaaaacgccctttctaagga

SEQ ID NO: 191140 - DNA, 37 bp, Artificial Sequence
  Synthetic oligonucleotide
tcccgcgccgaatcgccgtgtcccgctctccccagga

SEQ ID NO: 191141 - DNA, 35 bp, Artificial Sequence
  Synthetic oligonucleotide
tcaaggtcagttaaaaagggtggggagggtgagga

SEQ ID NO: 191142 - DNA, 37 bp, Artificial Sequence
  Synthetic oligonucleotide
atgtgcaaaaatggtaggagcgggaacgggagaggga

SEQ ID NO: 191143 - DNA, 37 bp, Artificial Sequence
  Synthetic oligonucleotide
ttgagaaggatcgagggggagcagggacttggaggga

SEQ ID NO: 191144 - DNA, 37 bp, Artificial Sequence
  Synthetic oligonucleotide
agccaagggaagggaggggacggtgagtaacccggga

SEQ ID NO: 191145 - DNA, 37 bp, Artificial Sequence
  Synthetic oligonucleotide
aacggataggtagggatggttggcggtgatgggggga

SEQ ID NO: 191146 - DNA, 37 bp, Artificial Sequence
  Synthetic oligonucleotide
gctgccggaataaaggaaggggagcacgggcatggga

SEQ ID NO: 191147 - DNA, 37 bp, Artificial Sequence
  Synthetic oligonucleotide
gacgcgcgatcgccactgcccgcccttctcactggga

SEQ ID NO: 191148 - DNA, 37 bp, Artificial Sequence
  Synthetic oligonucleotide
acatcacatccgccttggcgtctcatcaccacctgga

SEQ ID NO: 191149 - DNA, 37 bp, Artificial Sequence
  Synthetic oligonucleotide
tcgcaaaagacgggaggagagtggtgggcgcagtgga

SEQ ID NO: 191150 - DNA, 37 bp, Artificial Sequence
  Synthetic oligonucleotide
gttcgctgccccgcatggttcgcgcctcctgcttgga

SEQ ID NO: 191151 - DNA, 38 bp, Artificial Sequence
  Synthetic oligonucleotide
gagaggatgtgaagagggtaaggatggaaggtgaatga

SEQ ID NO: 191152 - DNA, 38 bp, Artificial Sequence
  Synthetic oligonucleotide
aagcggacgccccgagtgcttttcgtttcttctcatga

SEQ ID NO: 191153 - DNA, 38 bp, Artificial Sequence
  Synthetic oligonucleotide
tcaatctacccgccacctcgtaaacaggacattcatga

SEQ ID NO: 191154 - DNA, 38 bp, Artificial Sequence
  Synthetic oligonucleotide
tagcctgggagtcagtcgggcgggggggtgacggatga

SEQ ID NO: 191155 - DNA, 38 bp, Artificial Sequence
  Synthetic oligonucleotide
gagggtgggacaatgggggggggtgtagcacgctatga

SEQ ID NO: 191156 - DNA, 36 bp, Artificial Sequence
  Synthetic oligonucleotide
gcaaagagatgaaggggtggtggatgagtcagctga

SEQ ID NO: 191157 - DNA, 38 bp, Artificial Sequence
  Synthetic oligonucleotide
gccggtggtgagatgtagggtggggcggggatggctga

SEQ ID NO: 191158 - DNA, 38 bp, Artificial Sequence
  Synthetic oligonucleotide
acccacgcgcatattgcccttcgccatttcaactctga

SEQ ID NO: 191159 - DNA, 38 bp, Artificial Sequence
  Synthetic oligonucleotide
gtccccgccgatacctaaaacgcacaccgattctctga

SEQ ID NO: 191160 - DNA, 38 bp, Artificial Sequence
  Synthetic oligonucleotide
gccgccggcgcaatccgttcatgctcatctctttctga

SEQ ID NO: 191161 - DNA, 38 bp, Artificial Sequence
  Synthetic oligonucleotide
gtgcatgagacaagatagggatggtggtgtagtagtga

SEQ ID NO: 191162 - DNA, 37 bp, Artificial Sequence
  Synthetic oligonucleotide
accaacgccgtatcctctcatttcaccaagtccgtga

SEQ ID NO: 191163 - DNA, 38 bp, Artificial Sequence
  Synthetic oligonucleotide
gagggcgcagagggggatgcctgagggtaggggcgtga

SEQ ID NO: 191164 - DNA, 38 bp, Artificial Sequence
  Synthetic oligonucleotide
gactgccgagctggtttgacccatcccccacttcgtga

SEQ ID NO: 191165 - DNA, 38 bp, Artificial Sequence
  Synthetic oligonucleotide
taggtggagaggagtggatggtgcggtattaatggtga

SEQ ID NO: 191166 - DNA, 37 bp, Artificial Sequence
  Synthetic oligonucleotide
gagagacgggagagagtgggggggaggttgcacttga

SEQ ID NO: 191167 - DNA, 38 bp, Artificial Sequence
  Synthetic oligonucleotide
tagcctgcgaattctgtcccatctgcccgctcccttga

SEQ ID NO: 191168 - DNA, 38 bp, Artificial Sequence
  Synthetic oligonucleotide
acagcctgggtcatcatcctctgccgccgtttcgttga

SEQ ID NO: 191169 - DNA, 38 bp, Artificial Sequence
  Synthetic oligonucleotide
gcgtggtcgcctcgttttgcttccgactttgcctttga

SEQ ID NO: 191170 - DNA, 38 bp, Artificial Sequence
  Synthetic oligonucleotide
tcacagcaactgttgccctccgacctcttttcctttga

SEQ ID NO: 191171 - DNA, 38 bp, Artificial Sequence
  Synthetic oligonucleotide
gacctactcacagtgtgctgccccccgattcgctttga

SEQ ID NO: 191172 - DNA, 35 bp, Artificial Sequence
  Synthetic oligonucleotide
accacccaacatggggacttgcctctcttaccata

SEQ ID NO: 191173 - DNA, 35 bp, Artificial Sequence
  Synthetic oligonucleotide
gcctaaccgcccccttctgtattgctaaatcgata

SEQ ID NO: 191174 - DNA, 35 bp, Artificial Sequence
  Synthetic oligonucleotide
attcaccgactacctggccctgtaccctcgcccta

SEQ ID NO: 191175 - DNA, 35 bp, Artificial Sequence
  Synthetic oligonucleotide
acacttcctcatgagccgttttcctgcagttccta

SEQ ID NO: 191176 - DNA, 36 bp, Artificial Sequence
  Synthetic oligonucleotide
attgcggcaccccacgtatcgccttgctccccgcta

SEQ ID NO: 191177 - DNA, 34 bp, Artificial Sequence
  Synthetic oligonucleotide
gccaactcattggtcccacccaccttactggcta

SEQ ID NO: 191178 - DNA, 36 bp, Artificial Sequence
  Synthetic oligonucleotide
gatatccccaaccgtgccgaccgcctttacagtcta

SEQ ID NO: 191179 - DNA, 35 bp, Artificial Sequence
  Synthetic oligonucleotide
tccgcccccccactccctcaatgtcctgttcttta

SEQ ID NO: 191180 - DNA, 35 bp, Artificial Sequence
  Synthetic oligonucleotide
tacgttgccatctaactccgccgtttttgacgaac

SEQ ID NO: 191181 - DNA, 35 bp, Artificial Sequence
  Synthetic oligonucleotide
gccctcatcggatctgcaggcgatcccctcaccac

SEQ ID NO: 191182 - DNA, 35 bp, Artificial Sequence
  Synthetic oligonucleotide
gagatggtgggagggtactcattgctccgggggac

SEQ ID NO: 191183 - DNA, 35 bp, Artificial Sequence
  Synthetic oligonucleotide
ggagcgccctctgctgacccctgttcattcgctac

SEQ ID NO: 191184 - DNA, 35 bp, Artificial Sequence
  Synthetic oligonucleotide
tctgagcatagtcgcgaaacccatgcctcccgtac

SEQ ID NO: 191185 - DNA, 35 bp, Artificial Sequence
  Synthetic oligonucleotide
gttcccgcccgaggtaggcgtcttgctcccaaacc

SEQ ID NO: 191186 - DNA, 35 bp, Artificial Sequence
  Synthetic oligonucleotide
aaaaggcgggacgggggggaggtgctgtaagaacc

SEQ ID NO: 191187 - DNA, 35 bp, Artificial Sequence
  Synthetic oligonucleotide
tttgccatcatcccctctggtttgcttgactcacc

SEQ ID NO: 191188 - DNA, 35 bp, Artificial Sequence
  Synthetic oligonucleotide
gcaccagttcaggtcgccatttcccgccaaaaccc

SEQ ID NO: 191189 - DNA, 35 bp, Artificial Sequence
  Synthetic oligonucleotide
gcgcgtatgtccgttttcccccgtaggctcacccc

SEQ ID NO: 191190 - DNA, 35 bp, Artificial Sequence
  Synthetic oligonucleotide
accgagtggaacgtatccgccatgtttgctacccc

SEQ ID NO: 191191 - DNA, 35 bp, Artificial Sequence
  Synthetic oligonucleotide
tcctgccccaccaaacataaggcccagaccaagcc

SEQ ID NO: 191192 - DNA, 35 bp, Artificial Sequence
  Synthetic oligonucleotide
tgtggcccccgaactgttttctcgaccgtaccgcc

SEQ ID NO: 191193 - DNA, 35 bp, Artificial Sequence
  Synthetic oligonucleotide
tccagcacgctatcgtctccccccagcaaaatgcc

SEQ ID NO: 191194 - DNA, 35 bp, Artificial Sequence
  Synthetic oligonucleotide
acgaatatgctgagcgttaactacctgtccctgcc

SEQ ID NO: 191195 - DNA, 35 bp, Artificial Sequence
  Synthetic oligonucleotide
tctcggtacacatccgccgtccataatcctcatcc

SEQ ID NO: 191196 - DNA, 35 bp, Artificial Sequence
  Synthetic oligonucleotide
gcgctgcttacaatctcgtacaatcatctggctcc

SEQ ID NO: 191197 - DNA, 35 bp, Artificial Sequence
  Synthetic oligonucleotide
attgtccaccgcaaccatgaggttggagtttgtcc

SEQ ID NO: 191198 - DNA, 35 bp, Artificial Sequence
  Synthetic oligonucleotide
tgccaccctatctgtgagcaggacctccaccttcc

SEQ ID NO: 191199 - DNA, 35 bp, Artificial Sequence
  Synthetic oligonucleotide
taagcactatctctctgcgttttggggtcccttcc

SEQ ID NO: 191200 - DNA, 35 bp, Artificial Sequence
  Synthetic oligonucleotide
gccgaggtctcgctaaacgatcagcacacgcttcc

SEQ ID NO: 191201 - DNA, 35 bp, Artificial Sequence
  Synthetic oligonucleotide
tgttcccactcgtttggtttatccgaggttcttcc

SEQ ID NO: 191202 - DNA, 35 bp, Artificial Sequence
  Synthetic oligonucleotide
tcaagggggaaggcgggggcggagaggaggtaagc

SEQ ID NO: 191203 - DNA, 35 bp, Artificial Sequence
  Synthetic oligonucleotide
gtacgtgctccatcaattttagccccatccatagc

SEQ ID NO: 191204 - DNA, 35 bp, Artificial Sequence
  Synthetic oligonucleotide
tcacctccacttagcataagcgccccgcgacacgc

SEQ ID NO: 191205 - DNA, 35 bp, Artificial Sequence
  Synthetic oligonucleotide
gatacgacactccttcttgaaaagcacttcgccgc

SEQ ID NO: 191206 - DNA, 35 bp, Artificial Sequence
  Synthetic oligonucleotide
ttcccgcttcccagaattccagtcttctttgccgc

SEQ ID NO: 191207 - DNA, 35 bp, Artificial Sequence
  Synthetic oligonucleotide
aataaggcctgaagagcggaggggggtggtaaggc

SEQ ID NO: 191208 - DNA, 35 bp, Artificial Sequence
  Synthetic oligonucleotide
gaatttcgccgccgtgctccacgtccagtccttgc

SEQ ID NO: 191209 - DNA, 35 bp, Artificial Sequence
  Synthetic oligonucleotide
gagagaggggggcggagggtttgtcggggccaatc

SEQ ID NO: 191210 - DNA, 35 bp, Artificial Sequence
  Synthetic oligonucleotide
acaggggctctcttcactggtttcgttgttccatc

SEQ ID NO: 191211 - DNA, 35 bp, Artificial Sequence
  Synthetic oligonucleotide
tttgccatcctgcctatatttccgtgatcggactc

SEQ ID NO: 191212 - DNA, 35 bp, Artificial Sequence
  Synthetic oligonucleotide
gtatccgccctgagtactttgcttacctatgcctc

SEQ ID NO: 191213 - DNA, 35 bp, Artificial Sequence
  Synthetic oligonucleotide
gcatgtccagctgcctgcaatagtaccctatcctc

SEQ ID NO: 191214 - DNA, 35 bp, Artificial Sequence
  Synthetic oligonucleotide
tcagtcccaccgccccgttgtatgccaagcatctc

SEQ ID NO: 191215 - DNA, 35 bp, Artificial Sequence
  Synthetic oligonucleotide
tgattcccacgcgtgtcaatactgggctctttctc

SEQ ID NO: 191216 - DNA, 35 bp, Artificial Sequence
  Synthetic oligonucleotide
gtggaccgcctcatcttttggaggcacattttctc

SEQ ID NO: 191217 - DNA, 35 bp, Artificial Sequence
  Synthetic oligonucleotide
ggacacgtgtcaactctgccagaatcttctccgtc

SEQ ID NO: 191218 - DNA, 35 bp, Artificial Sequence
  Synthetic oligonucleotide
gcctatccgctctttctcgtaacgacatccagttc

SEQ ID NO: 191219 - DNA, 35 bp, Artificial Sequence
  Synthetic oligonucleotide
acacctccaaccgacgactgcctggtcatcatttc

SEQ ID NO: 191220 - DNA, 35 bp, Artificial Sequence
  Synthetic oligonucleotide
atggagggggagtgagacgggaaggggaagagaag

SEQ ID NO: 191221 - DNA, 35 bp, Artificial Sequence
  Synthetic oligonucleotide
ggtgcatgtcaaaaaagggtggggcaggagtgaag

SEQ ID NO: 191222 - DNA, 35 bp, Artificial Sequence
  Synthetic oligonucleotide
gtgagaccagggagaatgacagaagaagggttaag

SEQ ID NO: 191223 - DNA, 35 bp, Artificial Sequence
  Synthetic oligonucleotide
tgcgcgcgaggagggaacaggggaggtaaggccag

SEQ ID NO: 191224 - DNA, 35 bp, Artificial Sequence
  Synthetic oligonucleotide
ttgggtcaagggctggggagtaaggggtagagtag

SEQ ID NO: 191225 - DNA, 35 bp, Artificial Sequence
  Synthetic oligonucleotide
attagcccccgtcaccatgctggtcttcctatacg

SEQ ID NO: 191226 - DNA, 35 bp, Artificial Sequence
  Synthetic oligonucleotide
ttggaccgcatctgtttcgcctttcgttgcccgcg

SEQ ID NO: 191227 - DNA, 35 bp, Artificial Sequence
  Synthetic oligonucleotide
gccggtgccctttctctaccgcgtcgttacttgcg

SEQ ID NO: 191228 - DNA, 35 bp, Artificial Sequence
  Synthetic oligonucleotide
atcgcgcgccccagaaatactcccgtccagtctcg

SEQ ID NO: 191229 - DNA, 35 bp, Artificial Sequence
  Synthetic oligonucleotide
gagctgacagttgccgccaacttttacacccttcg

SEQ ID NO: 191230 - DNA, 35 bp, Artificial Sequence
  Synthetic oligonucleotide
aactgcggaaatagagaggggggaacaaggggagg

SEQ ID NO: 191231 - DNA, 35 bp, Artificial Sequence
  Synthetic oligonucleotide
gcatcgccatctgccccgcgcgcttagttccccgg

SEQ ID NO: 191232 - DNA, 36 bp, Artificial Sequence
  Synthetic oligonucleotide
aagcattggagcaggggtgcagggggaatggtaggg

SEQ ID NO: 191233 - DNA, 35 bp, Artificial Sequence
  Synthetic oligonucleotide
gatcaagggggggaatgggttagggagggaagggg

SEQ ID NO: 191234 - DNA, 35 bp, Artificial Sequence
  Synthetic oligonucleotide
gataatcacgtcaacttgtctcccttaccctctgg

SEQ ID NO: 191235 - DNA, 35 bp, Artificial Sequence
  Synthetic oligonucleotide
accggtggctgttccctgtttttgttggttacctg

SEQ ID NO: 191236 - DNA, 35 bp, Artificial Sequence
  Synthetic oligonucleotide
gagacagtagtagagggggggagatttggttgctg

SEQ ID NO: 191237 - DNA, 35 bp, Artificial Sequence
  Synthetic oligonucleotide
taccgaggggggagcctaaaagagggcaagtcgtg

SEQ ID NO: 191238 - DNA, 35 bp, Artificial Sequence
  Synthetic oligonucleotide
tccatcctcaccttgtcaactgtgcccccttcttg

SEQ ID NO: 191239 - DNA, 35 bp, Artificial Sequence
  Synthetic oligonucleotide
accacatgcgcccacgtcacgcctgtctgtcccat

SEQ ID NO: 191240 - DNA, 35 bp, Artificial Sequence
  Synthetic oligonucleotide
gtacatccgtccggcatttgtttcacggccactat

SEQ ID NO: 191241 - DNA, 35 bp, Artificial Sequence
  Synthetic oligonucleotide
ttggacgttgcgctgccccacgattccccatttat

SEQ ID NO: 191242 - DNA, 35 bp, Artificial Sequence
  Synthetic oligonucleotide
gctcagaggcgggttaactactctaccttgcacct

SEQ ID NO: 191243 - DNA, 35 bp, Artificial Sequence
  Synthetic oligonucleotide
gtgcacaggtcgcctcgcgattactcatccgccct

SEQ ID NO: 191244 - DNA, 35 bp, Artificial Sequence
  Synthetic oligonucleotide
ggacacgtatcactatcgacccatacgccggccct

SEQ ID NO: 191245 - DNA, 35 bp, Artificial Sequence
  Synthetic oligonucleotide
tccgtccattgatccatacgttaatcacgctccct

SEQ ID NO: 191246 - DNA, 35 bp, Artificial Sequence
  Synthetic oligonucleotide
tcaccgtcccgctcaatgctgaactatccaagcct

SEQ ID NO: 191247 - DNA, 35 bp, Artificial Sequence
  Synthetic oligonucleotide
acattacgcctgctgacactaaactgcagcctcct

SEQ ID NO: 191248 - DNA, 35 bp, Artificial Sequence
  Synthetic oligonucleotide
tgcactttccactggcaccctcctgatccaaggct

SEQ ID NO: 191249 - DNA, 35 bp, Artificial Sequence
  Synthetic oligonucleotide
gtcgaggggggaggtcggggacgaaagcggatgct

SEQ ID NO: 191250 - DNA, 35 bp, Artificial Sequence
  Synthetic oligonucleotide
tcagctggttcgtggttccattacgtcttccctct

SEQ ID NO: 191251 - DNA, 35 bp, Artificial Sequence
  Synthetic oligonucleotide
gagagttcgagggtgggagggagaaccaaaacagt

SEQ ID NO: 191252 - DNA, 35 bp, Artificial Sequence
  Synthetic oligonucleotide
gtcaatgcccgtcccacctgtctctgtctcccagt

SEQ ID NO: 191253 - DNA, 35 bp, Artificial Sequence
  Synthetic oligonucleotide
tcaacctctcctctcgcacgaccctggcccaaggt

SEQ ID NO: 191254 - DNA, 35 bp, Artificial Sequence
  Synthetic oligonucleotide
attgcacagcctgttgcttaatgcccttttgctgt

SEQ ID NO: 191255 - DNA, 35 bp, Artificial Sequence
  Synthetic oligonucleotide
attgttgctgctcccttatctgctctgtgccttgt

SEQ ID NO: 191256 - DNA, 33 bp, Artificial Sequence
  Synthetic oligonucleotide
gccacgccagtcctatctatgtctttcgcgatt

SEQ ID NO: 191257 - DNA, 35 bp, Artificial Sequence
  Synthetic oligonucleotide
tcatccgttctgcccaactcagcgagtatcacctt

SEQ ID NO: 191258 - DNA, 35 bp, Artificial Sequence
  Synthetic oligonucleotide
ggatcgctcgtctggtgtcatcgccttccatcctt

SEQ ID NO: 191259 - DNA, 35 bp, Artificial Sequence
  Synthetic oligonucleotide
gctcgccccgctttcgttctagcagagtatcgctt

SEQ ID NO: 191260 - DNA, 35 bp, Artificial Sequence
  Synthetic oligonucleotide
gtcaatcggcctttatgatctctttctgcactctt

SEQ ID NO: 191261 - DNA, 35 bp, Artificial Sequence
  Synthetic oligonucleotide
gtaacccgccctactgtagcattccgaacatggtt

SEQ ID NO: 191262 - DNA, 35 bp, Artificial Sequence
  Synthetic oligonucleotide
tttaaccgtcaagatcccccagcctccatcatgtt

SEQ ID NO: 191263 - DNA, 35 bp, Artificial Sequence
  Synthetic oligonucleotide
acttgcttccgaatctgttccatggcccccctgtt

SEQ ID NO: 191264 - DNA, 35 bp, Artificial Sequence
  Synthetic oligonucleotide
tttgtacgccctccctctgaactgctccatttgtt

SEQ ID NO: 191265 - DNA, 35 bp, Artificial Sequence
  Synthetic oligonucleotide
tgccttaccgcgttccttcgtagtccatccgtttt

SEQ ID NO: 191266 - DNA, 35 bp, Artificial Sequence
  Synthetic oligonucleotide
ttgccactccactctgatccttccgtgcccggaaa

SEQ ID NO: 191267 - DNA, 36 bp, Artificial Sequence
  Synthetic oligonucleotide
gaaccacccttctcatgcgtaacagtcagtatccaa

SEQ ID NO: 191268 - DNA, 36 bp, Artificial Sequence
  Synthetic oligonucleotide
ggaggggccggaaaggaactagtatggtggggagaa

SEQ ID NO: 191269 - DNA, 35 bp, Artificial Sequence
  Synthetic oligonucleotide
gacgcttggggtcagggaaggagggggttgaggaa

SEQ ID NO: 191270 - DNA, 36 bp, Artificial Sequence
  Synthetic oligonucleotide
gcctcctcgggtgactacccaattattcccattgaa

SEQ ID NO: 191271 - DNA, 35 bp, Artificial Sequence
  Synthetic oligonucleotide
tatgtcctgcctgtccactctgcgctgcctattaa

SEQ ID NO: 191272 - DNA, 35 bp, Artificial Sequence
  Synthetic oligonucleotide
gacaacaccccgggctgtgatccctcactactaca

SEQ ID NO: 191273 - DNA, 35 bp, Artificial Sequence
  Synthetic oligonucleotide
tcacccaccatcttgcagaatcacacagacttaca

SEQ ID NO: 191274 - DNA, 36 bp, Artificial Sequence
  Synthetic oligonucleotide
gtcaactgagaacgcatacctgaacgcccctaccca

SEQ ID NO: 191275 - DNA, 35 bp, Artificial Sequence
  Synthetic oligonucleotide
atcgccgacgttctaccattagccgtcctacccca

SEQ ID NO: 191276 - DNA, 36 bp, Artificial Sequence
  Synthetic oligonucleotide
tacaacggctggaccgctcaagtcactgcgccccca

SEQ ID NO: 191277 - DNA, 36 bp, Artificial Sequence
  Synthetic oligonucleotide
atgtcagaccgagggcatttgcgcatcccttcccca

SEQ ID NO: 191278 - DNA, 35 bp, Artificial Sequence
  Synthetic oligonucleotide
acgatccgccccagctcctctgagttctaccgcca

SEQ ID NO: 191279 - DNA, 36 bp, Artificial Sequence
  Synthetic oligonucleotide
tgcgctccttccctgttccgcttcgtgtgtgtgcca

SEQ ID NO: 191280 - DNA, 36 bp, Artificial Sequence
  Synthetic oligonucleotide
atctcgccttctcactaatcctgtgcaccttgtcca

SEQ ID NO: 191281 - DNA, 36 bp, Artificial Sequence
  Synthetic oligonucleotide
tgatggggaggcacggcaaaagcaagtcggatggca

SEQ ID NO: 191282 - DNA, 35 bp, Artificial Sequence
  Synthetic oligonucleotide
accatgcatttcgctccacctttagtattaatgca

SEQ ID NO: 191283 - DNA, 35 bp, Artificial Sequence
  Synthetic oligonucleotide
actccgccaatctgtccataattcaacatcatgca

SEQ ID NO: 191284 - DNA, 36 bp, Artificial Sequence
  Synthetic oligonucleotide
tctcccctcgctggtatctctccggtgggttcatca

SEQ ID NO: 191285 - DNA, 36 bp, Artificial Sequence
  Synthetic oligonucleotide
agttcacgcctggtccatcgcttcccgactccctca

SEQ ID NO: 191286 - DNA, 36 bp, Artificial Sequence
  Synthetic oligonucleotide
tgctcccgtcccgcagggctccaccgctgttcctca

SEQ ID NO: 191287 - DNA, 36 bp, Artificial Sequence
  Synthetic oligonucleotide
tgagtgcgctatctctcttttctttgccggttctca

SEQ ID NO: 191288 - DNA, 35 bp, Artificial Sequence
  Synthetic oligonucleotide
tgtgtaccatcgacccatccctgtgcagtcattca

SEQ ID NO: 191289 - DNA, 36 bp, Artificial Sequence
  Synthetic oligonucleotide
tagtccgttctccttccctgtgccgtctagttcaga

SEQ ID NO: 191290 - DNA, 37 bp, Artificial Sequence
  Synthetic oligonucleotide
tcccgccatcaggcgtattttccactaccattcgaga

SEQ ID NO: 191291 - DNA, 37 bp, Artificial Sequence
  Synthetic oligonucleotide
agagtgagtcggtggggtggaggcgggacgagggaga

SEQ ID NO: 191292 - DNA, 37 bp, Artificial Sequence
  Synthetic oligonucleotide
gtgatgggggcatggaggacgaggacgggcatgtaga

SEQ ID NO: 191293 - DNA, 37 bp, Artificial Sequence
  Synthetic oligonucleotide
gaccacccgccattatcagcctatgacagtaggacga

SEQ ID NO: 191294 - DNA, 35 bp, Artificial Sequence
  Synthetic oligonucleotide
gacaaagtgcagccgcttcccctcttgctttacga

SEQ ID NO: 191295 - DNA, 37 bp, Artificial Sequence
  Synthetic oligonucleotide
gaccccttccgtcgagctgctgtcacgctgcccccga

SEQ ID NO: 191296 - DNA, 35 bp, Artificial Sequence
  Synthetic oligonucleotide
gtacgccacgcccaggccctcgatggcacctccga

SEQ ID NO: 191297 - DNA, 37 bp, Artificial Sequence
  Synthetic oligonucleotide
gcccgccgccgtgtgttggtttttatctcccctccga

SEQ ID NO: 191298 - DNA, 37 bp, Artificial Sequence
  Synthetic oligonucleotide
tcccggacgccgcaacaaggcccactcgtacttccga

SEQ ID NO: 191299 - DNA, 37 bp, Artificial Sequence
  Synthetic oligonucleotide
gacggatggactggtgtaggatggggggctgtggcga

SEQ ID NO: 191300 - DNA, 35 bp, Artificial Sequence
  Synthetic oligonucleotide
gcaacgtaccgagagggggggaatggatggtgcga

SEQ ID NO: 191301 - DNA, 37 bp, Artificial Sequence
  Synthetic oligonucleotide
actgcccacaccatccggcccatgacgtcccttgcga

SEQ ID NO: 191302 - DNA, 37 bp, Artificial Sequence
  Synthetic oligonucleotide
gcaccctggtactagaggtcgtccgtccccacctcga

SEQ ID NO: 191303 - DNA, 37 bp, Artificial Sequence
  Synthetic oligonucleotide
tctcaggcactgttttgttacctcccacttttctcga

SEQ ID NO: 191304 - DNA, 36 bp, Artificial Sequence
  Synthetic oligonucleotide
ttccgcaccccccccggcatcgttgaatacgttcga

SEQ ID NO: 191305 - DNA, 38 bp, Artificial Sequence
  Synthetic oligonucleotide
tggtctgaggtcaggttcccgtaggtgaggggggagga

SEQ ID NO: 191306 - DNA, 37 bp, Artificial Sequence
  Synthetic oligonucleotide
gaggaacacgggagatcggaggggtaggacggtagga

SEQ ID NO: 191307 - DNA, 36 bp, Artificial Sequence
  Synthetic oligonucleotide
aacagccagggggtcacacagacggaggggagggga

SEQ ID NO: 191308 - DNA, 35 bp, Artificial Sequence
  Synthetic oligonucleotide
agaagccacgggaatggtaggttagtgggggggga

SEQ ID NO: 191309 - DNA, 37 bp, Artificial Sequence
  Synthetic oligonucleotide
atgggagaagggctggcatggaaactatggtggggga

SEQ ID NO: 191310 - DNA, 37 bp, Artificial Sequence
  Synthetic oligonucleotide
gcacgcgcggtgagacagagagggaggcaagtgggga

SEQ ID NO: 191311 - DNA, 36 bp, Artificial Sequence
  Synthetic oligonucleotide
tgtaaggccaggggggtggggcaaggtgtgtgggga

SEQ ID NO: 191312 - DNA, 35 bp, Artificial Sequence
  Synthetic oligonucleotide
gagagggacatggtggggtgtacggcggctatgga

SEQ ID NO: 191313 - DNA, 37 bp, Artificial Sequence
  Synthetic oligonucleotide
gaccgagctgttgcatccgacccaactccctcctgga

SEQ ID NO: 191314 - DNA, 37 bp, Artificial Sequence
  Synthetic oligonucleotide
ggggggagggaactggtaaaaagggggcaccgttgga

SEQ ID NO: 191315 - DNA, 37 bp, Artificial Sequence
  Synthetic oligonucleotide
gaacacgcaaggttgagcgggtaagggaggggttgga

SEQ ID NO: 191316 - DNA, 37 bp, Artificial Sequence
  Synthetic oligonucleotide
agatgcgagggggggataagggggtagaacatttgga

SEQ ID NO: 191317 - DNA, 37 bp, Artificial Sequence
  Synthetic oligonucleotide
actcgggcgggccgtagtgtgggcgggtgaaaaatga

SEQ ID NO: 191318 - DNA, 38 bp, Artificial Sequence
  Synthetic oligonucleotide
tcatgaagggagggggggaggagtggcagttcgaatga

SEQ ID NO: 191319 - DNA, 37 bp, Artificial Sequence
  Synthetic oligonucleotide
tcagagaacgaggtaaagggggcatggcgggtaatga

SEQ ID NO: 191320 - DNA, 38 bp, Artificial Sequence
  Synthetic oligonucleotide
ttgtctcctccacctgctttataggttgtcctctatga

SEQ ID NO: 191321 - DNA, 38 bp, Artificial Sequence
  Synthetic oligonucleotide
tgcacctctcagctctgctcactcaacctttacactga

SEQ ID NO: 191322 - DNA, 37 bp, Artificial Sequence
  Synthetic oligonucleotide
atccacgcacacccatctctcacagtcagcggactga

SEQ ID NO: 191323 - DNA, 37 bp, Artificial Sequence
  Synthetic oligonucleotide
gtctgacggccgatctttgcctctgtttctatcctga

SEQ ID NO: 191324 - DNA, 37 bp, Artificial Sequence
  Synthetic oligonucleotide
gtgggagggccaggggatcttgggggccggaacgtga

SEQ ID NO: 191325 - DNA, 38 bp, Artificial Sequence
  Synthetic oligonucleotide
tcacgcccatctacttctagtaccgtttccacccgtga

SEQ ID NO: 191326 - DNA, 38 bp, Artificial Sequence
  Synthetic oligonucleotide
aacgccccgacctcaattgctttttcatggacccgtga

SEQ ID NO: 191327 - DNA, 36 bp, Artificial Sequence
  Synthetic oligonucleotide
attgcccgagttcaacgctactactctcccccgtga

SEQ ID NO: 191328 - DNA, 37 bp, Artificial Sequence
  Synthetic oligonucleotide
ggggcggggagggggggcaggaccgggagtcgcgtga

SEQ ID NO: 191329 - DNA, 35 bp, Artificial Sequence
  Synthetic oligonucleotide
atgacacccagccatttgaatgttccacctcgtga

SEQ ID NO: 191330 - DNA, 36 bp, Artificial Sequence
  Synthetic oligonucleotide
gttgccacgcggcggtgggaagggacgggagggtga

SEQ ID NO: 191331 - DNA, 38 bp, Artificial Sequence
  Synthetic oligonucleotide
atcgccccgctccgttaccagcatcgctattcccttga

SEQ ID NO: 191332 - DNA, 38 bp, Artificial Sequence
  Synthetic oligonucleotide
acgctccatcggtttgccttccgaactccagtccttga

SEQ ID NO: 191333 - DNA, 38 bp, Artificial Sequence
  Synthetic oligonucleotide
tgctacctacagtatcccatccccacaaacgaagttga

SEQ ID NO: 191334 - DNA, 38 bp, Artificial Sequence
  Synthetic oligonucleotide
tgacgcccacgaaccgacccacaccctctcacggttga

SEQ ID NO: 191335 - DNA, 38 bp, Artificial Sequence
  Synthetic oligonucleotide
acacgcgcacgggtgggaaacggtgggatagtggttga

SEQ ID NO: 191336 - DNA, 37 bp, Artificial Sequence
  Synthetic oligonucleotide
acgttgtcgtactgcccgctcctcgttcctttgttga

SEQ ID NO: 191337 - DNA, 37 bp, Artificial Sequence
  Synthetic oligonucleotide
tacgacgggctggagggagggcacggatataatttga

SEQ ID NO: 191338 - DNA, 36 bp, Artificial Sequence
  Synthetic oligonucleotide
gatgggggtgggggtgcggagagcttggctaaaata

SEQ ID NO: 191339 - DNA, 34 bp, Artificial Sequence
  Synthetic oligonucleotide
gttgcccccaaactatgagccctgtcttcaaata

SEQ ID NO: 191340 - DNA, 36 bp, Artificial Sequence
  Synthetic oligonucleotide
accagctcgacttcaattggttagtctcttccccta

SEQ ID NO: 191341 - DNA, 36 bp, Artificial Sequence
  Synthetic oligonucleotide
tagggtggggagaggtggtggcggctggaggggcta

SEQ ID NO: 191342 - DNA, 36 bp, Artificial Sequence
  Synthetic oligonucleotide
ttgatgccgtcggtttcttcactgacccatgctcta

SEQ ID NO: 191343 - DNA, 36 bp, Artificial Sequence
  Synthetic oligonucleotide
acactggggagaagggtaagtcaatgaggacgcgta

SEQ ID NO: 191344 - DNA, 36 bp, Artificial Sequence
  Synthetic oligonucleotide
gtagcacgcaagagcgctttttcccctgttctcgta

SEQ ID NO: 191345 - DNA, 36 bp, Artificial Sequence
  Synthetic oligonucleotide
tctctcgccccgatactctactgtgccatcaatgta

SEQ ID NO: 191346 - DNA, 35 bp, Artificial Sequence
  Synthetic oligonucleotide
tcagataccgctgtgccctataccctcatactaac

SEQ ID NO: 191347 - DNA, 35 bp, Artificial Sequence
  Synthetic oligonucleotide
gcccgaaccgccacttttcgtagagattttaacac

SEQ ID NO: 191348 - DNA, 35 bp, Artificial Sequence
  Synthetic oligonucleotide
gtgccaattgcctgtatctcgtcctaagtcaccac

SEQ ID NO: 191349 - DNA, 35 bp, Artificial Sequence
  Synthetic oligonucleotide
gccgagtgctgccacttgtctcattgcccttccac

SEQ ID NO: 191350 - DNA, 35 bp, Artificial Sequence
  Synthetic oligonucleotide
gagatcatccaccgcccccatcgcctgctttccac

SEQ ID NO: 191351 - DNA, 35 bp, Artificial Sequence
  Synthetic oligonucleotide
gcgatcgcccttctccgccgcataaactgttggac

SEQ ID NO: 191352 - DNA, 35 bp, Artificial Sequence
  Synthetic oligonucleotide
actccctccttcccgtggtgttcactcatgtatac

SEQ ID NO: 191353 - DNA, 35 bp, Artificial Sequence
  Synthetic oligonucleotide
tcgacctttccgcttctgtcgactattgcacttac

SEQ ID NO: 191354 - DNA, 35 bp, Artificial Sequence
  Synthetic oligonucleotide
ttaaacagcgacttccaccgttgtctggcccttac

SEQ ID NO: 191355 - DNA, 35 bp, Artificial Sequence
  Synthetic oligonucleotide
gtcccgcattccgatcgttcgttacggccctcacc

SEQ ID NO: 191356 - DNA, 35 bp, Artificial Sequence
  Synthetic oligonucleotide
tagcccacctctcccacccctgatatctagggacc

SEQ ID NO: 191357 - DNA, 34 bp, Artificial Sequence
  Synthetic oligonucleotide
actaccctcgagccgactgtgacacgcgcttacc

SEQ ID NO: 191358 - DNA, 35 bp, Artificial Sequence
  Synthetic oligonucleotide
tacgactgcattgatgtttttcgcccctttttacc

SEQ ID NO: 191359 - DNA, 35 bp, Artificial Sequence
  Synthetic oligonucleotide
tgcccccctgtatactgcccagtcctgcccacccc

SEQ ID NO: 191360 - DNA, 35 bp, Artificial Sequence
  Synthetic oligonucleotide
gactacgcccattagtttgcccgcaatgccgcccc

SEQ ID NO: 191361 - DNA, 35 bp, Artificial Sequence
  Synthetic oligonucleotide
tcccagctgtatgtgtgttcctcctacggctcccc

SEQ ID NO: 191362 - DNA, 35 bp, Artificial Sequence
  Synthetic oligonucleotide
gtagtgtacccggcccccagcctgacgtcgtcccc

SEQ ID NO: 191363 - DNA, 35 bp, Artificial Sequence
  Synthetic oligonucleotide
gcccagcacatttacgtacttcttatgccaagccc

SEQ ID NO: 191364 - DNA, 35 bp, Artificial Sequence
  Synthetic oligonucleotide
tttacggccccatcacctgtcttctaacgccgccc

SEQ ID NO: 191365 - DNA, 35 bp, Artificial Sequence
  Synthetic oligonucleotide
gcacctccagcagatctcacaaatacggtccgccc

SEQ ID NO: 191366 - DNA, 35 bp, Artificial Sequence
  Synthetic oligonucleotide
gtgtaccaaccctcaattcgtgcccgccattgccc

SEQ ID NO: 191367 - DNA, 35 bp, Artificial Sequence
  Synthetic oligonucleotide
tcacacgtgtctgtccctgtcgtccttcgttgccc

SEQ ID NO: 191368 - DNA, 35 bp, Artificial Sequence
  Synthetic oligonucleotide
tcatggccgtagactttgtactcgtccccattccc

SEQ ID NO: 191369 - DNA, 35 bp, Artificial Sequence
  Synthetic oligonucleotide
tcctctccagatgctactaacctcctcaatcagcc

SEQ ID NO: 191370 - DNA, 35 bp, Artificial Sequence
  Synthetic oligonucleotide
tgtcaacgtttacgcaatcctcagtccctcccgcc

SEQ ID NO: 191371 - DNA, 35 bp, Artificial Sequence
  Synthetic oligonucleotide
tgatggctgcaccgtttgcgtctacctttcgcgcc

SEQ ID NO: 191372 - DNA, 35 bp, Artificial Sequence
  Synthetic oligonucleotide
acgtgggtgtctccctgttgccacggtctttcgcc

SEQ ID NO: 191373 - DNA, 35 bp, Artificial Sequence
  Synthetic oligonucleotide
aacatgccgacaccgcttcgcacgatacccttgcc

SEQ ID NO: 191374 - DNA, 35 bp, Artificial Sequence
  Synthetic oligonucleotide
atcatacggtcccagagcctcccccgcaagttgcc

SEQ ID NO: 191375 - DNA, 35 bp, Artificial Sequence
  Synthetic oligonucleotide
acccacgcaaactttacccatgggcctggccatcc

SEQ ID NO: 191376 - DNA, 35 bp, Artificial Sequence
  Synthetic oligonucleotide
gaaacctcccgtggcgtatctactgtgatccatcc

SEQ ID NO: 191377 - DNA, 35 bp, Artificial Sequence
  Synthetic oligonucleotide
actgccccgtacgctctgcatacgtatctcgatcc

SEQ ID NO: 191378 - DNA, 35 bp, Artificial Sequence
  Synthetic oligonucleotide
tcacctgttgccggattgcgcaccacgacccctcc

SEQ ID NO: 191379 - DNA, 35 bp, Artificial Sequence
  Synthetic oligonucleotide
aaatgccctggccgtatcacgactgatcctcctcc

SEQ ID NO: 191380 - DNA, 35 bp, Artificial Sequence
  Synthetic oligonucleotide
ttcactaccctgtaatataacagtctcggtcttcc

SEQ ID NO: 191381 - DNA, 35 bp, Artificial Sequence
  Synthetic oligonucleotide
atgcatccctcgcgccatcccatcctgtgagttcc

SEQ ID NO: 191382 - DNA, 35 bp, Artificial Sequence
  Synthetic oligonucleotide
tccccatcatcacctaagcccgacgaggttgccgc

SEQ ID NO: 191383 - DNA, 35 bp, Artificial Sequence
  Synthetic oligonucleotide
tccatttcagccgcccgccccgtctttgacccggc

SEQ ID NO: 191384 - DNA, 35 bp, Artificial Sequence
  Synthetic oligonucleotide
tgcccccgagtttgtgcccagcatccggttccatc

SEQ ID NO: 191385 - DNA, 35 bp, Artificial Sequence
  Synthetic oligonucleotide
ggagcacgacccttcgctacctcgccgttgaactc

SEQ ID NO: 191386 - DNA, 35 bp, Artificial Sequence
  Synthetic oligonucleotide
gcacgttgactagtaccaccctcgaaacatcgctc

SEQ ID NO: 191387 - DNA, 35 bp, Artificial Sequence
  Synthetic oligonucleotide
gtctacggatgtttgtttctcccctgttcgatgtc

SEQ ID NO: 191388 - DNA, 35 bp, Artificial Sequence
  Synthetic oligonucleotide
tacgctacccggcccgtacggtctctcccattgtc

SEQ ID NO: 191389 - DNA, 35 bp, Artificial Sequence
  Synthetic oligonucleotide
ttactgccactacatcgagtcgaacggttatcttc

SEQ ID NO: 191390 - DNA, 35 bp, Artificial Sequence
  Synthetic oligonucleotide
atcgctcgggcttccgagtgtcacgttccttcttc

SEQ ID NO: 191391 - DNA, 35 bp, Artificial Sequence
  Synthetic oligonucleotide
aaccccgagcagcttattcgtcccattgtttcttc

SEQ ID NO: 191392 - DNA, 35 bp, Artificial Sequence
  Synthetic oligonucleotide
gggacgtctcgccagctcggtcacgccactcgttc

SEQ ID NO: 191393 - DNA, 35 bp, Artificial Sequence
  Synthetic oligonucleotide
atcctgtccccgccaatccatcacagctgttgttc

SEQ ID NO: 191394 - DNA, 35 bp, Artificial Sequence
  Synthetic oligonucleotide
taccctcatcattgcgactgcaacgaccgtttttc

SEQ ID NO: 191395 - DNA, 35 bp, Artificial Sequence
  Synthetic oligonucleotide
acagcggtgtggggatggggggtggcggtaaaaag

SEQ ID NO: 191396 - DNA, 35 bp, Artificial Sequence
  Synthetic oligonucleotide
ttgaacggggagggaggaagaggaacttgatgtag

SEQ ID NO: 191397 - DNA, 35 bp, Artificial Sequence
  Synthetic oligonucleotide
tatcggcctcaccttcaccagcgatcgcctccccg

SEQ ID NO: 191398 - DNA, 35 bp, Artificial Sequence
  Synthetic oligonucleotide
tcctgctttgacacccgccgtattgactccactcg

SEQ ID NO: 191399 - DNA, 35 bp, Artificial Sequence
  Synthetic oligonucleotide
gccatcctgcaagtgacctctacctacatacgtcg

SEQ ID NO: 191400 - DNA, 35 bp, Artificial Sequence
  Synthetic oligonucleotide
ttgacccctcccgctttggtggccctccgctacgg

SEQ ID NO: 191401 - DNA, 35 bp, Artificial Sequence
  Synthetic oligonucleotide
acgatagtggcgcgtctgtcatggtccctcctcgg

SEQ ID NO: 191402 - DNA, 36 bp, Artificial Sequence
  Synthetic oligonucleotide
gagaggagaaatcgggaagtggatgcaaagttaggg

SEQ ID NO: 191403 - DNA, 35 bp, Artificial Sequence
  Synthetic oligonucleotide
gcagagaggctggggttggggggagtgctctgggg

SEQ ID NO: 191404 - DNA, 35 bp, Artificial Sequence
  Synthetic oligonucleotide
tcaaccacactcattcccggtccccaatcccttgg

SEQ ID NO: 191405 - DNA, 35 bp, Artificial Sequence
  Synthetic oligonucleotide
tgcgcaggtcggcatctcatcgtacttcttcactg

SEQ ID NO: 191406 - DNA, 35 bp, Artificial Sequence
  Synthetic oligonucleotide
tgcacgaatggctacgtccgctgttacctctcctg

SEQ ID NO: 191407 - DNA, 35 bp, Artificial Sequence
  Synthetic oligonucleotide
agcgccccgcctatcttcccttacagttcccacat

SEQ ID NO: 191408 - DNA, 35 bp, Artificial Sequence
  Synthetic oligonucleotide
actcccccagcccgccccatcgttcatgacaatat

SEQ ID NO: 191409 - DNA, 35 bp, Artificial Sequence
  Synthetic oligonucleotide
gttccccagcgttagacgattacgcttccgcccct

SEQ ID NO: 191410 - DNA, 35 bp, Artificial Sequence
  Synthetic oligonucleotide
gaagacacccgcctttagattttgtgcttatccct

SEQ ID NO: 191411 - DNA, 35 bp, Artificial Sequence
  Synthetic oligonucleotide
tactctcggtgtgtacccgctgtattgttctccct

SEQ ID NO: 191412 - DNA, 35 bp, Artificial Sequence
  Synthetic oligonucleotide
gatacatccgatagccttccggccctgccgtgcct

SEQ ID NO: 191413 - DNA, 35 bp, Artificial Sequence
  Synthetic oligonucleotide
gcgcaagtctacaccagtttatgactcgccctcct

SEQ ID NO: 191414 - DNA, 35 bp, Artificial Sequence
  Synthetic oligonucleotide
tgcgacagcatatccgtcgcgttttctcctctgct

SEQ ID NO: 191415 - DNA, 35 bp, Artificial Sequence
  Synthetic oligonucleotide
tgccgtcgtccacgtctacgccctatcgccaatct

SEQ ID NO: 191416 - DNA, 35 bp, Artificial Sequence
  Synthetic oligonucleotide
gcctgccacactgccgttaaaagccttccggatct

SEQ ID NO: 191417 - DNA, 35 bp, Artificial Sequence
  Synthetic oligonucleotide
gtcgccgtaaggtaaaatgacccccgtatccctct

SEQ ID NO: 191418 - DNA, 36 bp, Artificial Sequence
  Synthetic oligonucleotide
tgtgagcgcaatgggaagttgccctccttagcctct

SEQ ID NO: 191419 - DNA, 35 bp, Artificial Sequence
  Synthetic oligonucleotide
tatccgtcccggtatcgtttctgccatactgctct

SEQ ID NO: 191420 - DNA, 35 bp, Artificial Sequence
  Synthetic oligonucleotide
tatccacaacagtagttgcttgtcgccacctttct

SEQ ID NO: 191421 - DNA, 35 bp, Artificial Sequence
  Synthetic oligonucleotide
gagtcgggggaggcaaaattagagcaggtagacgt

SEQ ID NO: 191422 - DNA, 35 bp, Artificial Sequence
  Synthetic oligonucleotide
gcgatggcccgccctctcgatttatatcttctcgt

SEQ ID NO: 191423 - DNA, 35 bp, Artificial Sequence
  Synthetic oligonucleotide
tctcgacaacccagcaccttggctttttgcacctt

SEQ ID NO: 191424 - DNA, 35 bp, Artificial Sequence
  Synthetic oligonucleotide
tatcgctcctcagttcaccgcttcctattagcctt

SEQ ID NO: 191425 - DNA, 35 bp, Artificial Sequence
  Synthetic oligonucleotide
tccgcgtgactccacatatgccattgcgacctctt

SEQ ID NO: 191426 - DNA, 35 bp, Artificial Sequence
  Synthetic oligonucleotide
actcccccgtagttggtgtatcccaactcattgtt

SEQ ID NO: 191427 - DNA, 35 bp, Artificial Sequence
  Synthetic oligonucleotide
tagcccctctcagtcccatccaccctattccgttt

SEQ ID NO: 191428 - DNA, 35 bp, Artificial Sequence
  Synthetic oligonucleotide
taatccgcgcagcttgaactcttcctccttcgttt

SEQ ID NO: 191429 - DNA, 36 bp, Artificial Sequence
  Synthetic oligonucleotide
agccacccacctctgccccgacagttatgagcccaa

SEQ ID NO: 191430 - DNA, 36 bp, Artificial Sequence
  Synthetic oligonucleotide
agcgtgcagtacgacgaaggaggaatgggggtgcaa

SEQ ID NO: 191431 - DNA, 36 bp, Artificial Sequence
  Synthetic oligonucleotide
gccgcccttacctgtgcagatcctcacgtctctcaa

SEQ ID NO: 191432 - DNA, 36 bp, Artificial Sequence
  Synthetic oligonucleotide
gccaagagagaatgaagggggtgcgacggggcagaa

SEQ ID NO: 191433 - DNA, 36 bp, Artificial Sequence
  Synthetic oligonucleotide
agtgagggtaacggggaggaggagggcttttgcgaa

SEQ ID NO: 191434 - DNA, 36 bp, Artificial Sequence
  Synthetic oligonucleotide
tacgcccgctacacatgactcctcgcccgactataa

SEQ ID NO: 191435 - DNA, 35 bp, Artificial Sequence
  Synthetic oligonucleotide
tgaccccaccagtattgccctgcctgccgttctaa

SEQ ID NO: 191436 - DNA, 36 bp, Artificial Sequence
  Synthetic oligonucleotide
gcccaagggtgggaaagggaagggttcgttgtttaa

SEQ ID NO: 191437 - DNA, 36 bp, Artificial Sequence
  Synthetic oligonucleotide
tgaatgtgaactgtcgttgctcccgtgtccccccca

SEQ ID NO: 191438 - DNA, 36 bp, Artificial Sequence
  Synthetic oligonucleotide
acccgtacgcctcggcaaccgtacactggcccccca

SEQ ID NO: 191439 - DNA, 35 bp, Artificial Sequence
  Synthetic oligonucleotide
gcgcaacggattcgtaccatccagcgtgttcccca

SEQ ID NO: 191440 - DNA, 36 bp, Artificial Sequence
  Synthetic oligonucleotide
tacgagcatgcgttcaggcccccgtcacattgccca

SEQ ID NO: 191441 - DNA, 35 bp, Artificial Sequence
  Synthetic oligonucleotide
agatcctccgtgttgtctggccttttccatcgcca

SEQ ID NO: 191442 - DNA, 36 bp, Artificial Sequence
  Synthetic oligonucleotide
atgccgccccaatccgtcaaacaacctagccctcca

SEQ ID NO: 191443 - DNA, 35 bp, Artificial Sequence
  Synthetic oligonucleotide
tgaccctagccctgttttctctcgtccgcttcgca

SEQ ID NO: 191444 - DNA, 36 bp, Artificial Sequence
  Synthetic oligonucleotide
gcgttcccgtcacatccgcctttgatcatgcctgca

SEQ ID NO: 191445 - DNA, 35 bp, Artificial Sequence
  Synthetic oligonucleotide
tcacgctcgctcgctacgtacccatgcctggtgca

SEQ ID NO: 191446 - DNA, 36 bp, Artificial Sequence
  Synthetic oligonucleotide
tgcccgcatcctatactacctgtgcgaatcccatca

SEQ ID NO: 191447 - DNA, 36 bp, Artificial Sequence
  Synthetic oligonucleotide
tcccccgcattgatgtagcatctaccgtactcctca

SEQ ID NO: 191448 - DNA, 35 bp, Artificial Sequence
  Synthetic oligonucleotide
gcactctgtgcgttaaaatctactgctcctcctca

SEQ ID NO: 191449 - DNA, 36 bp, Artificial Sequence
  Synthetic oligonucleotide
gagaaggacaacggcaaaatcacagggggggagtca

SEQ ID NO: 191450 - DNA, 36 bp, Artificial Sequence
  Synthetic oligonucleotide
taatcgccacagtctataacctgcccgtttttttca

SEQ ID NO: 191451 - DNA, 36 bp, Artificial Sequence
  Synthetic oligonucleotide
tggataggaaaggaagtaggggaagcgggcacaaga

SEQ ID NO: 191452 - DNA, 37 bp, Artificial Sequence
  Synthetic oligonucleotide
acagcccctctggccgtcccttatcacccgtctcaga

SEQ ID NO: 191453 - DNA, 37 bp, Artificial Sequence
  Synthetic oligonucleotide
ttgtcatgcgaaggcgggcggagggtggggtgagaga

SEQ ID NO: 191454 - DNA, 37 bp, Artificial Sequence
  Synthetic oligonucleotide
gctgtgaccatgacgggggagggacgagacgatgaga

SEQ ID NO: 191455 - DNA, 37 bp, Artificial Sequence
  Synthetic oligonucleotide
ttggagagccagggggagggagggacgaaggaataga

SEQ ID NO: 191456 - DNA, 37 bp, Artificial Sequence
  Synthetic oligonucleotide
tgctcaaacgccgccatccatcgaaacctcttttaga

SEQ ID NO: 191457 - DNA, 37 bp, Artificial Sequence
  Synthetic oligonucleotide
gggaggggaaggatgggtgggagcttgtagtcgacga

SEQ ID NO: 191458 - DNA, 37 bp, Artificial Sequence
  Synthetic oligonucleotide
gccgaccgtcccctccgtgcttttatctgcttagcga

SEQ ID NO: 191459 - DNA, 37 bp, Artificial Sequence
  Synthetic oligonucleotide
aacacgtcgttctgcactttccacccagcgttatcga

SEQ ID NO: 191460 - DNA, 37 bp, Artificial Sequence
  Synthetic oligonucleotide
tccacgctctatttggtcccttgccatctctgctcga

SEQ ID NO: 191461 - DNA, 36 bp, Artificial Sequence
  Synthetic oligonucleotide
atgccatatcgcagctaatgtctcattccttctcga

SEQ ID NO: 191462 - DNA, 37 bp, Artificial Sequence
  Synthetic oligonucleotide
aactgtggaaagcgggggggaggtcgtaggcggagga

SEQ ID NO: 191463 - DNA, 37 bp, Artificial Sequence
  Synthetic oligonucleotide
gacgcggagacggggggtagttaggcttcggggagga

SEQ ID NO: 191464 - DNA, 36 bp, Artificial Sequence
  Synthetic oligonucleotide
tttgcctacccgcctcctctctcgagtcctcccgga

SEQ ID NO: 191465 - DNA, 37 bp, Artificial Sequence
  Synthetic oligonucleotide
accatcctcccttattgattatcactgtctcagcgga

SEQ ID NO: 191466 - DNA, 35 bp, Artificial Sequence
  Synthetic oligonucleotide
gtcctgtcctgactcttctctccgtttacatcgga

SEQ ID NO: 191467 - DNA, 37 bp, Artificial Sequence
  Synthetic oligonucleotide
tcagggtggaggagaaaattcaaagcggaacgaggga

SEQ ID NO: 191468 - DNA, 36 bp, Artificial Sequence
  Synthetic oligonucleotide
taggacgggagaagggattctggggctcgttaggga

SEQ ID NO: 191469 - DNA, 37 bp, Artificial Sequence
  Synthetic oligonucleotide
tagcaccattcgcattctccccattgatccttcggga

SEQ ID NO: 191470 - DNA, 37 bp, Artificial Sequence
  Synthetic oligonucleotide
taggaacgggaacaaaaaccagggagagacgggtgga

SEQ ID NO: 191471 - DNA, 37 bp, Artificial Sequence
  Synthetic oligonucleotide
aacaggccaaagggacggagtgcgtagggggggtgga

SEQ ID NO: 191472 - DNA, 37 bp, Artificial Sequence
  Synthetic oligonucleotide
ttagtcgcattgctcctcctgtctcgcccttcttgga

SEQ ID NO: 191473 - DNA, 36 bp, Artificial Sequence
  Synthetic oligonucleotide
gcagagggaaagacaggggagttgcgggcgagatga

SEQ ID NO: 191474 - DNA, 36 bp, Artificial Sequence
  Synthetic oligonucleotide
gtgggcgtcgtaatattctgctccttccctgcctga

SEQ ID NO: 191475 - DNA, 38 bp, Artificial Sequence
  Synthetic oligonucleotide
agtagccgacggaggaaggtggagtgaaggaaggctga

SEQ ID NO: 191476 - DNA, 37 bp, Artificial Sequence
  Synthetic oligonucleotide
atcgagtcagtggatgtagccgggcggaggggagtga

SEQ ID NO: 191477 - DNA, 37 bp, Artificial Sequence
  Synthetic oligonucleotide
tgagccgccgtcaccccgtttccgcccttcatagtga

SEQ ID NO: 191478 - DNA, 38 bp, Artificial Sequence
  Synthetic oligonucleotide
agggggagtggcaaaggtgaatggggggcgtatcgtga

SEQ ID NO: 191479 - DNA, 38 bp, Artificial Sequence
  Synthetic oligonucleotide
ggatggctggagaggggagaaatgaagggcagacttga

SEQ ID NO: 191480 - DNA, 36 bp, Artificial Sequence
  Synthetic oligonucleotide
accgatgcaccgccagaccgccattctgcaccttga

SEQ ID NO: 191481 - DNA, 35 bp, Artificial Sequence
  Synthetic oligonucleotide
gaagccccacttagtagtcccgttgttccccttga

SEQ ID NO: 191482 - DNA, 37 bp, Artificial Sequence
  Synthetic oligonucleotide
aacctccgcacggtgctcacgcactgtccattcttga

SEQ ID NO: 191483 - DNA, 37 bp, Artificial Sequence
  Synthetic oligonucleotide
acaccctactgtctggttttttgccctcgtccgttga

SEQ ID NO: 191484 - DNA, 36 bp, Artificial Sequence
  Synthetic oligonucleotide
tacctcccgctgttctatcgcggctccattctttga

SEQ ID NO: 191485 - DNA, 36 bp, Artificial Sequence
  Synthetic oligonucleotide
gcccacagacccgcttactttgcccttacttcgcta

SEQ ID NO: 191486 - DNA, 35 bp, Artificial Sequence
  Synthetic oligonucleotide
tgggagtgcgagggggctcaatcgggcggggagta

SEQ ID NO: 191487 - DNA, 36 bp, Artificial Sequence
  Synthetic oligonucleotide
gacgggtgcagaagagagtgggtgacgggtggagta

SEQ ID NO: 191488 - DNA, 35 bp, Artificial Sequence
  Synthetic oligonucleotide
gttgggaggggggggctggtgtatcccgaagggta

SEQ ID NO: 191489 - DNA, 36 bp, Artificial Sequence
  Synthetic oligonucleotide
tccttccacgtaacaacgcctctcgccaccatggta

SEQ ID NO: 191490 - DNA, 36 bp, Artificial Sequence
  Synthetic oligonucleotide
tgcctgagccccgcccttgcaatcctcgtactggta

SEQ ID NO: 191491 - DNA, 36 bp, Artificial Sequence
  Synthetic oligonucleotide
gcgtaatcgcccctgtttaccaaccttgcctttgta

SEQ ID NO: 191492 - DNA, 36 bp, Artificial Sequence
  Synthetic oligonucleotide
gcctccctagttctccatccgcgtcccacacgctta

SEQ ID NO: 191493 - DNA, 35 bp, Artificial Sequence
  Synthetic oligonucleotide
tctgtccactgcattggtcccgaacgtctcccaac

SEQ ID NO: 191494 - DNA, 35 bp, Artificial Sequence
  Synthetic oligonucleotide
gtagcaacgtcctccccccacacgatcacctacac

SEQ ID NO: 191495 - DNA, 35 bp, Artificial Sequence
  Synthetic oligonucleotide
tcacaaggcgcgcatccggtaccatcgcaaaccac

SEQ ID NO: 191496 - DNA, 35 bp, Artificial Sequence
  Synthetic oligonucleotide
gtttccgccttcgacattacaagttcgtgctccac

SEQ ID NO: 191497 - DNA, 34 bp, Artificial Sequence
  Synthetic oligonucleotide
atcctggctcccttcgaattagcacggcttccac

SEQ ID NO: 191498 - DNA, 35 bp, Artificial Sequence
  Synthetic oligonucleotide
accagtacgctgggtagggtagggaaccagggcac

SEQ ID NO: 191499 - DNA, 35 bp, Artificial Sequence
  Synthetic oligonucleotide
gtcccccccgctggagtaccgctcattgtgctcac

SEQ ID NO: 191500 - DNA, 35 bp, Artificial Sequence
  Synthetic oligonucleotide
tgtgcgctcgaaggatcggccgctcgctttctcac

SEQ ID NO: 191501 - DNA, 35 bp, Artificial Sequence
  Synthetic oligonucleotide
tggtggcctcgcctgtcatactatcccctgttcac

SEQ ID NO: 191502 - DNA, 34 bp, Artificial Sequence
  Synthetic oligonucleotide
acttgcgaacgcaaatctggattcacacatcgac

SEQ ID NO: 191503 - DNA, 34 bp, Artificial Sequence
  Synthetic oligonucleotide
tagaccgttgcgcaaagtgcacttttcctcctac

SEQ ID NO: 191504 - DNA, 34 bp, Artificial Sequence
  Synthetic oligonucleotide
ttgccatacccgtcactctgtttctccactctac

SEQ ID NO: 191505 - DNA, 35 bp, Artificial Sequence
  Synthetic oligonucleotide
tgtgtgtgccgccccgttcgcgctcttgctggtac

SEQ ID NO: 191506 - DNA, 35 bp, Artificial Sequence
  Synthetic oligonucleotide
tcctcgcccaattttgactgcgtcctccactaacc

SEQ ID NO: 191507 - DNA, 35 bp, Artificial Sequence
  Synthetic oligonucleotide
ttcgccatccagccctcgtttctctaatacacacc

SEQ ID NO: 191508 - DNA, 35 bp, Artificial Sequence
  Synthetic oligonucleotide
ttcgaacacccccacaggtgagccaggcttgcacc

SEQ ID NO: 191509 - DNA, 35 bp, Artificial Sequence
  Synthetic oligonucleotide
gagccaacctctcctcttgcttttcgctgttcacc

SEQ ID NO: 191510 - DNA, 35 bp, Artificial Sequence
  Synthetic oligonucleotide
tcatgctctcatgtttctcgctccccccgtaaccc

SEQ ID NO: 191511 - DNA, 35 bp, Artificial Sequence
  Synthetic oligonucleotide
tcaagatggtgtactttgccgcgccgctgttaccc

SEQ ID NO: 191512 - DNA, 35 bp, Artificial Sequence
  Synthetic oligonucleotide
gcctcctgctcctctgtccttgctcaaacgacccc

SEQ ID NO: 191513 - DNA, 35 bp, Artificial Sequence
  Synthetic oligonucleotide
tcagcgcccccttattgtgcatttccggttccccc

SEQ ID NO: 191514 - DNA, 35 bp, Artificial Sequence
  Synthetic oligonucleotide
tgtccctgtggcaagtctggcattgttctcgcccc

SEQ ID NO: 191515 - DNA, 35 bp, Artificial Sequence
  Synthetic oligonucleotide
tgcattcactggacataacctagcgcctgggcccc

SEQ ID NO: 191516 - DNA, 35 bp, Artificial Sequence
  Synthetic oligonucleotide
taactccgttgcctgcgaatcactggtgcctcccc

SEQ ID NO: 191517 - DNA, 35 bp, Artificial Sequence
  Synthetic oligonucleotide
ggaccgatgtgcgtcttcttgcactctttttcccc

SEQ ID NO: 191518 - DNA, 35 bp, Artificial Sequence
  Synthetic oligonucleotide
gacggagtcgagaaaatgcctgtcgtcacccgccc

SEQ ID NO: 191519 - DNA, 35 bp, Artificial Sequence
  Synthetic oligonucleotide
tactcatcgcacccatgttggttcgcacccttccc

SEQ ID NO: 191520 - DNA, 35 bp, Artificial Sequence
  Synthetic oligonucleotide
tatgaccccagacctccctatttgccgacactgcc

SEQ ID NO: 191521 - DNA, 35 bp, Artificial Sequence
  Synthetic oligonucleotide
tacagcctccagcacgtttgtactccgttggttcc

SEQ ID NO: 191522 - DNA, 35 bp, Artificial Sequence
  Synthetic oligonucleotide
taccatcaacaatttgccgcttgcacgttccgcgc

SEQ ID NO: 191523 - DNA, 35 bp, Artificial Sequence
  Synthetic oligonucleotide
atgccctcgcctatatgtcatcttggtctcttcgc

SEQ ID NO: 191524 - DNA, 35 bp, Artificial Sequence
  Synthetic oligonucleotide
gtgacgacaccgccccctgctctttcggttgtggc

SEQ ID NO: 191525 - DNA, 35 bp, Artificial Sequence
  Synthetic oligonucleotide
tacacgcaacgccctcgttcattcgctggacctgc

SEQ ID NO: 191526 - DNA, 35 bp, Artificial Sequence
  Synthetic oligonucleotide
tgttcgtacacattcacccgtcctatatggcctgc

SEQ ID NO: 191527 - DNA, 35 bp, Artificial Sequence
  Synthetic oligonucleotide
ccactcccgcccgcacatgccacaagctattaatc

SEQ ID NO: 191528 - DNA, 35 bp, Artificial Sequence
  Synthetic oligonucleotide
gtgtacagtcgcctaaacctgttttctcgcacatc

SEQ ID NO: 191529 - DNA, 35 bp, Artificial Sequence
  Synthetic oligonucleotide
gccgaccgaccgtcccgtgaacgccacaatgcatc

SEQ ID NO: 191530 - DNA, 35 bp, Artificial Sequence
  Synthetic oligonucleotide
gtcgcgatactttgttagcccgccgttccgacctc

SEQ ID NO: 191531 - DNA, 34 bp, Artificial Sequence
  Synthetic oligonucleotide
gcaaccgctcccaccacattgttgcgagcccctc

SEQ ID NO: 191532 - DNA, 35 bp, Artificial Sequence
  Synthetic oligonucleotide
acagagagcttctcatgcctttacccagctccctc

SEQ ID NO: 191533 - DNA, 35 bp, Artificial Sequence
  Synthetic oligonucleotide
tcgataccatcatgtcccaggaccttgtaatcctc

SEQ ID NO: 191534 - DNA, 35 bp, Artificial Sequence
  Synthetic oligonucleotide
tcgaacgtcgcaaggaagaacacgctcccttcctc

SEQ ID NO: 191535 - DNA, 34 bp, Artificial Sequence
  Synthetic oligonucleotide
gaagagccgcctcatcgatacccacacccgtctc

SEQ ID NO: 191536 - DNA, 35 bp, Artificial Sequence
  Synthetic oligonucleotide
atgcaagctcaacgctctgccaccttcgttgtctc

SEQ ID NO: 191537 - DNA, 35 bp, Artificial Sequence
  Synthetic oligonucleotide
tcgttgggcgggcggggttaagtccagggtaggtc

SEQ ID NO: 191538 - DNA, 35 bp, Artificial Sequence
  Synthetic oligonucleotide
gccgtttctgcgccccccggttgaccaactacttc

SEQ ID NO: 191539 - DNA, 35 bp, Artificial Sequence
  Synthetic oligonucleotide
cgcgcgtcctcattttatcctcgttccagctgttc

SEQ ID NO: 191540 - DNA, 35 bp, Artificial Sequence
  Synthetic oligonucleotide
agcccgtccgcctctcatgtccctgccgcttgttc

SEQ ID NO: 191541 - DNA, 35 bp, Artificial Sequence
  Synthetic oligonucleotide
atcagcacgcatctttaaatactgctcgccctttc

SEQ ID NO: 191542 - DNA, 34 bp, Artificial Sequence
  Synthetic oligonucleotide
gcgtacgcccactccatgttcacttattcacaag

SEQ ID NO: 191543 - DNA, 35 bp, Artificial Sequence
  Synthetic oligonucleotide
gctcccttcatccgctgattccgccgttttcctag

SEQ ID NO: 191544 - DNA, 35 bp, Artificial Sequence
  Synthetic oligonucleotide
gaccacgatcccgcctgtctttctgaacctcaacg

SEQ ID NO: 191545 - DNA, 35 bp, Artificial Sequence
  Synthetic oligonucleotide
gctccccccctggtctacatgctccgcctcttgcg

SEQ ID NO: 191546 - DNA, 35 bp, Artificial Sequence
  Synthetic oligonucleotide
agcatccgtagttccgcctatcatcctagttctcg

SEQ ID NO: 191547 - DNA, 35 bp, Artificial Sequence
  Synthetic oligonucleotide
agacggcgaaggaaatggagggcatggtaggaagg

SEQ ID NO: 191548 - DNA, 35 bp, Artificial Sequence
  Synthetic oligonucleotide
aatatgagccgttgatgggggggggcggagtaagg

SEQ ID NO: 191549 - DNA, 35 bp, Artificial Sequence
  Synthetic oligonucleotide
atgcgggacgagacggggggtttaatcggaggagg

SEQ ID NO: 191550 - DNA, 35 bp, Artificial Sequence
  Synthetic oligonucleotide
tttgggatcgggaggggaataacagtgaagggggg

SEQ ID NO: 191551 - DNA, 35 bp, Artificial Sequence
  Synthetic oligonucleotide
ttggagagtgtgtgggagggttctggcaccactgg

SEQ ID NO: 191552 - DNA, 36 bp, Artificial Sequence
  Synthetic oligonucleotide
ggacgaccggagtagtaggatagggaaggttgttgg

SEQ ID NO: 191553 - DNA, 35 bp, Artificial Sequence
  Synthetic oligonucleotide
gcctgcctcggtcacttcccttcgggtttccactg

SEQ ID NO: 191554 - DNA, 35 bp, Artificial Sequence
  Synthetic oligonucleotide
tccgatggcgtaagggagggtcgggagaggagctg

SEQ ID NO: 191555 - DNA, 35 bp, Artificial Sequence
  Synthetic oligonucleotide
acacctcatcccatttcttataggacttccccgtg

SEQ ID NO: 191556 - DNA, 35 bp, Artificial Sequence
  Synthetic oligonucleotide
tttgccaccatactctcgcctttcagctcgccgtg

SEQ ID NO: 191557 - DNA, 35 bp, Artificial Sequence
  Synthetic oligonucleotide
tgacaggaaggtggaggagcaggaggaaagttcat

SEQ ID NO: 191558 - DNA, 35 bp, Artificial Sequence
  Synthetic oligonucleotide
aaggatcacgggcggggggtgaacggataggagat

SEQ ID NO: 191559 - DNA, 35 bp, Artificial Sequence
  Synthetic oligonucleotide
gacattccccgcatgccctcttattcattgctgat

SEQ ID NO: 191560 - DNA, 35 bp, Artificial Sequence
  Synthetic oligonucleotide
tatcgtcacacagcgtggcatcgcaacctccacct

SEQ ID NO: 191561 - DNA, 35 bp, Artificial Sequence
  Synthetic oligonucleotide
actccacttctgctgtgcctcgacaccaggcacct

SEQ ID NO: 191562 - DNA, 35 bp, Artificial Sequence
  Synthetic oligonucleotide
tagcccctctagcagcctcatcactgacaccccct

SEQ ID NO: 191563 - DNA, 35 bp, Artificial Sequence
  Synthetic oligonucleotide
gagcaccgtacctctcagcgccgatacgaccccct

SEQ ID NO: 191564 - DNA, 35 bp, Artificial Sequence
  Synthetic oligonucleotide
gttgcccactattctatcgaatcaccttttggcct

SEQ ID NO: 191565 - DNA, 35 bp, Artificial Sequence
  Synthetic oligonucleotide
ttagccccattggtgcccctgtaacgaaactgcct

SEQ ID NO: 191566 - DNA, 35 bp, Artificial Sequence
  Synthetic oligonucleotide
agcccgagatgtatccaatcaactccctgccctct

SEQ ID NO: 191567 - DNA, 35 bp, Artificial Sequence
  Synthetic oligonucleotide
acgttgtccgcccgccatgggaatcggtctcctct

SEQ ID NO: 191568 - DNA, 35 bp, Artificial Sequence
  Synthetic oligonucleotide
tgtcatggacgccagcccatgctactcatctctct

SEQ ID NO: 191569 - DNA, 35 bp, Artificial Sequence
  Synthetic oligonucleotide
tcaccgcccagtgtcctttttgccagcctctctct

SEQ ID NO: 191570 - DNA, 35 bp, Artificial Sequence
  Synthetic oligonucleotide
acgtggttcgctttgaattagcgccttctctctct

SEQ ID NO: 191571 - DNA, 35 bp, Artificial Sequence
  Synthetic oligonucleotide
gacggtacgggtccattgtcttctcctctatgtct

SEQ ID NO: 191572 - DNA, 35 bp, Artificial Sequence
  Synthetic oligonucleotide
gtttgcgcactagcccctctaacgtaccacccggt

SEQ ID NO: 191573 - DNA, 36 bp, Artificial Sequence
  Synthetic oligonucleotide
gcctcctcctcagctcgcaaataccgatcacctggt

SEQ ID NO: 191574 - DNA, 35 bp, Artificial Sequence
  Synthetic oligonucleotide
tctgccgcccactaggtctataacaccatctcatt

SEQ ID NO: 191575 - DNA, 35 bp, Artificial Sequence
  Synthetic oligonucleotide
atatgccattgccccgctgatccgttcttttagtt

SEQ ID NO: 191576 - DNA, 35 bp, Artificial Sequence
  Synthetic oligonucleotide
gctaactccgctactcatcatgccgttccctcttt

SEQ ID NO: 191577 - DNA, 36 bp, Artificial Sequence
  Synthetic oligonucleotide
gcgattcgaggggatgggaaggaaaagggcgtacaa

SEQ ID NO: 191578 - DNA, 35 bp, Artificial Sequence
  Synthetic oligonucleotide
gtgcggtggaggggatggggcaagccgaaaagcaa

SEQ ID NO: 191579 - DNA, 36 bp, Artificial Sequence
  Synthetic oligonucleotide
gaccctcccatgctctttctcagttcgaccgggcaa

SEQ ID NO: 191580 - DNA, 36 bp, Artificial Sequence
  Synthetic oligonucleotide
gtcccaccccgcagtaatgaacaccgtccgtagtaa

SEQ ID NO: 191581 - DNA, 35 bp, Artificial Sequence
  Synthetic oligonucleotide
actgacgcagaaacataacgctcatgacccgccca

SEQ ID NO: 191582 - DNA, 35 bp, Artificial Sequence
  Synthetic oligonucleotide
gcatcacgccatcttttgcatcctgtcgcatccca

SEQ ID NO: 191583 - DNA, 35 bp, Artificial Sequence
  Synthetic oligonucleotide
atcccatgaattgttttgtacaccaggccttccca

SEQ ID NO: 191584 - DNA, 36 bp, Artificial Sequence
  Synthetic oligonucleotide
tgaagcccccgtgctccctttacctggtcttgtcca

SEQ ID NO: 191585 - DNA, 35 bp, Artificial Sequence
  Synthetic oligonucleotide
acccgacctttcatatgttccttctctgttgtcca

SEQ ID NO: 191586 - DNA, 36 bp, Artificial Sequence
  Synthetic oligonucleotide
gtcccctgacacctgaccacaccaccgccgattcca

SEQ ID NO: 191587 - DNA, 35 bp, Artificial Sequence
  Synthetic oligonucleotide
tcatgtacgtcactctctcaatgtaccaccacgca

SEQ ID NO: 191588 - DNA, 35 bp, Artificial Sequence
  Synthetic oligonucleotide
atgccccttggtagttttttgctctgcgcaccgca

SEQ ID NO: 191589 - DNA, 36 bp, Artificial Sequence
  Synthetic oligonucleotide
tcaccccttgattgagcagtttcctcgttcttcgca

SEQ ID NO: 191590 - DNA, 35 bp, Artificial Sequence
  Synthetic oligonucleotide
gtggttgggcaatcgggcggggcaggggacactca

SEQ ID NO: 191591 - DNA, 29 bp, Artificial Sequence
  Synthetic oligonucleotide
ttgcgccctcacactgtcgcccttactca

SEQ ID NO: 191592 - DNA, 36 bp, Artificial Sequence
  Synthetic oligonucleotide
gacaccctcgattagtttctaaatcaactgccctca

SEQ ID NO: 191593 - DNA, 35 bp, Artificial Sequence
  Synthetic oligonucleotide
gtcccttccccgctgcaacctcgtacttggtttca

SEQ ID NO: 191594 - DNA, 37 bp, Artificial Sequence
  Synthetic oligonucleotide
acgatgcctttgatgcgctcatcgttacctcttttca

SEQ ID NO: 191595 - DNA, 37 bp, Artificial Sequence
  Synthetic oligonucleotide
aacgaaagcgtgggcaagggccgggaacggaggaaga

SEQ ID NO: 191596 - DNA, 37 bp, Artificial Sequence
  Synthetic oligonucleotide
accacctgccatcttgtattctgcccattgacctaga

SEQ ID NO: 191597 - DNA, 37 bp, Artificial Sequence
  Synthetic oligonucleotide
accagcccacgaatcgatttcagctttccctcttaga

SEQ ID NO: 191598 - DNA, 37 bp, Artificial Sequence
  Synthetic oligonucleotide
tccaactgtaccgctgccctacaattacacactccga

SEQ ID NO: 191599 - DNA, 37 bp, Artificial Sequence
  Synthetic oligonucleotide
tcacctgtccaagggataagctccgtaccccctccga

SEQ ID NO: 191600 - DNA, 37 bp, Artificial Sequence
  Synthetic oligonucleotide
atcagtaagcagggaggggaggagaggtacagagcga

SEQ ID NO: 191601 - DNA, 37 bp, Artificial Sequence
  Synthetic oligonucleotide
gtgcgctgtgctgggaggtaatggatagggggggcga

SEQ ID NO: 191602 - DNA, 37 bp, Artificial Sequence
  Synthetic oligonucleotide
acaccacatctcgccgcctcacccttatagtgtgcga

SEQ ID NO: 191603 - DNA, 37 bp, Artificial Sequence
  Synthetic oligonucleotide
tctccaccaccttggttactgcccgtcgcttgtgcga

SEQ ID NO: 191604 - DNA, 37 bp, Artificial Sequence
  Synthetic oligonucleotide
tcgatatggagaggggggctaaggggaggaacatcga

SEQ ID NO: 191605 - DNA, 37 bp, Artificial Sequence
  Synthetic oligonucleotide
gagtttagtcgggtgggtaacgggaagggcctatcga

SEQ ID NO: 191606 - DNA, 37 bp, Artificial Sequence
  Synthetic oligonucleotide
tcagatgtagcggagggctatgaggggcttgtaagga

SEQ ID NO: 191607 - DNA, 36 bp, Artificial Sequence
  Synthetic oligonucleotide
acacaccaacttagctcacctccgtttggaaacgga

SEQ ID NO: 191608 - DNA, 37 bp, Artificial Sequence
  Synthetic oligonucleotide
gggggggtagggtggggattaacttcctttgaacgga

SEQ ID NO: 191609 - DNA, 36 bp, Artificial Sequence
  Synthetic oligonucleotide
aagggacgggaagggataggatgagcggacgccgga

SEQ ID NO: 191610 - DNA, 37 bp, Artificial Sequence
  Synthetic oligonucleotide
tttgtaagtcggggggtgaagaacaagggggagcgga

SEQ ID NO: 191611 - DNA, 37 bp, Artificial Sequence
  Synthetic oligonucleotide
ccgatgacaggacgggaagaagggaagatggggcgga

SEQ ID NO: 191612 - DNA, 38 bp, Artificial Sequence
  Synthetic oligonucleotide
gagatagacgggtgttcatggggagggggagtcgggga

SEQ ID NO: 191613 - DNA, 37 bp, Artificial Sequence
  Synthetic oligonucleotide
ggtcctgtccgctgccctcgtatccccgtccatggga

SEQ ID NO: 191614 - DNA, 37 bp, Artificial Sequence
  Synthetic oligonucleotide
tagtgggagataggaaaggaatgcggggctggtggga

SEQ ID NO: 191615 - DNA, 37 bp, Artificial Sequence
  Synthetic oligonucleotide
acctcccatcctcggtccagtacagtacgccactgga

SEQ ID NO: 191616 - DNA, 37 bp, Artificial Sequence
  Synthetic oligonucleotide
ttcggtccacgcacacttataacaacccccccctgga

SEQ ID NO: 191617 - DNA, 37 bp, Artificial Sequence
  Synthetic oligonucleotide
gacctcccttagtacccctttgaccactgcctttgga

SEQ ID NO: 191618 - DNA, 37 bp, Artificial Sequence
  Synthetic oligonucleotide
gagcctgggcgataattagtgggcgggagggaaatga

SEQ ID NO: 191619 - DNA, 38 bp, Artificial Sequence
  Synthetic oligonucleotide
agcagagcgggagagagggggggcaaggttatatatga

SEQ ID NO: 191620 - DNA, 37 bp, Artificial Sequence
  Synthetic oligonucleotide
ggttcggtacatgtttcgctcgcccactcctcactga

SEQ ID NO: 191621 - DNA, 38 bp, Artificial Sequence
  Synthetic oligonucleotide
gcaacacagtattgccctccccccgtggcctaccctga

SEQ ID NO: 191622 - DNA, 35 bp, Artificial Sequence
  Synthetic oligonucleotide
taacgcctggaccgtccctgagcctcaccccctga

SEQ ID NO: 191623 - DNA, 37 bp, Artificial Sequence
  Synthetic oligonucleotide
gcgctagcccctcccggtacctgtttgaccgccctga

SEQ ID NO: 191624 - DNA, 36 bp, Artificial Sequence
  Synthetic oligonucleotide
gtgccttgcatgtccagttctcttgccgttccctga

SEQ ID NO: 191625 - DNA, 38 bp, Artificial Sequence
  Synthetic oligonucleotide
atgttccatcccccttcagcgtgttaattttcctctga

SEQ ID NO: 191626 - DNA, 37 bp, Artificial Sequence
  Synthetic oligonucleotide
tggatcccccgcccacgttgcacgacctctttagtga

SEQ ID NO: 191627 - DNA, 38 bp, Artificial Sequence
  Synthetic oligonucleotide
gagcaacaacaaggcagtcaaagggaggacgaacgtga

SEQ ID NO: 191628 - DNA, 38 bp, Artificial Sequence
  Synthetic oligonucleotide
tctacgccacctatcgtgtattgtacccttctccgtga

SEQ ID NO: 191629 - DNA, 35 bp, Artificial Sequence
  Synthetic oligonucleotide
gacgaggaggggcaacgggtaggaggatcaggtga

SEQ ID NO: 191630 - DNA, 38 bp, Artificial Sequence
  Synthetic oligonucleotide
gacactgctaagaaagtgaggtggggaggcgggggtga

SEQ ID NO: 191631 - DNA, 38 bp, Artificial Sequence
  Synthetic oligonucleotide
accaaccatcacgaacctgcctcgttccatcactgtga

SEQ ID NO: 191632 - DNA, 38 bp, Artificial Sequence
  Synthetic oligonucleotide
atgtcccctccacctcgtgattccgatcaacacattga

SEQ ID NO: 191633 - DNA, 38 bp, Artificial Sequence
  Synthetic oligonucleotide
gaatccgccccattgagttccccgcttgaccaacttga

SEQ ID NO: 191634 - DNA, 38 bp, Artificial Sequence
  Synthetic oligonucleotide
tgcaccgtatgccgccgccgatatccgcaatgacttga

SEQ ID NO: 191635 - DNA, 38 bp, Artificial Sequence
  Synthetic oligonucleotide
gatgtggaccctcaactgctgaatcgacccttccttga

SEQ ID NO: 191636 - DNA, 37 bp, Artificial Sequence
  Synthetic oligonucleotide
ttcccaccgtagacctgacttacatccatcccgttga

SEQ ID NO: 191637 - DNA, 37 bp, Artificial Sequence
  Synthetic oligonucleotide
gagtaaggggtggggagcagttagagccagagtttga

SEQ ID NO: 191638 - DNA, 36 bp, Artificial Sequence
  Synthetic oligonucleotide
tgccctcgcctactttaggtactcctcgacctccta

SEQ ID NO: 191639 - DNA, 36 bp, Artificial Sequence
  Synthetic oligonucleotide
tacctgaccccgaagtctccacgagttaccctccta

SEQ ID NO: 191640 - DNA, 36 bp, Artificial Sequence
  Synthetic oligonucleotide
aatcgcaacatctatgctagctctttgtctcacgta

SEQ ID NO: 191641 - DNA, 36 bp, Artificial Sequence
  Synthetic oligonucleotide
atgcaagccgccggcgcccatccccttcaactggta

SEQ ID NO: 191642 - DNA, 35 bp, Artificial Sequence
  Synthetic oligonucleotide
gttaccccccaatcgtgtggtctacctaccctgta

SEQ ID NO: 191643 - DNA, 36 bp, Artificial Sequence
  Synthetic oligonucleotide
gacacctcgttgctgatttcccactttctgttatta

SEQ ID NO: 191644 - DNA, 35 bp, Artificial Sequence
  Synthetic oligonucleotide
acgacgccgttctgctatatagccaccgccttcac

SEQ ID NO: 191645 - DNA, 35 bp, Artificial Sequence
  Synthetic oligonucleotide
gaccactccacccatgtcgctgattagaaatcgac

SEQ ID NO: 191646 - DNA, 35 bp, Artificial Sequence
  Synthetic oligonucleotide
gtcggggagggaggtcattggcagtttagggggac

SEQ ID NO: 191647 - DNA, 35 bp, Artificial Sequence
  Synthetic oligonucleotide
gactatgcaggaggaggtgggctgcggtggtggac

SEQ ID NO: 191648 - DNA, 35 bp, Artificial Sequence
  Synthetic oligonucleotide
gctacgtggggtcgtccgtcgcagctaccctttac

SEQ ID NO: 191649 - DNA, 35 bp, Artificial Sequence
  Synthetic oligonucleotide
tcattcgccggtcccacactcctgtcgaggtttac

SEQ ID NO: 191650 - DNA, 35 bp, Artificial Sequence
  Synthetic oligonucleotide
gagtgcgccaacgccacttaactaggacccccacc

SEQ ID NO: 191651 - DNA, 35 bp, Artificial Sequence
  Synthetic oligonucleotide
atcgcggcattcaattggcgttacgtccctggccc

SEQ ID NO: 191652 - DNA, 35 bp, Artificial Sequence
  Synthetic oligonucleotide
gtgcacactgccctggtgctctcttcccagtgccc

SEQ ID NO: 191653 - DNA, 35 bp, Artificial Sequence
  Synthetic oligonucleotide
atgttcacgcatcgcctgtcttacgaactcgtccc

SEQ ID NO: 191654 - DNA, 35 bp, Artificial Sequence
  Synthetic oligonucleotide
tgctaaccagccctcgaccgactacgtttaccgcc

SEQ ID NO: 191655 - DNA, 35 bp, Artificial Sequence
  Synthetic oligonucleotide
tttgcattgcagacgcttcctttggtgggccttcc

SEQ ID NO: 191656 - DNA, 35 bp, Artificial Sequence
  Synthetic oligonucleotide
attggtgggcgccgaagtactttgcgttatcttcc

SEQ ID NO: 191657 - DNA, 35 bp, Artificial Sequence
  Synthetic oligonucleotide
gagaccgcacttggtactttccgccagttctttcc

SEQ ID NO: 191658 - DNA, 35 bp, Artificial Sequence
  Synthetic oligonucleotide
gatttggcggctgctgctttctcccccactaacgc

SEQ ID NO: 191659 - DNA, 35 bp, Artificial Sequence
  Synthetic oligonucleotide
gtagagcaaccaagccacccctctcggctatacgc

SEQ ID NO: 191660 - DNA, 35 bp, Artificial Sequence
  Synthetic oligonucleotide
tgcgtgtgcgacggcctccctgttctaccttacgc

SEQ ID NO: 191661 - DNA, 34 bp, Artificial Sequence
  Synthetic oligonucleotide
taaccccccgactctgagcgctctctactagcgc

SEQ ID NO: 191662 - DNA, 35 bp, Artificial Sequence
  Synthetic oligonucleotide
gtctccgcccctgcctcctaatgtaccacgatcgc

SEQ ID NO: 191663 - DNA, 35 bp, Artificial Sequence
  Synthetic oligonucleotide
tgaaatcgccgtccaagccctaacctgtcgttcgc

SEQ ID NO: 191664 - DNA, 35 bp, Artificial Sequence
  Synthetic oligonucleotide
tgcccctctccgttccacacccgctcaccgccggc

SEQ ID NO: 191665 - DNA, 35 bp, Artificial Sequence
  Synthetic oligonucleotide
gtcaagttcccaatgtacgccttacacacccctgc

SEQ ID NO: 191666 - DNA, 35 bp, Artificial Sequence
  Synthetic oligonucleotide
aagcttgtcaccagccagctcatcgtcctccctgc

SEQ ID NO: 191667 - DNA, 35 bp, Artificial Sequence
  Synthetic oligonucleotide
gaccgccccgcccgtcgttcacccgttactcttgc

SEQ ID NO: 191668 - DNA, 35 bp, Artificial Sequence
  Synthetic oligonucleotide
gccagatgccatgttttgcgcccttgtagatttgc

SEQ ID NO: 191669 - DNA, 35 bp, Artificial Sequence
  Synthetic oligonucleotide
tatggtcaggtctcacgcttgcctctgtcttaatc

SEQ ID NO: 191670 - DNA, 32 bp, Artificial Sequence
  Synthetic oligonucleotide
gcaccttcgcgcccgtattccactcttccctc

SEQ ID NO: 191671 - DNA, 35 bp, Artificial Sequence
  Synthetic oligonucleotide
gacaacccaccaggcactagcgttccctagtcctc

SEQ ID NO: 191672 - DNA, 35 bp, Artificial Sequence
  Synthetic oligonucleotide
tcgcacgagcaagatacgaaatggcccccctgctc

SEQ ID NO: 191673 - DNA, 36 bp, Artificial Sequence
  Synthetic oligonucleotide
gacaaagcctgtcacgtcgcgcccactcatcctgtc

SEQ ID NO: 191674 - DNA, 35 bp, Artificial Sequence
  Synthetic oligonucleotide
tccccgctccgccttctgtttgctctaaggctgtc

SEQ ID NO: 191675 - DNA, 35 bp, Artificial Sequence
  Synthetic oligonucleotide
tcccgatctgctcacctccctgggctaacgaattc

SEQ ID NO: 191676 - DNA, 35 bp, Artificial Sequence
  Synthetic oligonucleotide
ttcatggcaagggggggcgggtacacgaattcttc

SEQ ID NO: 191677 - DNA, 35 bp, Artificial Sequence
  Synthetic oligonucleotide
atgccgtactgtcaaacccaggtcgactccctttc

SEQ ID NO: 191678 - DNA, 36 bp, Artificial Sequence
  Synthetic oligonucleotide
atgggggggggagtgagacgggaaggggaagagaag

SEQ ID NO: 191679 - DNA, 36 bp, Artificial Sequence
  Synthetic oligonucleotide
ggttcgtcggaggggacgtagggaaggggacggaag

SEQ ID NO: 191680 - DNA, 35 bp, Artificial Sequence
  Synthetic oligonucleotide
gagaggggctgcacaaggagaacggaaagtctgag

SEQ ID NO: 191681 - DNA, 35 bp, Artificial Sequence
  Synthetic oligonucleotide
gccggtaccgcttaggttatctccgcccctcctag

SEQ ID NO: 191682 - DNA, 35 bp, Artificial Sequence
  Synthetic oligonucleotide
atacccagcctattcccttcgcccagccgcacacg

SEQ ID NO: 191683 - DNA, 35 bp, Artificial Sequence
  Synthetic oligonucleotide
ttcgtccatgcctcccgatctttacacccttaccg

SEQ ID NO: 191684 - DNA, 35 bp, Artificial Sequence
  Synthetic oligonucleotide
tctgactgcgtactgattactcctcactcgtcccg

SEQ ID NO: 191685 - DNA, 35 bp, Artificial Sequence
  Synthetic oligonucleotide
taccgacttgccttgttttgtgtatcctgtcgccg

SEQ ID NO: 191686 - DNA, 35 bp, Artificial Sequence
  Synthetic oligonucleotide
acgccgcctcggttcgtccatcttcaccccgcgcg

SEQ ID NO: 191687 - DNA, 35 bp, Artificial Sequence
  Synthetic oligonucleotide
gaggacgaaggcacagggatcaggggatggaggcg

SEQ ID NO: 191688 - DNA, 35 bp, Artificial Sequence
  Synthetic oligonucleotide
tgcgagtgggagggggaatggtggctccaagatcg

SEQ ID NO: 191689 - DNA, 35 bp, Artificial Sequence
  Synthetic oligonucleotide
ttgaccctgcaccacccgagaatatttgtttctcg

SEQ ID NO: 191690 - DNA, 35 bp, Artificial Sequence
  Synthetic oligonucleotide
gtagggaagggggggggtcgacgaggaatcgaagg

SEQ ID NO: 191691 - DNA, 35 bp, Artificial Sequence
  Synthetic oligonucleotide
gagttggggaatcatcgagagggagggcggatagg

SEQ ID NO: 191692 - DNA, 35 bp, Artificial Sequence
  Synthetic oligonucleotide
tttgaccgtctgtttgctacgccccccatcttcgg

SEQ ID NO: 191693 - DNA, 35 bp, Artificial Sequence
  Synthetic oligonucleotide
gcgaaccttcccttactcctcttgaccagctcggg

SEQ ID NO: 191694 - DNA, 35 bp, Artificial Sequence
  Synthetic oligonucleotide
ttgactccggcgtgttttctacccctcaatcttgg

SEQ ID NO: 191695 - DNA, 35 bp, Artificial Sequence
  Synthetic oligonucleotide
atcttctacgcccccccgtgcctccgacaactatg

SEQ ID NO: 191696 - DNA, 35 bp, Artificial Sequence
  Synthetic oligonucleotide
cgtccgccgccaaccaactatacacacccgccctg

SEQ ID NO: 191697 - DNA, 35 bp, Artificial Sequence
  Synthetic oligonucleotide
gtcgcggccaccgtcgttcctctccatccttcgtg

SEQ ID NO: 191698 - DNA, 35 bp, Artificial Sequence
  Synthetic oligonucleotide
tcagatgccacgcccattatcatcaccgcactgtg

SEQ ID NO: 191699 - DNA, 35 bp, Artificial Sequence
  Synthetic oligonucleotide
gcctccagccctcgtacatgtactcaccgttcttg

SEQ ID NO: 191700 - DNA, 35 bp, Artificial Sequence
  Synthetic oligonucleotide
tgacgatccaaccttttttgccccacgctttcttg

SEQ ID NO: 191701 - DNA, 35 bp, Artificial Sequence
  Synthetic oligonucleotide
aaggaaagggaggggaacaggactaaacaacgttg

SEQ ID NO: 191702 - DNA, 35 bp, Artificial Sequence
  Synthetic oligonucleotide
tgttggagggagggatcgatgggggatcgtggttg

SEQ ID NO: 191703 - DNA, 35 bp, Artificial Sequence
  Synthetic oligonucleotide
aacctcgcggccctgcacctcgaccacgctcccat

SEQ ID NO: 191704 - DNA, 35 bp, Artificial Sequence
  Synthetic oligonucleotide
gaagggtgagggagatgatattgtggcgggggcat

SEQ ID NO: 191705 - DNA, 35 bp, Artificial Sequence
  Synthetic oligonucleotide
gcggggtgggggtggagggagcggcttcaaaagat

SEQ ID NO: 191706 - DNA, 35 bp, Artificial Sequence
  Synthetic oligonucleotide
gatgacacgtgtactattgctatccgtcgccaact

SEQ ID NO: 191707 - DNA, 35 bp, Artificial Sequence
  Synthetic oligonucleotide
atagaccacccacatgtcataccactgctggcact

SEQ ID NO: 191708 - DNA, 35 bp, Artificial Sequence
  Synthetic oligonucleotide
ttcaacttggcgtgtgcccatccgtgccctttact

SEQ ID NO: 191709 - DNA, 35 bp, Artificial Sequence
  Synthetic oligonucleotide
tgtggcctcagcatcctcctttgcccatttcccct

SEQ ID NO: 191710 - DNA, 35 bp, Artificial Sequence
  Synthetic oligonucleotide
gtcgttcaagctcgctactacgcgctctctgccct

SEQ ID NO: 191711 - DNA, 35 bp, Artificial Sequence
  Synthetic oligonucleotide
tcaaccgcacacttacgccgttttcgatcctgcct

SEQ ID NO: 191712 - DNA, 35 bp, Artificial Sequence
  Synthetic oligonucleotide
gcaccgagctgggtccttatgctcccccattgcct

SEQ ID NO: 191713 - DNA, 35 bp, Artificial Sequence
  Synthetic oligonucleotide
tctgctccaggcgtttactgctcactcgaatctct

SEQ ID NO: 191714 - DNA, 35 bp, Artificial Sequence
  Synthetic oligonucleotide
tcatgcacccttgtcactggttctcacgattttct

SEQ ID NO: 191715 - DNA, 35 bp, Artificial Sequence
  Synthetic oligonucleotide
tctcacctcttgccgtcgacacaatcgcttctatt

SEQ ID NO: 191716 - DNA, 35 bp, Artificial Sequence
  Synthetic oligonucleotide
gtcatccccccgcatgcgtaacttcctcaggtatt

SEQ ID NO: 191717 - DNA, 35 bp, Artificial Sequence
  Synthetic oligonucleotide
tccccccagaccgcctcgaacaatccataagactt

SEQ ID NO: 191718 - DNA, 35 bp, Artificial Sequence
  Synthetic oligonucleotide
gacgcatcaacggcacgtgttttttccccctactt

SEQ ID NO: 191719 - DNA, 35 bp, Artificial Sequence
  Synthetic oligonucleotide
tgtgtccttgcttctatcgtcttaactactccctt

SEQ ID NO: 191720 - DNA, 35 bp, Artificial Sequence
  Synthetic oligonucleotide
accgagcaacgggcattcatttagctctgttcctt

SEQ ID NO: 191721 - DNA, 35 bp, Artificial Sequence
  Synthetic oligonucleotide
gaccaccccttaatgatatctagataactgttctt

SEQ ID NO: 191722 - DNA, 35 bp, Artificial Sequence
  Synthetic oligonucleotide
tgtcaaagggtcagctcagggtagggtgggaattt

SEQ ID NO: 191723 - DNA, 35 bp, Artificial Sequence
  Synthetic oligonucleotide
ttagccactgtcaactctctgatttcgcgcgcttt

SEQ ID NO: 191724 - DNA, 35 bp, Artificial Sequence
  Synthetic oligonucleotide
tcctcacactccagccccataaggtcccaggcgaa

SEQ ID NO: 191725 - DNA, 36 bp, Artificial Sequence
  Synthetic oligonucleotide
ttcctgccgggggggggtaaaatgctggggagggaa

SEQ ID NO: 191726 - DNA, 36 bp, Artificial Sequence
  Synthetic oligonucleotide
aacgccattccgcccgcattgacatctaacttaaca

SEQ ID NO: 191727 - DNA, 36 bp, Artificial Sequence
  Synthetic oligonucleotide
ttccatcccgtgctttaagtacgagccataccccca

SEQ ID NO: 191728 - DNA, 36 bp, Artificial Sequence
  Synthetic oligonucleotide
tctccactgcctcagctcgtgttccccccctgccca

SEQ ID NO: 191729 - DNA, 36 bp, Artificial Sequence
  Synthetic oligonucleotide
gccgcatcactctgtaatacctcctcgtgtatccca

SEQ ID NO: 191730 - DNA, 36 bp, Artificial Sequence
  Synthetic oligonucleotide
agcacgcccctgaccgctccttctctgtgattccca

SEQ ID NO: 191731 - DNA, 35 bp, Artificial Sequence
  Synthetic oligonucleotide
tcatcctgctttcatgattttacttcgccactcca

SEQ ID NO: 191732 - DNA, 34 bp, Artificial Sequence
  Synthetic oligonucleotide
gcccgccttccctatgtgtcgcactgaccctcca

SEQ ID NO: 191733 - DNA, 36 bp, Artificial Sequence
  Synthetic oligonucleotide
actgaccccacgaggtatctcattgtgcctcctcca

SEQ ID NO: 191734 - DNA, 36 bp, Artificial Sequence
  Synthetic oligonucleotide
gttccatctctggctggttatttcgctccctgagca

SEQ ID NO: 191735 - DNA, 36 bp, Artificial Sequence
  Synthetic oligonucleotide
agtcactgcagccgttgcaatttctccacccaggca

SEQ ID NO: 191736 - DNA, 36 bp, Artificial Sequence
  Synthetic oligonucleotide
gtaccctcaatcgcttcttcactacgccctagtgca

SEQ ID NO: 191737 - DNA, 35 bp, Artificial Sequence
  Synthetic oligonucleotide
tctgctacatccttcattgcgtacagccaacatca

SEQ ID NO: 191738 - DNA, 36 bp, Artificial Sequence
  Synthetic oligonucleotide
tgatagcccgtacatatatccccttgtctgtcctca

SEQ ID NO: 191739 - DNA, 36 bp, Artificial Sequence
  Synthetic oligonucleotide
aaacaccgccccccccgacagatttgtgattcctca

SEQ ID NO: 191740 - DNA, 36 bp, Artificial Sequence
  Synthetic oligonucleotide
tgtcctttccgccgaatctatcactgtgcgtgctca

SEQ ID NO: 191741 - DNA, 35 bp, Artificial Sequence
  Synthetic oligonucleotide
tgccagttgcacgaagcccctcagacgcctcttca

SEQ ID NO: 191742 - DNA, 35 bp, Artificial Sequence
  Synthetic oligonucleotide
ggttgcgtcatcgttccgtcgtcccctgctgttca

SEQ ID NO: 191743 - DNA, 37 bp, Artificial Sequence
  Synthetic oligonucleotide
gtctcgcatacgtcactctcttccgccactctacaga

SEQ ID NO: 191744 - DNA, 37 bp, Artificial Sequence
  Synthetic oligonucleotide
tcgaccgctgtatggggaaaagggtgaggggggcaga

SEQ ID NO: 191745 - DNA, 36 bp, Artificial Sequence
  Synthetic oligonucleotide
agaggtgaaggcaagtatgggggtcaagggatcaga

SEQ ID NO: 191746 - DNA, 37 bp, Artificial Sequence
  Synthetic oligonucleotide
aatacgggactgttgtaggggacgtgagggagggaga

SEQ ID NO: 191747 - DNA, 36 bp, Artificial Sequence
  Synthetic oligonucleotide
atggatgcggggcgagggtgagaacagatggtgaga

SEQ ID NO: 191748 - DNA, 37 bp, Artificial Sequence
  Synthetic oligonucleotide
gccacctactactgcatccagcccgctcgcttaacga

SEQ ID NO: 191749 - DNA, 35 bp, Artificial Sequence
  Synthetic oligonucleotide
tctcctccccatctgtgtcgcggaaatctccccga

SEQ ID NO: 191750 - DNA, 37 bp, Artificial Sequence
  Synthetic oligonucleotide
tgcaccccgcgtgtctatcctcctgctggtctcccga

SEQ ID NO: 191751 - DNA, 35 bp, Artificial Sequence
  Synthetic oligonucleotide
gccaccactacctggctatcccgatacaccgccga

SEQ ID NO: 191752 - DNA, 37 bp, Artificial Sequence
  Synthetic oligonucleotide
ggggtagctatcccttacgcatttgaacgccctccga

SEQ ID NO: 191753 - DNA, 37 bp, Artificial Sequence
  Synthetic oligonucleotide
aaaaagggcaagaaaggctaggcggggaagggggcga

SEQ ID NO: 191754 - DNA, 37 bp, Artificial Sequence
  Synthetic oligonucleotide
gaacgaacatagggaaggggacgcggtcgttggagga

SEQ ID NO: 191755 - DNA, 35 bp, Artificial Sequence
  Synthetic oligonucleotide
tatcgggcgggtgtggagggagcctaatttgcgga

SEQ ID NO: 191756 - DNA, 37 bp, Artificial Sequence
  Synthetic oligonucleotide
gaaactgcgggccaaggaaggatatgggggctaggga

SEQ ID NO: 191757 - DNA, 37 bp, Artificial Sequence
  Synthetic oligonucleotide
atgacccctgctcaccttttgtcctccgaagacggga

SEQ ID NO: 191758 - DNA, 37 bp, Artificial Sequence
  Synthetic oligonucleotide
gagtcgggcgggcttcatcttaggagacgggagggga

SEQ ID NO: 191759 - DNA, 37 bp, Artificial Sequence
  Synthetic oligonucleotide
tggggagtggcggtttccatcctagggaggtggggga

SEQ ID NO: 191760 - DNA, 36 bp, Artificial Sequence
  Synthetic oligonucleotide
gcgaggtaagattcagagagggggagcggagtggga

SEQ ID NO: 191761 - DNA, 37 bp, Artificial Sequence
  Synthetic oligonucleotide
tatgggcgtgtcacactcttatgaagggcgggtggga

SEQ ID NO: 191762 - DNA, 37 bp, Artificial Sequence
  Synthetic oligonucleotide
atgcctgctggaacgggtgcttaggtgggggggtgga

SEQ ID NO: 191763 - DNA, 38 bp, Artificial Sequence
  Synthetic oligonucleotide
atgccaacactctccatccgctcataagcccagaatga

SEQ ID NO: 191764 - DNA, 37 bp, Artificial Sequence
  Synthetic oligonucleotide
tccacctacgccctttccggttcttggactgccatga

SEQ ID NO: 191765 - DNA, 38 bp, Artificial Sequence
  Synthetic oligonucleotide
gtggaacacgtacaactgtgagaggggagggaatatga

SEQ ID NO: 191766 - DNA, 37 bp, Artificial Sequence
  Synthetic oligonucleotide
tgtagtctcccgtgcatgttccaccctcttactatga

SEQ ID NO: 191767 - DNA, 35 bp, Artificial Sequence
  Synthetic oligonucleotide
tagtcacgggggcgggatgggcgggtactgtatga

SEQ ID NO: 191768 - DNA, 38 bp, Artificial Sequence
  Synthetic oligonucleotide
atggtccaacctctcgtgccttagtttaaccgccctga

SEQ ID NO: 191769 - DNA, 38 bp, Artificial Sequence
  Synthetic oligonucleotide
tgcggtgcctcacactgttacacttcgcactccgctga

SEQ ID NO: 191770 - DNA, 36 bp, Artificial Sequence
  Synthetic oligonucleotide
atcaaccggtcaggtacgaactcctccccttgctga

SEQ ID NO: 191771 - DNA, 37 bp, Artificial Sequence
  Synthetic oligonucleotide
ttcggaacatgagggggaggaaaggagtcagatctga

SEQ ID NO: 191772 - DNA, 38 bp, Artificial Sequence
  Synthetic oligonucleotide
gcaagcgggacggggggaggcacggaaggggtatctga

SEQ ID NO: 191773 - DNA, 38 bp, Artificial Sequence
  Synthetic oligonucleotide
atgaccgctcacacatatccgggtccactctattctga

SEQ ID NO: 191774 - DNA, 38 bp, Artificial Sequence
  Synthetic oligonucleotide
tacgaggggggggctgggcgagcgggatagacaagtga

SEQ ID NO: 191775 - DNA, 37 bp, Artificial Sequence
  Synthetic oligonucleotide
gtcacggaccgggtaagcaaggggaagagtggagtga

SEQ ID NO: 191776 - DNA, 35 bp, Artificial Sequence
  Synthetic oligonucleotide
tttgcgttgggcgtccagggagggtgggctcgtga

SEQ ID NO: 191777 - DNA, 37 bp, Artificial Sequence
  Synthetic oligonucleotide
acgtacggctggtatcgctgctccacctctctcgtga

SEQ ID NO: 191778 - DNA, 38 bp, Artificial Sequence
  Synthetic oligonucleotide
tcacacgacgaggggggcaaagaaagggggaacggtga

SEQ ID NO: 191779 - DNA, 38 bp, Artificial Sequence
  Synthetic oligonucleotide
tcacgcctgtggttcgttacatcatcccttctccttga

SEQ ID NO: 191780 - DNA, 35 bp, Artificial Sequence
  Synthetic oligonucleotide
gttgccacctcctgtcccgattgctaaacgcttga

SEQ ID NO: 191781 - DNA, 36 bp, Artificial Sequence
  Synthetic oligonucleotide
gagtggcgcctccttgctcccgtcttttcctcttga

SEQ ID NO: 191782 - DNA, 38 bp, Artificial Sequence
  Synthetic oligonucleotide
tgctgagacagcgggctgaaacggaggggcggggttga

SEQ ID NO: 191783 - DNA, 37 bp, Artificial Sequence
  Synthetic oligonucleotide
gaagcgcacatacggacctacccccccagcctgttga

SEQ ID NO: 191784 - DNA, 35 bp, Artificial Sequence
  Synthetic oligonucleotide
atatgccactcctgcctgcatctaacgccttttga

SEQ ID NO: 191785 - DNA, 37 bp, Artificial Sequence
  Synthetic oligonucleotide
acgcgcccccagaacttatgctatcgcccctttttga

SEQ ID NO: 191786 - DNA, 35 bp, Artificial Sequence
  Synthetic oligonucleotide
tcacgctgttcacctggttacttcgcacccgcata

SEQ ID NO: 191787 - DNA, 36 bp, Artificial Sequence
  Synthetic oligonucleotide
tcactcttccgacgttgtttcttgttgcgctttata

SEQ ID NO: 191788 - DNA, 36 bp, Artificial Sequence
  Synthetic oligonucleotide
gatctcgacgacacctctcataagtctctgtcccta

SEQ ID NO: 191789 - DNA, 36 bp, Artificial Sequence
  Synthetic oligonucleotide
tcacggacctgctgtcttaccgaaccttgctctcta

SEQ ID NO: 191790 - DNA, 36 bp, Artificial Sequence
  Synthetic oligonucleotide
tgcatgcacgtccccctcccgtcctccagttgagta

SEQ ID NO: 191791 - DNA, 35 bp, Artificial Sequence
  Synthetic oligonucleotide
taaccagcccatagtcttatcgtcctgctctcgta

SEQ ID NO: 191792 - DNA, 36 bp, Artificial Sequence
  Synthetic oligonucleotide
ttgaaggccggtcagtggtagttggggcggggggta

SEQ ID NO: 191793 - DNA, 36 bp, Artificial Sequence
  Synthetic oligonucleotide
tctactgcccctggcgctcctggccctttctctgta

SEQ ID NO: 191794 - DNA, 35 bp, Artificial Sequence
  Synthetic oligonucleotide
tccaccctcatagccgctccctgataccccgtgta

SEQ ID NO: 191795 - DNA, 36 bp, Artificial Sequence
  Synthetic oligonucleotide
tccggaccgtgcgtgctcccgccctaacttgcctta

SEQ ID NO: 191796 - DNA, 36 bp, Artificial Sequence
  Synthetic oligonucleotide
actcctaccaccgccccgttttatgcatttggctta

SEQ ID NO: 191797 - DNA, 36 bp, Artificial Sequence
  Synthetic oligonucleotide
gagctgggaggggatcgatgtagcacgggtgggtta

SEQ ID NO: 191798 - DNA, 34 bp, Artificial Sequence
  Synthetic oligonucleotide
tagcactcaccgtccggccactctattcaaacac

SEQ ID NO: 191799 - DNA, 35 bp, Artificial Sequence
  Synthetic oligonucleotide
attcccgccctcagtcttggccggtttccttccac

SEQ ID NO: 191800 - DNA, 35 bp, Artificial Sequence
  Synthetic oligonucleotide
gcccattgcccgtcctgtcgccggccctgtttcac

SEQ ID NO: 191801 - DNA, 34 bp, Artificial Sequence
  Synthetic oligonucleotide
tccgtgcaattgtgttaccctacctgtttcaccc

SEQ ID NO: 191802 - DNA, 35 bp, Artificial Sequence
  Synthetic oligonucleotide
tgcatcctgaccccgctcccgaattgtgccgaccc

SEQ ID NO: 191803 - DNA, 35 bp, Artificial Sequence
  Synthetic oligonucleotide
gcccccactctgtagatgttctttagccattaccc

SEQ ID NO: 191804 - DNA, 35 bp, Artificial Sequence
  Synthetic oligonucleotide
atgtccgtaggtacgtcgcggctcccctttctccc

SEQ ID NO: 191805 - DNA, 35 bp, Artificial Sequence
  Synthetic oligonucleotide
accttcgccactgagccatatagtccattcgtccc

SEQ ID NO: 191806 - DNA, 34 bp, Artificial Sequence
  Synthetic oligonucleotide
tgagcacacacctttctgaagctatgccgttccc

SEQ ID NO: 191807 - DNA, 35 bp, Artificial Sequence
  Synthetic oligonucleotide
atggccaaccgtccttcctgccagcccctcacgcc

SEQ ID NO: 191808 - DNA, 35 bp, Artificial Sequence
  Synthetic oligonucleotide
gtggcgatcgcacctctgattatcgaccctttgcc

SEQ ID NO: 191809 - DNA, 35 bp, Artificial Sequence
  Synthetic oligonucleotide
gcatgatcgcccctgtttgcgcaacacctccatcc

SEQ ID NO: 191810 - DNA, 35 bp, Artificial Sequence
  Synthetic oligonucleotide
gcgcaccccacgtatgactgtatccccgtccctcc

SEQ ID NO: 191811 - DNA, 35 bp, Artificial Sequence
  Synthetic oligonucleotide
tgcgcgtggcacttgcgcgcacttcctactattcc

SEQ ID NO: 191812 - DNA, 35 bp, Artificial Sequence
  Synthetic oligonucleotide
ttaccccaaccgttacaagtggtaacacgccttcc

SEQ ID NO: 191813 - DNA, 34 bp, Artificial Sequence
  Synthetic oligonucleotide
gttgtgtccaaatttgcgtgactcacctccttcc

SEQ ID NO: 191814 - DNA, 35 bp, Artificial Sequence
  Synthetic oligonucleotide
gagacgtcaccagtttagccactgtcgtctcttcc

SEQ ID NO: 191815 - DNA, 35 bp, Artificial Sequence
  Synthetic oligonucleotide
gttgcaggccccacctagcagtcgcacttttttcc

SEQ ID NO: 191816 - DNA, 35 bp, Artificial Sequence
  Synthetic oligonucleotide
accacccctcgatcatgccccacttgtgctcccgc

SEQ ID NO: 191817 - DNA, 35 bp, Artificial Sequence
  Synthetic oligonucleotide
gcatcaccggtgtttcccgctcatctatttgtcgc

SEQ ID NO: 191818 - DNA, 35 bp, Artificial Sequence
  Synthetic oligonucleotide
aacttacacccgccttattgcttgcatacgattgc

SEQ ID NO: 191819 - DNA, 35 bp, Artificial Sequence
  Synthetic oligonucleotide
gcatctgacacctgctgatcaacccctttagtatc

SEQ ID NO: 191820 - DNA, 35 bp, Artificial Sequence
  Synthetic oligonucleotide
gacgctctacctcaataacggcgcttgctctactc

SEQ ID NO: 191821 - DNA, 35 bp, Artificial Sequence
  Synthetic oligonucleotide
ttgggccgcagcacctttcgtcatacaacaccctc

SEQ ID NO: 191822 - DNA, 35 bp, Artificial Sequence
  Synthetic oligonucleotide
taacgccagaccgctacttccttgcgccacgcctc

SEQ ID NO: 191823 - DNA, 35 bp, Artificial Sequence
  Synthetic oligonucleotide
ttaagcacctttcacactcgtactgctctgggctc

SEQ ID NO: 191824 - DNA, 35 bp, Artificial Sequence
  Synthetic oligonucleotide
gtgccacggctgtgtctcttatgcctctctcagtc

SEQ ID NO: 191825 - DNA, 35 bp, Artificial Sequence
  Synthetic oligonucleotide
gaccgtcccccgccatttcgagaaacgtccccgtc

SEQ ID NO: 191826 - DNA, 35 bp, Artificial Sequence
  Synthetic oligonucleotide
gtatccacccggctccacccgccgtgctctaattc

SEQ ID NO: 191827 - DNA, 35 bp, Artificial Sequence
  Synthetic oligonucleotide
tcaggaactcccatgcctcaagccctccagcattc

SEQ ID NO: 191828 - DNA, 35 bp, Artificial Sequence
  Synthetic oligonucleotide
gtggcactctccctgctgctaaccaactattattc

SEQ ID NO: 191829 - DNA, 35 bp, Artificial Sequence
  Synthetic oligonucleotide
tctcggtgacaccatccattagcacatcacttttc

SEQ ID NO: 191830 - DNA, 35 bp, Artificial Sequence
  Synthetic oligonucleotide
tgccacacccatttgtttccctaggatcttacacg

SEQ ID NO: 191831 - DNA, 35 bp, Artificial Sequence
  Synthetic oligonucleotide
gtgagatcccgcccgacctgactgtcatctactcg

SEQ ID NO: 191832 - DNA, 35 bp, Artificial Sequence
  Synthetic oligonucleotide
actctacggagcggtgtgggagggttcggggaggg

SEQ ID NO: 191833 - DNA, 35 bp, Artificial Sequence
  Synthetic oligonucleotide
ggactcatcactccgctccgttcccccccgtgggg

SEQ ID NO: 191834 - DNA, 35 bp, Artificial Sequence
  Synthetic oligonucleotide
gaggggggatggcattgggtataggataggtgggg

SEQ ID NO: 191835 - DNA, 35 bp, Artificial Sequence
  Synthetic oligonucleotide
atgtacagtgggaaagggtgaagctggggttgggg

SEQ ID NO: 191836 - DNA, 35 bp, Artificial Sequence
  Synthetic oligonucleotide
acgcacccttctttgctgaaaccgttaccgcatgg

SEQ ID NO: 191837 - DNA, 35 bp, Artificial Sequence
  Synthetic oligonucleotide
tcccagatgtgcgctgtgttgttatttgtccctgg

SEQ ID NO: 191838 - DNA, 35 bp, Artificial Sequence
  Synthetic oligonucleotide
ggtatcgccgaggttgctcaaccccacactccctg

SEQ ID NO: 191839 - DNA, 35 bp, Artificial Sequence
  Synthetic oligonucleotide
tcacctgtgctcattgtctttcatctctcctgctg

SEQ ID NO: 191840 - DNA, 35 bp, Artificial Sequence
  Synthetic oligonucleotide
tatgcgttgcacgtcgcccgtttccgtatgttctg

SEQ ID NO: 191841 - DNA, 35 bp, Artificial Sequence
  Synthetic oligonucleotide
tagcaccggccctctccctcccaccgtgcttcgtg

SEQ ID NO: 191842 - DNA, 35 bp, Artificial Sequence
  Synthetic oligonucleotide
actgcgtgaccacatgcgttcgttccccataattg

SEQ ID NO: 191843 - DNA, 35 bp, Artificial Sequence
  Synthetic oligonucleotide
tgaagacggcaatcttgcctcattttgttctccat

SEQ ID NO: 191844 - DNA, 35 bp, Artificial Sequence
  Synthetic oligonucleotide
tttgcaaagccccatcacccgtgccacattccact

SEQ ID NO: 191845 - DNA, 35 bp, Artificial Sequence
  Synthetic oligonucleotide
tattcagcctccctgccgttccaaaaagaccgcct

SEQ ID NO: 191846 - DNA, 35 bp, Artificial Sequence
  Synthetic oligonucleotide
ttgcccgcccacccttggccttcactaacgatcct

SEQ ID NO: 191847 - DNA, 35 bp, Artificial Sequence
  Synthetic oligonucleotide
gccgtggggcttgaatgtgtcactctccacctcct

SEQ ID NO: 191848 - DNA, 35 bp, Artificial Sequence
  Synthetic oligonucleotide
gtccctctccaccgttgagcctcctagtctttcct

SEQ ID NO: 191849 - DNA, 35 bp, Artificial Sequence
  Synthetic oligonucleotide
taacccgcctggttgaagtccccataatctccgct

SEQ ID NO: 191850 - DNA, 35 bp, Artificial Sequence
  Synthetic oligonucleotide
tgttccctgccatttccgttttcatatccggtgct

SEQ ID NO: 191851 - DNA, 35 bp, Artificial Sequence
  Synthetic oligonucleotide
tgtatacgcacgggtcgccctcttggtcctgctct

SEQ ID NO: 191852 - DNA, 35 bp, Artificial Sequence
  Synthetic oligonucleotide
gggaaccccggggtggtggagaagggcaagggatt

SEQ ID NO: 191853 - DNA, 35 bp, Artificial Sequence
  Synthetic oligonucleotide
tgacgtgtcagactgctcctcgtcgctccgccctt

SEQ ID NO: 191854 - DNA, 35 bp, Artificial Sequence
  Synthetic oligonucleotide
acattgcggagaccagtgtcggcctttcttccctt

SEQ ID NO: 191855 - DNA, 35 bp, Artificial Sequence
  Synthetic oligonucleotide
gaaccgtgaatggtgagggggaattagggagggtt

SEQ ID NO: 191856 - DNA, 35 bp, Artificial Sequence
  Synthetic oligonucleotide
ataccctgcgcccctgccggacgtcgatcctggtt

SEQ ID NO: 191857 - DNA, 35 bp, Artificial Sequence
  Synthetic oligonucleotide
ggaacagcgagaacagggcggatgggggcaataaa

SEQ ID NO: 191858 - DNA, 36 bp, Artificial Sequence
  Synthetic oligonucleotide
gggacgggagggaaggagttgcggtgggtaggccaa

SEQ ID NO: 191859 - DNA, 36 bp, Artificial Sequence
  Synthetic oligonucleotide
tgagccggacccggtcggcttaactcaccttttcaa

SEQ ID NO: 191860 - DNA, 36 bp, Artificial Sequence
  Synthetic oligonucleotide
tgggacgagtgaagggtgggcaggcgcgagggaaca

SEQ ID NO: 191861 - DNA, 36 bp, Artificial Sequence
  Synthetic oligonucleotide
accacccactggacatgaatacccggacttttcaca

SEQ ID NO: 191862 - DNA, 36 bp, Artificial Sequence
  Synthetic oligonucleotide
gcatagccgtcctcgttccgttttgacccttcgaca

SEQ ID NO: 191863 - DNA, 36 bp, Artificial Sequence
  Synthetic oligonucleotide
tcctgccaatggaatacagccctcactcctgcacca

SEQ ID NO: 191864 - DNA, 35 bp, Artificial Sequence
  Synthetic oligonucleotide
gtggacagtcgccctcctaagctgttttttaccca

SEQ ID NO: 191865 - DNA, 35 bp, Artificial Sequence
  Synthetic oligonucleotide
tctgccctgcccgacctgctgttctcccggtccca

SEQ ID NO: 191866 - DNA, 36 bp, Artificial Sequence
  Synthetic oligonucleotide
ttgaccccctgtgtcatatctcgatctgtctttcca

SEQ ID NO: 191867 - DNA, 36 bp, Artificial Sequence
  Synthetic oligonucleotide
tactcaacctccacattccgtgcttatggccacgca

SEQ ID NO: 191868 - DNA, 35 bp, Artificial Sequence
  Synthetic oligonucleotide
ggtgcctttcccatctcgtactgccgggcgacgca

SEQ ID NO: 191869 - DNA, 36 bp, Artificial Sequence
  Synthetic oligonucleotide
gcatcacgtcgtgacgctgaaccatctaacacctca

SEQ ID NO: 191870 - DNA, 35 bp, Artificial Sequence
  Synthetic oligonucleotide
tgatccttgcggcacctcagtcttaccacacctca

SEQ ID NO: 191871 - DNA, 36 bp, Artificial Sequence
  Synthetic oligonucleotide
tcattgggcaacgcacctgcacgtaacgccttctca

SEQ ID NO: 191872 - DNA, 35 bp, Artificial Sequence
  Synthetic oligonucleotide
tcacacaccctctcctccgctagtgccttgtgtca

SEQ ID NO: 191873 - DNA, 36 bp, Artificial Sequence
  Synthetic oligonucleotide
gtcaactacccgcctgcctgagccccctctgtttca

SEQ ID NO: 191874 - DNA, 37 bp, Artificial Sequence
  Synthetic oligonucleotide
gatacaagcgggaacgaggggaatgaggaagtagaga

SEQ ID NO: 191875 - DNA, 35 bp, Artificial Sequence
  Synthetic oligonucleotide
atgtgaacgccgccttgcacacctgtatccctaga

SEQ ID NO: 191876 - DNA, 37 bp, Artificial Sequence
  Synthetic oligonucleotide
gataggcacaggggggtgggatgaaggtaggtaacga

SEQ ID NO: 191877 - DNA, 36 bp, Artificial Sequence
  Synthetic oligonucleotide
gaaccctcgccacacccctctatgatgaacgcacga

SEQ ID NO: 191878 - DNA, 37 bp, Artificial Sequence
  Synthetic oligonucleotide
ttcccaccactctgaccgtttccataccgttgtacga

SEQ ID NO: 191879 - DNA, 36 bp, Artificial Sequence
  Synthetic oligonucleotide
gggactgccaccacttgtctatgatctataccccga

SEQ ID NO: 191880 - DNA, 36 bp, Artificial Sequence
  Synthetic oligonucleotide
tacgcgtcacgttctgaagccctcccgcctccccga

SEQ ID NO: 191881 - DNA, 37 bp, Artificial Sequence
  Synthetic oligonucleotide
gccactcaggcacatgctcttgcactaaatagtgcga

SEQ ID NO: 191882 - DNA, 36 bp, Artificial Sequence
  Synthetic oligonucleotide
gagggggagggagcacgggcaggtaggggacatcga

SEQ ID NO: 191883 - DNA, 37 bp, Artificial Sequence
  Synthetic oligonucleotide
gacaacggcaggcccctctgagttcacgcctcctcga

SEQ ID NO: 191884 - DNA, 37 bp, Artificial Sequence
  Synthetic oligonucleotide
tcaacacctccgttgcctttcctggactgcccttcga

SEQ ID NO: 191885 - DNA, 37 bp, Artificial Sequence
  Synthetic oligonucleotide
gatggaggggagaataggtaggagagacgccgaagga

SEQ ID NO: 191886 - DNA, 37 bp, Artificial Sequence
  Synthetic oligonucleotide
tccaggggtagaggatagcacgagggacggaccagga

SEQ ID NO: 191887 - DNA, 37 bp, Artificial Sequence
  Synthetic oligonucleotide
gaaaaggtggggggggcacgtgaaagggtagtcagga

SEQ ID NO: 191888 - DNA, 37 bp, Artificial Sequence
  Synthetic oligonucleotide
tgttgctcgacgtcttcagcgctgcccctccaacgga

SEQ ID NO: 191889 - DNA, 37 bp, Artificial Sequence
  Synthetic oligonucleotide
aacgtgagccctcgatccattgttcccctctaccgga

SEQ ID NO: 191890 - DNA, 37 bp, Artificial Sequence
  Synthetic oligonucleotide
ataacaaggtggcggtaaaggggccatggaaggcgga

SEQ ID NO: 191891 - DNA, 37 bp, Artificial Sequence
  Synthetic oligonucleotide
gacaggggaagggaaaggcgggccgaaaccgcaggga

SEQ ID NO: 191892 - DNA, 37 bp, Artificial Sequence
  Synthetic oligonucleotide
atgggcgaaagggcaatgggggcgtgggagggaggga

SEQ ID NO: 191893 - DNA, 37 bp, Artificial Sequence
  Synthetic oligonucleotide
acaccgcgcgaagcacaaagggagggggggtttggga

SEQ ID NO: 191894 - DNA, 36 bp, Artificial Sequence
  Synthetic oligonucleotide
atcaccctcctccgacattaagactggtcagctgga

SEQ ID NO: 191895 - DNA, 33 bp, Artificial Sequence
  Synthetic oligonucleotide
tacccctcctgccgcagacagcactgtagtgga

SEQ ID NO: 191896 - DNA, 37 bp, Artificial Sequence
  Synthetic oligonucleotide
ttcgcaccgcggccataagcctacccttcaccttgga

SEQ ID NO: 191897 - DNA, 37 bp, Artificial Sequence
  Synthetic oligonucleotide
gacgtcgcggagggaggggaggctagggggggcatga

SEQ ID NO: 191898 - DNA, 38 bp, Artificial Sequence
  Synthetic oligonucleotide
tgctgccagggactgggggaagggagggagtggcatga

SEQ ID NO: 191899 - DNA, 38 bp, Artificial Sequence
  Synthetic oligonucleotide
aagggcggggaggcggagggaacttgctgagaggatga

SEQ ID NO: 191900 - DNA, 37 bp, Artificial Sequence
  Synthetic oligonucleotide
atctgcggcacaacggtcccccccgcccatcatatga

SEQ ID NO: 191901 - DNA, 37 bp, Artificial Sequence
  Synthetic oligonucleotide
tggaccctacatctgcttctttgccgctccttactga

SEQ ID NO: 191902 - DNA, 35 bp, Artificial Sequence
  Synthetic oligonucleotide
gttgccagctcttatactcgctatcctcgccctga

SEQ ID NO: 191903 - DNA, 38 bp, Artificial Sequence
  Synthetic oligonucleotide
gcaaagacgggtggtgattgtaaggtggtggaagctga

SEQ ID NO: 191904 - DNA, 38 bp, Artificial Sequence
  Synthetic oligonucleotide
gatggcgcccgggtccacctcgtccttattcctgctga

SEQ ID NO: 191905 - DNA, 38 bp, Artificial Sequence
  Synthetic oligonucleotide
acctgcgcagatcgcttcttgctattccatcttgctga

SEQ ID NO: 191906 - DNA, 38 bp, Artificial Sequence
  Synthetic oligonucleotide
gtgccgacctatgccgcccataatccccctgtctctga

SEQ ID NO: 191907 - DNA, 37 bp, Artificial Sequence
  Synthetic oligonucleotide
tacttgttccatcgtactgcttctaccacgaaagtga

SEQ ID NO: 191908 - DNA, 36 bp, Artificial Sequence
  Synthetic oligonucleotide
tcctccttcaccccgagcttgtactttgacccgtga

SEQ ID NO: 191909 - DNA, 38 bp, Artificial Sequence
  Synthetic oligonucleotide
gtgccaccagcgaagtcctcatgccccactcctcgtga

SEQ ID NO: 191910 - DNA, 38 bp, Artificial Sequence
  Synthetic oligonucleotide
tccggaaagagggaaggttggaagaagggtgtaggtga

SEQ ID NO: 191911 - DNA, 38 bp, Artificial Sequence
  Synthetic oligonucleotide
gagatcacgctggtgctcttttcctttccccctggtga

SEQ ID NO: 191912 - DNA, 38 bp, Artificial Sequence
  Synthetic oligonucleotide
gaaacgggaggaggccgggatgggatggacggctgtga

SEQ ID NO: 191913 - DNA, 38 bp, Artificial Sequence
  Synthetic oligonucleotide
tcacaaagtaggtggtggggtagataggaaaggtgtga

SEQ ID NO: 191914 - DNA, 37 bp, Artificial Sequence
  Synthetic oligonucleotide
actctccgccgctgctttcctttcaatcgaagattga

SEQ ID NO: 191915 - DNA, 38 bp, Artificial Sequence
  Synthetic oligonucleotide
gacccatccgctgtttattgcacggatccttcacttga

SEQ ID NO: 191916 - DNA, 38 bp, Artificial Sequence
  Synthetic oligonucleotide
gggtgggtcggggcgggcgtggacactgatccagttga

SEQ ID NO: 191917 - DNA, 38 bp, Artificial Sequence
  Synthetic oligonucleotide
gaaaacgtgggggtgggaggaaatgggcaccgttttga

SEQ ID NO: 191918 - DNA, 36 bp, Artificial Sequence
  Synthetic oligonucleotide
ataccgcaccacctcacgacacctttcaaagccata

SEQ ID NO: 191919 - DNA, 35 bp, Artificial Sequence
  Synthetic oligonucleotide
acacacctcgcgactatatcgtctccctacgccta

SEQ ID NO: 191920 - DNA, 36 bp, Artificial Sequence
  Synthetic oligonucleotide
ttaccacatgcactgctggcctttccgtaaggccta

SEQ ID NO: 191921 - DNA, 36 bp, Artificial Sequence
  Synthetic oligonucleotide
accgccaggcccagtacgctgaaccgcctcttccta

SEQ ID NO: 191922 - DNA, 35 bp, Artificial Sequence
  Synthetic oligonucleotide
ttgctaccacccgggccccctgatagctttagcta

SEQ ID NO: 191923 - DNA, 36 bp, Artificial Sequence
  Synthetic oligonucleotide
atgtgcggagacacagaggagagggtcaagggagta

SEQ ID NO: 191924 - DNA, 36 bp, Artificial Sequence
  Synthetic oligonucleotide
acctccgccattattaagttgttttagtcctccgta

SEQ ID NO: 191925 - DNA, 36 bp, Artificial Sequence
  Synthetic oligonucleotide
gtagggtagggtcggggggacgtggggtaacgcgta

SEQ ID NO: 191926 - DNA, 36 bp, Artificial Sequence
  Synthetic oligonucleotide
atcatccttcgcacctgccgctgtagaccattcgta

SEQ ID NO: 191927 - DNA, 36 bp, Artificial Sequence
  Synthetic oligonucleotide
gaacaggtggggggacacgggataagcaaggcggta

SEQ ID NO: 191928 - DNA, 36 bp, Artificial Sequence
  Synthetic oligonucleotide
tggacgggggaggaatgcctatacggggggtcggta

SEQ ID NO: 191929 - DNA, 36 bp, Artificial Sequence
  Synthetic oligonucleotide
tcgttgttccaccactactgcgtttgcctgccatta

SEQ ID NO: 191930 - DNA, 35 bp, Artificial Sequence
  Synthetic oligonucleotide
acacacccaacgccacagccatacgggaacctaac

SEQ ID NO: 191931 - DNA, 35 bp, Artificial Sequence
  Synthetic oligonucleotide
tcacgtagacgccggctattctttcagggcaccac

SEQ ID NO: 191932 - DNA, 35 bp, Artificial Sequence
  Synthetic oligonucleotide
actgccgtttgttgatcggttcttcgcgccctcac

SEQ ID NO: 191933 - DNA, 35 bp, Artificial Sequence
  Synthetic oligonucleotide
atcgcacaccccgtcgcgctacaggaattcctcac

SEQ ID NO: 191934 - DNA, 35 bp, Artificial Sequence
  Synthetic oligonucleotide
ggaacgagtgtccctcgccgtacgtctcccccgac

SEQ ID NO: 191935 - DNA, 35 bp, Artificial Sequence
  Synthetic oligonucleotide
aagtagcacgggtccactattccactccctgcccc

SEQ ID NO: 191936 - DNA, 35 bp, Artificial Sequence
  Synthetic oligonucleotide
aacacccccaacgtgttacgcatgccactctagcc

SEQ ID NO: 191937 - DNA, 35 bp, Artificial Sequence
  Synthetic oligonucleotide
ttcgctctagtcctctgatatcgcttctattcgcc

SEQ ID NO: 191938 - DNA, 35 bp, Artificial Sequence
  Synthetic oligonucleotide
gacaacgcaggtcgcccttacccctgtctctggcc

SEQ ID NO: 191939 - DNA, 35 bp, Artificial Sequence
  Synthetic oligonucleotide
aagtccatcgtagcctcccacacgtttttggtgcc

SEQ ID NO: 191940 - DNA, 35 bp, Artificial Sequence
  Synthetic oligonucleotide
acacccgtgacggactgccaactctcgcgtaatcc

SEQ ID NO: 191941 - DNA, 35 bp, Artificial Sequence
  Synthetic oligonucleotide
tgagcctcagatcatcccccgcctcggttatctcc

SEQ ID NO: 191942 - DNA, 35 bp, Artificial Sequence
  Synthetic oligonucleotide
gccaaacacgctagactggccctcgaatcttctcc

SEQ ID NO: 191943 - DNA, 35 bp, Artificial Sequence
  Synthetic oligonucleotide
gttcccccccgagctaccggttcgatccatgttcc

SEQ ID NO: 191944 - DNA, 35 bp, Artificial Sequence
  Synthetic oligonucleotide
tgccgcaacggctcgactccacccccaccggaagc

SEQ ID NO: 191945 - DNA, 35 bp, Artificial Sequence
  Synthetic oligonucleotide
actgcatgctctagcctttccataccactccccgc

SEQ ID NO: 191946 - DNA, 35 bp, Artificial Sequence
  Synthetic oligonucleotide
tccccctgccttagttaaaggtcctaattgcccgc

SEQ ID NO: 191947 - DNA, 35 bp, Artificial Sequence
  Synthetic oligonucleotide
tttgagcacctgtacgccctgtggttcccctccgc

SEQ ID NO: 191948 - DNA, 35 bp, Artificial Sequence
  Synthetic oligonucleotide
atggcccagccattcgttccctatcttcaggaggc

SEQ ID NO: 191949 - DNA, 35 bp, Artificial Sequence
  Synthetic oligonucleotide
gtaaatgtctgggcggtggaggggtgaggtggggc

SEQ ID NO: 191950 - DNA, 35 bp, Artificial Sequence
  Synthetic oligonucleotide
gcagacgcagcaccggtaaacccgactattccctc

SEQ ID NO: 191951 - DNA, 35 bp, Artificial Sequence
  Synthetic oligonucleotide
gacaccattctggcaagtaaacgttcccttccctc

SEQ ID NO: 191952 - DNA, 35 bp, Artificial Sequence
  Synthetic oligonucleotide
ttgacacctgggttgctatataagcctctatcctc

SEQ ID NO: 191953 - DNA, 35 bp, Artificial Sequence
  Synthetic oligonucleotide
ttgccccattcccacacgacactttgctgatgctc

SEQ ID NO: 191954 - DNA, 35 bp, Artificial Sequence
  Synthetic oligonucleotide
ttgccgaagtgccagccttgttacacaaccatctc

SEQ ID NO: 191955 - DNA, 35 bp, Artificial Sequence
  Synthetic oligonucleotide
ttaccgcacgccacactccatcgccctccatcgtc

SEQ ID NO: 191956 - DNA, 35 bp, Artificial Sequence
  Synthetic oligonucleotide
gagcgaagccccatacgcttactatggtaccattc

SEQ ID NO: 191957 - DNA, 35 bp, Artificial Sequence
  Synthetic oligonucleotide
tattgctacggttagttccgaccggcttccccttc

SEQ ID NO: 191958 - DNA, 35 bp, Artificial Sequence
  Synthetic oligonucleotide
aaggtgcgcttcggctctactgtaatccgcccttc

SEQ ID NO: 191959 - DNA, 35 bp, Artificial Sequence
  Synthetic oligonucleotide
gagacaggagagaggcgccgtagaggagataaacg

SEQ ID NO: 191960 - DNA, 35 bp, Artificial Sequence
  Synthetic oligonucleotide
actaacagccgcgttcttggccatctttcactccg

SEQ ID NO: 191961 - DNA, 35 bp, Artificial Sequence
  Synthetic oligonucleotide
tggaggggggggataaatttagggtacggcgaggg

SEQ ID NO: 191962 - DNA, 35 bp, Artificial Sequence
  Synthetic oligonucleotide
gatgacgaggttagaatggtccatagggggggtgg

SEQ ID NO: 191963 - DNA, 35 bp, Artificial Sequence
  Synthetic oligonucleotide
gataggggtgtaagaggggagggagcgacgtttgg

SEQ ID NO: 191964 - DNA, 35 bp, Artificial Sequence
  Synthetic oligonucleotide
ataaagggggcgaggataaggggaaagacggactg

SEQ ID NO: 191965 - DNA, 35 bp, Artificial Sequence
  Synthetic oligonucleotide
tacgtccctgtccccttggcccagctcacaacgtg

SEQ ID NO: 191966 - DNA, 35 bp, Artificial Sequence
  Synthetic oligonucleotide
agcccccgacactattatctatccgaggccccttg

SEQ ID NO: 191967 - DNA, 35 bp, Artificial Sequence
  Synthetic oligonucleotide
acggagttaaagggatgaagggaggcggggggcat

SEQ ID NO: 191968 - DNA, 35 bp, Artificial Sequence
  Synthetic oligonucleotide
gccttacccgtctgccactcgatatgccacttcat

SEQ ID NO: 191969 - DNA, 35 bp, Artificial Sequence
  Synthetic oligonucleotide
gctccctgcactccgggtcgaaagacacgctaact

SEQ ID NO: 191970 - DNA, 35 bp, Artificial Sequence
  Synthetic oligonucleotide
tccgtcactcgattccgccgctgtttcgccctact

SEQ ID NO: 191971 - DNA, 35 bp, Artificial Sequence
  Synthetic oligonucleotide
atggagcagagaagtccccctcgccccgctgtact

SEQ ID NO: 191972 - DNA, 35 bp, Artificial Sequence
  Synthetic oligonucleotide
ttcgcctctagtggccacctcatcacagctttact

SEQ ID NO: 191973 - DNA, 35 bp, Artificial Sequence
  Synthetic oligonucleotide
acaccgacccgtgcgccttttcagccctcgtacct

SEQ ID NO: 191974 - DNA, 35 bp, Artificial Sequence
  Synthetic oligonucleotide
tgcccaacaagtgtattccgccgctttgatgccct

SEQ ID NO: 191975 - DNA, 35 bp, Artificial Sequence
  Synthetic oligonucleotide
agcaagcctcttagttgctctcttctcactcgcct

SEQ ID NO: 191976 - DNA, 35 bp, Artificial Sequence
  Synthetic oligonucleotide
tcgtaacgcgtgcatcccgtactggctcaactcct

SEQ ID NO: 191977 - DNA, 35 bp, Artificial Sequence
  Synthetic oligonucleotide
atagccgccctcccctggttcggcaccctagagct

SEQ ID NO: 191978 - DNA, 35 bp, Artificial Sequence
  Synthetic oligonucleotide
gctgagtgcctggcctccttcatgtctttttcgct

SEQ ID NO: 191979 - DNA, 35 bp, Artificial Sequence
  Synthetic oligonucleotide
tgacatgtggaggagatattgcaatccgtccctct

SEQ ID NO: 191980 - DNA, 35 bp, Artificial Sequence
  Synthetic oligonucleotide
gcatcgacccatctgcctatacgcttgctagctct

SEQ ID NO: 191981 - DNA, 35 bp, Artificial Sequence
  Synthetic oligonucleotide
gggttagcccccggactgcaatactttcccgctct

SEQ ID NO: 191982 - DNA, 35 bp, Artificial Sequence
  Synthetic oligonucleotide
gtgtggtgtgtgggggagcggggaggacagagtct

SEQ ID NO: 191983 - DNA, 35 bp, Artificial Sequence
  Synthetic oligonucleotide
gcacctccttctacgttttatgtaccatgttttct

SEQ ID NO: 191984 - DNA, 36 bp, Artificial Sequence
  Synthetic oligonucleotide
aaccccacgccatttcgccattgttcagccaatcgt

SEQ ID NO: 191985 - DNA, 35 bp, Artificial Sequence
  Synthetic oligonucleotide
ggggtgagtgagtgggctaggggaggggaataggt

SEQ ID NO: 191986 - DNA, 35 bp, Artificial Sequence
  Synthetic oligonucleotide
agctaccgtcacgcgccttcactgttccctccggt

SEQ ID NO: 191987 - DNA, 35 bp, Artificial Sequence
  Synthetic oligonucleotide
ttaggactgcctgccgccgcctccgcctcccatgt

SEQ ID NO: 191988 - DNA, 35 bp, Artificial Sequence
  Synthetic oligonucleotide
gtacaaagggtgggtggatccgggagagtgtttgt

SEQ ID NO: 191989 - DNA, 35 bp, Artificial Sequence
  Synthetic oligonucleotide
gtctgcccaccgcttcgtcctggctctcttcgatt

SEQ ID NO: 191990 - DNA, 35 bp, Artificial Sequence
  Synthetic oligonucleotide
atcatcccatacggtctgtatccccccattgactt

SEQ ID NO: 191991 - DNA, 35 bp, Artificial Sequence
  Synthetic oligonucleotide
ttccgccccagcttttcccgccgtaaattatcctt

SEQ ID NO: 191992 - DNA, 35 bp, Artificial Sequence
  Synthetic oligonucleotide
aacggccaggagggcggggggggacagtgtgcgtt

SEQ ID NO: 191993 - DNA, 35 bp, Artificial Sequence
  Synthetic oligonucleotide
atatcgctgtgtgtcttgcgtccttcccaccggtt

SEQ ID NO: 191994 - DNA, 35 bp, Artificial Sequence
  Synthetic oligonucleotide
aacatactccgccaattccgtttcgataccgggtt

SEQ ID NO: 191995 - DNA, 35 bp, Artificial Sequence
  Synthetic oligonucleotide
gtttcctcccagtctgttagtagttcctgtctgtt

SEQ ID NO: 191996 - DNA, 35 bp, Artificial Sequence
  Synthetic oligonucleotide
tggtacgccttcactgccagtcaccttacgccttt

SEQ ID NO: 191997 - DNA, 37 bp, Artificial Sequence
  Synthetic oligonucleotide
tcacgtgtggggattggaaaggcgggcggggggaaaa

SEQ ID NO: 191998 - DNA, 36 bp, Artificial Sequence
  Synthetic oligonucleotide
tcccgcccctactatgtgccttcagtaggctctaaa

SEQ ID NO: 191999 - DNA, 36 bp, Artificial Sequence
  Synthetic oligonucleotide
gcgcaggccagtaggtcgggggaagggatggtgcaa

SEQ ID NO: 192000 - DNA, 35 bp, Artificial Sequence
  Synthetic oligonucleotide
aacccaccccaggttcaatttgggctacccttcaa

SEQ ID NO: 192001 - DNA, 35 bp, Artificial Sequence
  Synthetic oligonucleotide
gagcgatgaaaggggaatgggcgggtggccgagaa

SEQ ID NO: 192002 - DNA, 36 bp, Artificial Sequence
  Synthetic oligonucleotide
gtgggaggggtggggcggatattgttgggccgtgaa

SEQ ID NO: 192003 - DNA, 35 bp, Artificial Sequence
  Synthetic oligonucleotide
actgccgccggagtaggtcaccagcccttgcctaa

SEQ ID NO: 192004 - DNA, 36 bp, Artificial Sequence
  Synthetic oligonucleotide
tccggttacatcagctcccgtactcacctgcacaca

SEQ ID NO: 192005 - DNA, 36 bp, Artificial Sequence
  Synthetic oligonucleotide
tcaccaccctttgtagttcagtgtaacactctccca

SEQ ID NO: 192006 - DNA, 36 bp, Artificial Sequence
  Synthetic oligonucleotide
tgtcgcctacagtcagggacgtcccccttcgctcca

SEQ ID NO: 192007 - DNA, 36 bp, Artificial Sequence
  Synthetic oligonucleotide
gcacaccgtatgcttttccgaagctagtgccttcca

SEQ ID NO: 192008 - DNA, 35 bp, Artificial Sequence
  Synthetic oligonucleotide
gatccatccggtccgccgtagtgcccttttaggca

SEQ ID NO: 192009 - DNA, 36 bp, Artificial Sequence
  Synthetic oligonucleotide
aagggggtggggcaagggtagtcgcggatcatggca

SEQ ID NO: 192010 - DNA, 35 bp, Artificial Sequence
  Synthetic oligonucleotide
actccccgcctgtgcttcgagcggttcctcttgca

SEQ ID NO: 192011 - DNA, 35 bp, Artificial Sequence
  Synthetic oligonucleotide
gtcccaactatcgatactataacacctctcttgca

SEQ ID NO: 192012 - DNA, 36 bp, Artificial Sequence
  Synthetic oligonucleotide
gacgggggggaactcgggtgggcgatgtggatatca

SEQ ID NO: 192013 - DNA, 35 bp, Artificial Sequence
  Synthetic oligonucleotide
tgatacgcacccgtttactgacccatctactatca

SEQ ID NO: 192014 - DNA, 36 bp, Artificial Sequence
  Synthetic oligonucleotide
gaacagcgctatttgtctcattacccttgcccctca

SEQ ID NO: 192015 - DNA, 36 bp, Artificial Sequence
  Synthetic oligonucleotide
acacccggctacccctatgtctttcgtaaacgctca

SEQ ID NO: 192016 - DNA, 35 bp, Artificial Sequence
  Synthetic oligonucleotide
tttcaccctccgttgtcctctaacccccgtggtca

SEQ ID NO: 192017 - DNA, 36 bp, Artificial Sequence
  Synthetic oligonucleotide
gtccgaccccttgctttatcggcgttccgtaattca

SEQ ID NO: 192018 - DNA, 36 bp, Artificial Sequence
  Synthetic oligonucleotide
tcgtagcggtcaacattgccgcgtgccacctcttca

SEQ ID NO: 192019 - DNA, 36 bp, Artificial Sequence
  Synthetic oligonucleotide
gtcacggggggaagggtacatgcggggtactagaga

SEQ ID NO: 192020 - DNA, 36 bp, Artificial Sequence
  Synthetic oligonucleotide
atgttcacctctgctgccactctaacatgctaccga

SEQ ID NO: 192021 - DNA, 37 bp, Artificial Sequence
  Synthetic oligonucleotide
atcacctgcaccgatctgtgatccttcgctttaccga

SEQ ID NO: 192022 - DNA, 37 bp, Artificial Sequence
  Synthetic oligonucleotide
gatccgagctccattggtttccgtgtgccccctccga

SEQ ID NO: 192023 - DNA, 37 bp, Artificial Sequence
  Synthetic oligonucleotide
gtacacgccccgttatcactaagtgccatccttccga

SEQ ID NO: 192024 - DNA, 36 bp, Artificial Sequence
  Synthetic oligonucleotide
tgcccatccccttgcgtaggtcgccgcaccttgcga

SEQ ID NO: 192025 - DNA, 37 bp, Artificial Sequence
  Synthetic oligonucleotide
tgcaccctcgcccagcgttcactcgacgttagatcga

SEQ ID NO: 192026 - DNA, 37 bp, Artificial Sequence
  Synthetic oligonucleotide
actcacagcagtccccgttcgtctatatttccttcga

SEQ ID NO: 192027 - DNA, 37 bp, Artificial Sequence
  Synthetic oligonucleotide
atcggatgatgggggggggcgtggagatcgggaagga

SEQ ID NO: 192028 - DNA, 35 bp, Artificial Sequence
  Synthetic oligonucleotide
gatgaggagtgggcgggagttgtacagggtaagga

SEQ ID NO: 192029 - DNA, 37 bp, Artificial Sequence
  Synthetic oligonucleotide
accccatgcaccttggctccctctcgacgatttagga

SEQ ID NO: 192030 - DNA, 36 bp, Artificial Sequence
  Synthetic oligonucleotide
gtggtgggcgcatgccataatatagtgaaagaggga

SEQ ID NO: 192031 - DNA, 36 bp, Artificial Sequence
  Synthetic oligonucleotide
agtgcgaatcggagggagggtaggggagcaacggga

SEQ ID NO: 192032 - DNA, 37 bp, Artificial Sequence
  Synthetic oligonucleotide
agccagggagaaggcaagaaaagggtggagcagggga

SEQ ID NO: 192033 - DNA, 37 bp, Artificial Sequence
  Synthetic oligonucleotide
tcacgaccgggtgggtattgggccgcacaaattggga

SEQ ID NO: 192034 - DNA, 37 bp, Artificial Sequence
  Synthetic oligonucleotide
gactgacgggggaggaagtcagtataggagggatgga

SEQ ID NO: 192035 - DNA, 36 bp, Artificial Sequence
  Synthetic oligonucleotide
gctcgaactaccgccgcactttttgagtcctctgga

SEQ ID NO: 192036 - DNA, 37 bp, Artificial Sequence
  Synthetic oligonucleotide
accaccaacatcacatgcatatcgccttccccttgga

SEQ ID NO: 192037 - DNA, 37 bp, Artificial Sequence
  Synthetic oligonucleotide
gactcacacccgcctgttatccaaggtttctcactga

SEQ ID NO: 192038 - DNA, 37 bp, Artificial Sequence
  Synthetic oligonucleotide
tgtgacgtcacaatctgccacgccttcttgtacctga

SEQ ID NO: 192039 - DNA, 37 bp, Artificial Sequence
  Synthetic oligonucleotide
tcccacctgacgatgatcccgcttactacatccctga

SEQ ID NO: 192040 - DNA, 37 bp, Artificial Sequence
  Synthetic oligonucleotide
tcagggtagaagggaatgtaaggggctaggaacgtga

SEQ ID NO: 192041 - DNA, 38 bp, Artificial Sequence
  Synthetic oligonucleotide
tgctccccccctgtagcgccttttgccattgtccgtga

SEQ ID NO: 192042 - DNA, 38 bp, Artificial Sequence
  Synthetic oligonucleotide
tgtggaggacgggaggtaagcacggacgaactgggtga

SEQ ID NO: 192043 - DNA, 37 bp, Artificial Sequence
  Synthetic oligonucleotide
gcgcgggaagggaacggcggataccaggagttggtga

SEQ ID NO: 192044 - DNA, 38 bp, Artificial Sequence
  Synthetic oligonucleotide
tacatcccgccccatgagtatctgctccttgcaattga

SEQ ID NO: 192045 - DNA, 38 bp, Artificial Sequence
  Synthetic oligonucleotide
tcgatggaaaagggtgttaggcggggcggaaggattga

SEQ ID NO: 192046 - DNA, 37 bp, Artificial Sequence
  Synthetic oligonucleotide
acttgtgccccatcccttgctgagacatactgcttga

SEQ ID NO: 192047 - DNA, 37 bp, Artificial Sequence
  Synthetic oligonucleotide
tgtagccgtccgcagacttgccccgcccccttcttga

SEQ ID NO: 192048 - DNA, 37 bp, Artificial Sequence
  Synthetic oligonucleotide
tcagacccggctgccgttatcgtctcgccccatttga

SEQ ID NO: 192049 - DNA, 35 bp, Artificial Sequence
  Synthetic oligonucleotide
gcagccgctgagctatcacctaaccaccactttga

SEQ ID NO: 192050 - DNA, 35 bp, Artificial Sequence
  Synthetic oligonucleotide
gatcacccgtagccccctgtttatgttttacacta

SEQ ID NO: 192051 - DNA, 35 bp, Artificial Sequence
  Synthetic oligonucleotide
acatacatcatgtccgatgatgccatcccccacta

SEQ ID NO: 192052 - DNA, 36 bp, Artificial Sequence
  Synthetic oligonucleotide
ggagtaacgccaccattccgtgatccctgttgccta

SEQ ID NO: 192053 - DNA, 36 bp, Artificial Sequence
  Synthetic oligonucleotide
taacctacgccacgtttctcgtcgactcaccttgta

SEQ ID NO: 192054 - DNA, 35 bp, Artificial Sequence
  Synthetic oligonucleotide
tgctgctctcgcccgctgttgactcaccttcctta

SEQ ID NO: 192055 - DNA, 35 bp, Artificial Sequence
  Synthetic oligonucleotide
gctactcatcgtggcccttatgtctatcctcgtta

SEQ ID NO: 192056 - DNA, 35 bp, Artificial Sequence
  Synthetic oligonucleotide
gatgtgcactgcccgactcaccacgatacatgaac

SEQ ID NO: 192057 - DNA, 35 bp, Artificial Sequence
  Synthetic oligonucleotide
tcccatgtgcctgcttaacatcctcctactgtaac

SEQ ID NO: 192058 - DNA, 35 bp, Artificial Sequence
  Synthetic oligonucleotide
tccacgcatacgtcttagttactccccctgcgcac

SEQ ID NO: 192059 - DNA, 35 bp, Artificial Sequence
  Synthetic oligonucleotide
ttacgtacagatcccgttctctgtctgcacatcac

SEQ ID NO: 192060 - DNA, 35 bp, Artificial Sequence
  Synthetic oligonucleotide
tcgatggctgacccctcctctgcaattagtgctac

SEQ ID NO: 192061 - DNA, 35 bp, Artificial Sequence
  Synthetic oligonucleotide
atggacaccactcgcctggacaaccatcagtctac

SEQ ID NO: 192062 - DNA, 36 bp, Artificial Sequence
  Synthetic oligonucleotide
gctcaacatcgtactgtttgtagcgcctttccttac

SEQ ID NO: 192063 - DNA, 35 bp, Artificial Sequence
  Synthetic oligonucleotide
tccaccccgacccatgccgtgccaaagcaccaacc

SEQ ID NO: 192064 - DNA, 35 bp, Artificial Sequence
  Synthetic oligonucleotide
tcttacaccactgccgtgactaaccggacgacacc

SEQ ID NO: 192065 - DNA, 35 bp, Artificial Sequence
  Synthetic oligonucleotide
aactaccgggcagacagcgggcactccaccccacc

SEQ ID NO: 192066 - DNA, 35 bp, Artificial Sequence
  Synthetic oligonucleotide
tgttaataccctcccgagccctggcattgagcacc

SEQ ID NO: 192067 - DNA, 35 bp, Artificial Sequence
  Synthetic oligonucleotide
gacaccaatcgtatgctcccggcccttgcacaccc

SEQ ID NO: 192068 - DNA, 35 bp, Artificial Sequence
  Synthetic oligonucleotide
gtccccctccgcaggttgacagatggtcttgcccc

SEQ ID NO: 192069 - DNA, 35 bp, Artificial Sequence
  Synthetic oligonucleotide
ggacacctccactgctttacttttcctgaatcccc

SEQ ID NO: 192070 - DNA, 35 bp, Artificial Sequence
  Synthetic oligonucleotide
tcccgcatgccaactcgtactgctcgagatctccc

SEQ ID NO: 192071 - DNA, 35 bp, Artificial Sequence
  Synthetic oligonucleotide
gcacccgttcagttatgcgtgtcacaccctgtccc

SEQ ID NO: 192072 - DNA, 35 bp, Artificial Sequence
  Synthetic oligonucleotide
tgacagcactcaccgcccgtatgttttgttctgcc

SEQ ID NO: 192073 - DNA, 35 bp, Artificial Sequence
  Synthetic oligonucleotide
gaccccgcctccacattataccagcacttgttgcc

SEQ ID NO: 192074 - DNA, 35 bp, Artificial Sequence
  Synthetic oligonucleotide
gctaaccatctgcaatataggcgctttagccatcc

SEQ ID NO: 192075 - DNA, 35 bp, Artificial Sequence
  Synthetic oligonucleotide
taatgcacctcaatgaccctcctcgctgaatctcc

SEQ ID NO: 192076 - DNA, 35 bp, Artificial Sequence
  Synthetic oligonucleotide
gctccgctgggggtgtcatcccgcgcaaaccttcc

SEQ ID NO: 192077 - DNA, 35 bp, Artificial Sequence
  Synthetic oligonucleotide
tcggggtcgcctgttcaaccagcgattgcccttcc

SEQ ID NO: 192078 - DNA, 35 bp, Artificial Sequence
  Synthetic oligonucleotide
ggtggtcctcgatactttaccttaaccggccttcc

SEQ ID NO: 192079 - DNA, 35 bp, Artificial Sequence
  Synthetic oligonucleotide
tctgcatccctgactcagagctccatcggccttcc

SEQ ID NO: 192080 - DNA, 35 bp, Artificial Sequence
  Synthetic oligonucleotide
tctatggcgggtcactcctcggatcctctgcttcc

SEQ ID NO: 192081 - DNA, 35 bp, Artificial Sequence
  Synthetic oligonucleotide
ttacgcgcaacactagaaatgaatgctgcctttcc

SEQ ID NO: 192082 - DNA, 33 bp, Artificial Sequence
  Synthetic oligonucleotide
atgagcagccctccaccagcagcagcctcactc

SEQ ID NO: 192083 - DNA, 35 bp, Artificial Sequence
  Synthetic oligonucleotide
aatcgcgtgcaatctggctcaactcactatccctc

SEQ ID NO: 192084 - DNA, 35 bp, Artificial Sequence
  Synthetic oligonucleotide
ttcgatcagaccgcccttcgtagtattcctgcctc

SEQ ID NO: 192085 - DNA, 35 bp, Artificial Sequence
  Synthetic oligonucleotide
gcaacttgtgtatgcccgctcatccgtgtttcctc

SEQ ID NO: 192086 - DNA, 35 bp, Artificial Sequence
  Synthetic oligonucleotide
acacggttgggccgttcagtctttccccgctgctc

SEQ ID NO: 192087 - DNA, 35 bp, Artificial Sequence
  Synthetic oligonucleotide
gtcgcctctgactacattattctggtcattctctc

SEQ ID NO: 192088 - DNA, 35 bp, Artificial Sequence
  Synthetic oligonucleotide
tcttacgctctctcccatgtgtcgttatcaccttc

SEQ ID NO: 192089 - DNA, 35 bp, Artificial Sequence
  Synthetic oligonucleotide
agtgttcacctgttacgttatagcccgccgccttc

SEQ ID NO: 192090 - DNA, 35 bp, Artificial Sequence
  Synthetic oligonucleotide
gagtgaccggtcccatttgcccttcgcgttccttc

SEQ ID NO: 192091 - DNA, 35 bp, Artificial Sequence
  Synthetic oligonucleotide
tcagtaggcacccagtgcggtggttcactttcttc

SEQ ID NO: 192092 - DNA, 36 bp, Artificial Sequence
  Synthetic oligonucleotide
ttgccccgcctctgttcggtctggcattacccgttc

SEQ ID NO: 192093 - DNA, 35 bp, Artificial Sequence
  Synthetic oligonucleotide
tcaaaaacgcctgctatgatccttcacaccctttc

SEQ ID NO: 192094 - DNA, 35 bp, Artificial Sequence
  Synthetic oligonucleotide
atgggataacagggggggaagggttataggacaag

SEQ ID NO: 192095 - DNA, 35 bp, Artificial Sequence
  Synthetic oligonucleotide
gaccacgtccaggcctcccacccctcagtcttaag

SEQ ID NO: 192096 - DNA, 35 bp, Artificial Sequence
  Synthetic oligonucleotide
tgagagacacgggccgatgggcaagggcgggatag

SEQ ID NO: 192097 - DNA, 35 bp, Artificial Sequence
  Synthetic oligonucleotide
gccatactcccttttcaccatccacgaccctgacg

SEQ ID NO: 192098 - DNA, 35 bp, Artificial Sequence
  Synthetic oligonucleotide
tgcacaagtgcttccgtcgtctcatgatcctaccg

SEQ ID NO: 192099 - DNA, 35 bp, Artificial Sequence
  Synthetic oligonucleotide
gctccctgtacctccgacgtcttgacatactgccg

SEQ ID NO: 192100 - DNA, 35 bp, Artificial Sequence
  Synthetic oligonucleotide
atgtgggccagagcagaggggtacgggtaggggcg

SEQ ID NO: 192101 - DNA, 35 bp, Artificial Sequence
  Synthetic oligonucleotide
gctctaaccaaggttggccagccctgctcccctcg

SEQ ID NO: 192102 - DNA, 35 bp, Artificial Sequence
  Synthetic oligonucleotide
gacgttgggggggggcagggcgggaatttttaagg

SEQ ID NO: 192103 - DNA, 35 bp, Artificial Sequence
  Synthetic oligonucleotide
ttacccgcttccggtatcgctcctcctttgcatgg

SEQ ID NO: 192104 - DNA, 35 bp, Artificial Sequence
  Synthetic oligonucleotide
tccgcgccgtaaatcccacaccgtcccgcccctgg

SEQ ID NO: 192105 - DNA, 35 bp, Artificial Sequence
  Synthetic oligonucleotide
gtgcaacgcactgcgttactccccccagcttttgg

SEQ ID NO: 192106 - DNA, 35 bp, Artificial Sequence
  Synthetic oligonucleotide
gaataggtaggggagagcaaaggggccaggtcatg

SEQ ID NO: 192107 - DNA, 35 bp, Artificial Sequence
  Synthetic oligonucleotide
gcttagtcccctgcccgtatttgcgtagctccctg

SEQ ID NO: 192108 - DNA, 35 bp, Artificial Sequence
  Synthetic oligonucleotide
atgcccagccttacgggtgcccctgtgatctcctg

SEQ ID NO: 192109 - DNA, 35 bp, Artificial Sequence
  Synthetic oligonucleotide
gaagcaaagctaaaagtggaaggatagggcgcgtg

SEQ ID NO: 192110 - DNA, 35 bp, Artificial Sequence
  Synthetic oligonucleotide
agacaatccgcctgctcctactttacactcgcttg

SEQ ID NO: 192111 - DNA, 35 bp, Artificial Sequence
  Synthetic oligonucleotide
ttcacaacccgcgctgcctttcgtccctgggtttg

SEQ ID NO: 192112 - DNA, 35 bp, Artificial Sequence
  Synthetic oligonucleotide
tagccacgccggtatcaaatccgccccagacacct

SEQ ID NO: 192113 - DNA, 35 bp, Artificial Sequence
  Synthetic oligonucleotide
atgtgccgtcccccgacttagtccccgttatccct

SEQ ID NO: 192114 - DNA, 35 bp, Artificial Sequence
  Synthetic oligonucleotide
tccgcaggggggggaggacggggaggataaggcct

SEQ ID NO: 192115 - DNA, 35 bp, Artificial Sequence
  Synthetic oligonucleotide
gtcccaccatccaagcatacgtatgaggttctcct

SEQ ID NO: 192116 - DNA, 35 bp, Artificial Sequence
  Synthetic oligonucleotide
tgcaccccagcgcctaaccctctggaatgacctct

SEQ ID NO: 192117 - DNA, 35 bp, Artificial Sequence
  Synthetic oligonucleotide
gttcacgcgaacacatagattctcacgttccctct

SEQ ID NO: 192118 - DNA, 35 bp, Artificial Sequence
  Synthetic oligonucleotide
gactgtcgcaattctctgcctgccataccttccgt

SEQ ID NO: 192119 - DNA, 35 bp, Artificial Sequence
  Synthetic oligonucleotide
attggtggtgagaaggggtgagctggaagagaggt

SEQ ID NO: 192120 - DNA, 31 bp, Artificial Sequence
  Synthetic oligonucleotide
gatggggtgggactgtagtctgtaaggcggt

SEQ ID NO: 192121 - DNA, 35 bp, Artificial Sequence
  Synthetic oligonucleotide
ttctgtccctcctagatgctctgtacctccctggt

SEQ ID NO: 192122 - DNA, 35 bp, Artificial Sequence
  Synthetic oligonucleotide
acttcacctcacccatccaccagaaggcccgtggt

SEQ ID NO: 192123 - DNA, 35 bp, Artificial Sequence
  Synthetic oligonucleotide
gcctgttccttcattgcgtcatacttgctcactgt

SEQ ID NO: 192124 - DNA, 35 bp, Artificial Sequence
  Synthetic oligonucleotide
tcttagcctgcaagctgccctcccatctttccctt

SEQ ID NO: 192125 - DNA, 35 bp, Artificial Sequence
  Synthetic oligonucleotide
tatccagtccaatctgtagtttgccaacccctctt

SEQ ID NO: 192126 - DNA, 29 bp, Artificial Sequence
  Synthetic oligonucleotide
gactatccgtatccgtaccgcttatattt

SEQ ID NO: 192127 - DNA, 35 bp, Artificial Sequence
  Synthetic oligonucleotide
ttacccgccccaaatttcctgctagatgggccttt

SEQ ID NO: 192128 - DNA, 35 bp, Artificial Sequence
  Synthetic oligonucleotide
tccaccgctgtagggcccatttacagttgcttttt

SEQ ID NO: 192129 - DNA, 36 bp, Artificial Sequence
  Synthetic oligonucleotide
gaccatggggtgggtggtgagggccgttcgggaaaa

SEQ ID NO: 192130 - DNA, 35 bp, Artificial Sequence
  Synthetic oligonucleotide
acaccccaccagttcgtaaaaaggctgtccacgaa

SEQ ID NO: 192131 - DNA, 35 bp, Artificial Sequence
  Synthetic oligonucleotide
agtcgtaggacaggtgcatcatgggggggggcgaa

SEQ ID NO: 192132 - DNA, 35 bp, Artificial Sequence
  Synthetic oligonucleotide
ttgggggagggtggtccgtgttcggggactgtgaa

SEQ ID NO: 192133 - DNA, 36 bp, Artificial Sequence
  Synthetic oligonucleotide
accccgccgtccatcccgtctccgccaagtcgctaa

SEQ ID NO: 192134 - DNA, 35 bp, Artificial Sequence
  Synthetic oligonucleotide
ggaccgcagcagaagtccttctctctctgctctaa

SEQ ID NO: 192135 - DNA, 35 bp, Artificial Sequence
  Synthetic oligonucleotide
tagtgcagacagtattagcttaccctgcacctcca

SEQ ID NO: 192136 - DNA, 36 bp, Artificial Sequence
  Synthetic oligonucleotide
tagaaacgccagaactcgcccttcgctatctctcca

SEQ ID NO: 192137 - DNA, 36 bp, Artificial Sequence
  Synthetic oligonucleotide
tgaacgctctgcccatccacgtgttctttgtttcca

SEQ ID NO: 192138 - DNA, 36 bp, Artificial Sequence
  Synthetic oligonucleotide
aagaacgaggagaacgtggtggtaggtggggaggca

SEQ ID NO: 192139 - DNA, 33 bp, Artificial Sequence
  Synthetic oligonucleotide
tcacgtgctgggtgggagggatgtcattgggca

SEQ ID NO: 192140 - DNA, 36 bp, Artificial Sequence
  Synthetic oligonucleotide
acgtaccggccaatctggcacttctctccactgtca

SEQ ID NO: 192141 - DNA, 36 bp, Artificial Sequence
  Synthetic oligonucleotide
gattcgcctcactgtcttggacttccgatcctgtca

SEQ ID NO: 192142 - DNA, 36 bp, Artificial Sequence
  Synthetic oligonucleotide
tccatccctaggtgggattttctcgtttgccattca

SEQ ID NO: 192143 - DNA, 35 bp, Artificial Sequence
  Synthetic oligonucleotide
accccacgccatgtctgctgccattcgttgcttca

SEQ ID NO: 192144 - DNA, 36 bp, Artificial Sequence
  Synthetic oligonucleotide
tcacggtcaccggtgtgtaccgcctctatccccaga

SEQ ID NO: 192145 - DNA, 35 bp, Artificial Sequence
  Synthetic oligonucleotide
tccccatcctcaatatctagcctcgtcctctcaga

SEQ ID NO: 192146 - DNA, 37 bp, Artificial Sequence
  Synthetic oligonucleotide
ggaggcggtaggggttcggtggatggctgtgcagaga

SEQ ID NO: 192147 - DNA, 37 bp, Artificial Sequence
  Synthetic oligonucleotide
attgtgcataaggtgtagggtagtagggggcgggaga

SEQ ID NO: 192148 - DNA, 37 bp, Artificial Sequence
  Synthetic oligonucleotide
tgccggtcctccctattcgtcacaatctcgtcgtaga

SEQ ID NO: 192149 - DNA, 35 bp, Artificial Sequence
  Synthetic oligonucleotide
gtccccctgcctcactccctgatactgcctttaga

SEQ ID NO: 192150 - DNA, 36 bp, Artificial Sequence
  Synthetic oligonucleotide
gtgccgttccttctgcccttgcgaccatctccccga

SEQ ID NO: 192151 - DNA, 37 bp, Artificial Sequence
  Synthetic oligonucleotide
tcacacgccatccctctatctccatctatcggtgcga

SEQ ID NO: 192152 - DNA, 36 bp, Artificial Sequence
  Synthetic oligonucleotide
tgtccccacttggctccttccacctcgaggtttcga

SEQ ID NO: 192153 - DNA, 37 bp, Artificial Sequence
  Synthetic oligonucleotide
ttgaaccatcccacttttctgtgcagtctatgcagga

SEQ ID NO: 192154 - DNA, 37 bp, Artificial Sequence
  Synthetic oligonucleotide
ggtccggacgcacaaggaaagaaaggggaggaacgga

SEQ ID NO: 192155 - DNA, 37 bp, Artificial Sequence
  Synthetic oligonucleotide
tgcaagaggggggtggggtgacagtaggaaatgcgga

SEQ ID NO: 192156 - DNA, 35 bp, Artificial Sequence
  Synthetic oligonucleotide
gcgcccctccagtgtcgcttagcttactcttcgga

SEQ ID NO: 192157 - DNA, 37 bp, Artificial Sequence
  Synthetic oligonucleotide
tgagactagacgttgggtagtaattgggcgggaggga

SEQ ID NO: 192158 - DNA, 36 bp, Artificial Sequence
  Synthetic oligonucleotide
atgccatcattcggctcatttcctgcccacacggga

SEQ ID NO: 192159 - DNA, 37 bp, Artificial Sequence
  Synthetic oligonucleotide
tagcgggacacgggagggatacaagggaagaagggga

SEQ ID NO: 192160 - DNA, 37 bp, Artificial Sequence
  Synthetic oligonucleotide
gtgaggggtagatagtccttgggggttctttcgggga

SEQ ID NO: 192161 - DNA, 35 bp, Artificial Sequence
  Synthetic oligonucleotide
ggaacgggcgagacgggaggtagtgattggatgga

SEQ ID NO: 192162 - DNA, 37 bp, Artificial Sequence
  Synthetic oligonucleotide
gggatggaggaggaataggtacgtgcagcaatatgga

SEQ ID NO: 192163 - DNA, 36 bp, Artificial Sequence
  Synthetic oligonucleotide
aatggtggtggggtgtgtgggcggtgagtgggtgga

SEQ ID NO: 192164 - DNA, 37 bp, Artificial Sequence
  Synthetic oligonucleotide
gaggtggtggtggggcctggtaaaagcgggggttgga

SEQ ID NO: 192165 - DNA, 37 bp, Artificial Sequence
  Synthetic oligonucleotide
gctaaccgggaggaggaatgaaggagcggtgtaatga

SEQ ID NO: 192166 - DNA, 37 bp, Artificial Sequence
  Synthetic oligonucleotide
gccccatgacccagcccgcgatataccgtccttatga

SEQ ID NO: 192167 - DNA, 37 bp, Artificial Sequence
  Synthetic oligonucleotide
tctacatcgcaccacctatagaccctgttacgcctga

SEQ ID NO: 192168 - DNA, 38 bp, Artificial Sequence
  Synthetic oligonucleotide
gacactctacatgtgtcgctgccgtgctccactcctga

SEQ ID NO: 192169 - DNA, 38 bp, Artificial Sequence
  Synthetic oligonucleotide
gaccggcgtacactattcttgcctgccactcactctga

SEQ ID NO: 192170 - DNA, 37 bp, Artificial Sequence
  Synthetic oligonucleotide
tgttacccagttggtcgtaacatctctcttcctctga

SEQ ID NO: 192171 - DNA, 37 bp, Artificial Sequence
  Synthetic oligonucleotide
atgtaccaccgatggtgcctaatgtatccttttctga

SEQ ID NO: 192172 - DNA, 38 bp, Artificial Sequence
  Synthetic oligonucleotide
aacgaggggtgggggggattacggagacggttaagtga

SEQ ID NO: 192173 - DNA, 38 bp, Artificial Sequence
  Synthetic oligonucleotide
tcaggtcagccatccttctgttagtgccccatccgtga

SEQ ID NO: 192174 - DNA, 38 bp, Artificial Sequence
  Synthetic oligonucleotide
ggtaggacgggggaagaaaaacaagcggtcgagcgtga

SEQ ID NO: 192175 - DNA, 38 bp, Artificial Sequence
  Synthetic oligonucleotide
aagggaagtagggaagggtgaggatgaacacgtcgtga

SEQ ID NO: 192176 - DNA, 37 bp, Artificial Sequence
  Synthetic oligonucleotide
gacgcagacggggaacgggaggtggggaaaagggtga

SEQ ID NO: 192177 - DNA, 37 bp, Artificial Sequence
  Synthetic oligonucleotide
accgtagccagggagttggaaggaagggtgggattga

SEQ ID NO: 192178 - DNA, 35 bp, Artificial Sequence
  Synthetic oligonucleotide
taccaccttctacgcgccgttcgactcttgattga

SEQ ID NO: 192179 - DNA, 37 bp, Artificial Sequence
  Synthetic oligonucleotide
tgccgtgctgtgatctccccccctcatttgcccttga

SEQ ID NO: 192180 - DNA, 36 bp, Artificial Sequence
  Synthetic oligonucleotide
gggtggcatcagcctacctatgttctcgtttgttga

SEQ ID NO: 192181 - DNA, 37 bp, Artificial Sequence
  Synthetic oligonucleotide
tcccgcccgccggttgccccaacttcatctcgtttga

SEQ ID NO: 192182 - DNA, 35 bp, Artificial Sequence
  Synthetic oligonucleotide
atagacaggtggggaggataggggcaagttcgata

SEQ ID NO: 192183 - DNA, 36 bp, Artificial Sequence
  Synthetic oligonucleotide
ttccgcccacatccacgtgcgtctaacagccttata

SEQ ID NO: 192184 - DNA, 36 bp, Artificial Sequence
  Synthetic oligonucleotide
gacgctagcctgtatactctctccccgctccgacta

SEQ ID NO: 192185 - DNA, 36 bp, Artificial Sequence
  Synthetic oligonucleotide
gtcggaaaacgccggcctaggtcctccgactcccta

SEQ ID NO: 192186 - DNA, 36 bp, Artificial Sequence
  Synthetic oligonucleotide
atcggtaatgacgtcacatactcctggcccctccta

SEQ ID NO: 192187 - DNA, 36 bp, Artificial Sequence
  Synthetic oligonucleotide
tatgaccataacgccgactagttaccgatcgtccta

SEQ ID NO: 192188 - DNA, 36 bp, Artificial Sequence
  Synthetic oligonucleotide
gacatcccagccgcatcccgtgagttccatcctcta

SEQ ID NO: 192189 - DNA, 35 bp, Artificial Sequence
  Synthetic oligonucleotide
gccgcatgaggcctcgttatccattttccgctcta

SEQ ID NO: 192190 - DNA, 36 bp, Artificial Sequence
  Synthetic oligonucleotide
ttgtcctcccgagtcatcgagccatgcatccccgta

SEQ ID NO: 192191 - DNA, 34 bp, Artificial Sequence
  Synthetic oligonucleotide
gtctcccagccctgcttttcggtgtttttccgta

SEQ ID NO: 192192 - DNA, 35 bp, Artificial Sequence
  Synthetic oligonucleotide
ggtgcccatccgctcctttagtccacccctatgta

SEQ ID NO: 192193 - DNA, 36 bp, Artificial Sequence
  Synthetic oligonucleotide
atccgtccccggcagacctgtcgatgtcctgctgta

SEQ ID NO: 192194 - DNA, 36 bp, Artificial Sequence
  Synthetic oligonucleotide
agccaccatcctgctagttcctttcccgtaccctta

SEQ ID NO: 192195 - DNA, 36 bp, Artificial Sequence
  Synthetic oligonucleotide
tcgcacccccgtctccatcttcacgttccagtctta

SEQ ID NO: 192196 - DNA, 36 bp, Artificial Sequence
  Synthetic oligonucleotide
gatgtcgcgctctctcccccatggtcgatccagtta

SEQ ID NO: 192197 - DNA, 36 bp, Artificial Sequence
  Synthetic oligonucleotide
ttatcgtgccctgctgtcttgaagcccatcctttta

SEQ ID NO: 192198 - DNA, 36 bp, Artificial Sequence
  Synthetic oligonucleotide
tccgccccctctactccgtgcctgtagatcctttta

SEQ ID NO: 192199 - DNA, 35 bp, Artificial Sequence
  Synthetic oligonucleotide
accctcgtccttggtgccatggccaattactccac

SEQ ID NO: 192200 - DNA, 35 bp, Artificial Sequence
  Synthetic oligonucleotide
atgtgccaccagttgcttccgacccactagccgac

SEQ ID NO: 192201 - DNA, 35 bp, Artificial Sequence
  Synthetic oligonucleotide
gttaccgctcacactgaacttcccgtctcaaggac

SEQ ID NO: 192202 - DNA, 35 bp, Artificial Sequence
  Synthetic oligonucleotide
tacaccgccgacgaccgctggcgctcctccacacc

SEQ ID NO: 192203 - DNA, 35 bp, Artificial Sequence
  Synthetic oligonucleotide
acccgcgcaccgcccccctcgcgaccggtgacacc

SEQ ID NO: 192204 - DNA, 31 bp, Artificial Sequence
  Synthetic oligonucleotide
taagtcccgtttgttgcgccccatctccacc

SEQ ID NO: 192205 - DNA, 35 bp, Artificial Sequence
  Synthetic oligonucleotide
gatccgctctcaggctcctcccgccctcaggcacc

SEQ ID NO: 192206 - DNA, 35 bp, Artificial Sequence
  Synthetic oligonucleotide
tactccagctggtcgatgacggtcactcacccccc

SEQ ID NO: 192207 - DNA, 35 bp, Artificial Sequence
  Synthetic oligonucleotide
gtgctagcactcaggatctcgccttttctccggcc

SEQ ID NO: 192208 - DNA, 35 bp, Artificial Sequence
  Synthetic oligonucleotide
tgtacagacccgcctcactgaaacccgctttatcc

SEQ ID NO: 192209 - DNA, 35 bp, Artificial Sequence
  Synthetic oligonucleotide
agtgctgtctccccatttttgagctgatcccttcc

SEQ ID NO: 192210 - DNA, 35 bp, Artificial Sequence
  Synthetic oligonucleotide
ccaccgccccccttgacgctgaagttaagtcttcc

SEQ ID NO: 192211 - DNA, 34 bp, Artificial Sequence
  Synthetic oligonucleotide
ttctccgccccattgcttgttccatccgtcttcc

SEQ ID NO: 192212 - DNA, 35 bp, Artificial Sequence
  Synthetic oligonucleotide
atggcggtgccacctgcctgttcgaccgccgttcc

SEQ ID NO: 192213 - DNA, 35 bp, Artificial Sequence
  Synthetic oligonucleotide
gtcaatccttcattgtgcattgcttactcttttcc

SEQ ID NO: 192214 - DNA, 35 bp, Artificial Sequence
  Synthetic oligonucleotide
gtcacgccccactcctctcgctccgtcgctttagc

SEQ ID NO: 192215 - DNA, 35 bp, Artificial Sequence
  Synthetic oligonucleotide
gtcccccagctgaggtacttgccacttatgcgcgc

SEQ ID NO: 192216 - DNA, 35 bp, Artificial Sequence
  Synthetic oligonucleotide
atgtaccaccttactgtatcgtgttccgattaatc

SEQ ID NO: 192217 - DNA, 35 bp, Artificial Sequence
  Synthetic oligonucleotide
gcgagcacctcaatcgcgcacgtctaccggacctc

SEQ ID NO: 192218 - DNA, 35 bp, Artificial Sequence
  Synthetic oligonucleotide
tatctcagtcgccgctccgtcccctccggaccctc

SEQ ID NO: 192219 - DNA, 35 bp, Artificial Sequence
  Synthetic oligonucleotide
ttggtcaggttaaacgttactatagtccacctctc

SEQ ID NO: 192220 - DNA, 35 bp, Artificial Sequence
  Synthetic oligonucleotide
tcctccggaatcacttgtttgttgcgcactccttc

SEQ ID NO: 192221 - DNA, 35 bp, Artificial Sequence
  Synthetic oligonucleotide
gtatcgccctgcctacatttctattcaggagcttc

SEQ ID NO: 192222 - DNA, 35 bp, Artificial Sequence
  Synthetic oligonucleotide
ggacccctcaagctgcctccgacacgctctcgttc

SEQ ID NO: 192223 - DNA, 35 bp, Artificial Sequence
  Synthetic oligonucleotide
agcatccacccgtctcactgtccctgctacctaag

SEQ ID NO: 192224 - DNA, 35 bp, Artificial Sequence
  Synthetic oligonucleotide
ttcaccgccttcgaaccgacgtctttatcctctag

SEQ ID NO: 192225 - DNA, 35 bp, Artificial Sequence
  Synthetic oligonucleotide
ttcatccaccctggtcccgtcacattcactggacg

SEQ ID NO: 192226 - DNA, 35 bp, Artificial Sequence
  Synthetic oligonucleotide
acaccgacacctgctgcctctccttatttagtacg

SEQ ID NO: 192227 - DNA, 35 bp, Artificial Sequence
  Synthetic oligonucleotide
gcaacgtcccctgttgccgctccatcctcgttacg

SEQ ID NO: 192228 - DNA, 35 bp, Artificial Sequence
  Synthetic oligonucleotide
tcctgccccgccagcctctttttagaccaccaccg

SEQ ID NO: 192229 - DNA, 35 bp, Artificial Sequence
  Synthetic oligonucleotide
tgcacgcaaagcgctaccccgttacttaacctccg

SEQ ID NO: 192230 - DNA, 35 bp, Artificial Sequence
  Synthetic oligonucleotide
agaccaggctgccggctgttactgcaacccctccg

SEQ ID NO: 192231 - DNA, 35 bp, Artificial Sequence
  Synthetic oligonucleotide
tcaaggggtccggaggtgggacgggtgggttggcg

SEQ ID NO: 192232 - DNA, 35 bp, Artificial Sequence
  Synthetic oligonucleotide
gcccaggccctgccccccggtgtaacgcacaatcg

SEQ ID NO: 192233 - DNA, 35 bp, Artificial Sequence
  Synthetic oligonucleotide
tgttcaccactctcatatcctgtcacgccacctcg

SEQ ID NO: 192234 - DNA, 35 bp, Artificial Sequence
  Synthetic oligonucleotide
gtcctcgcccctgtctattcttcgtgtcctgaatg

SEQ ID NO: 192235 - DNA, 35 bp, Artificial Sequence
  Synthetic oligonucleotide
aatacctgcgcgttctgttgcccccgttttccatg

SEQ ID NO: 192236 - DNA, 35 bp, Artificial Sequence
  Synthetic oligonucleotide
gtgtgcgtcgattcctctcatgtcacacaaaactg

SEQ ID NO: 192237 - DNA, 35 bp, Artificial Sequence
  Synthetic oligonucleotide
tgtcgcaccgatcgtacgaactcctccatttgttg

SEQ ID NO: 192238 - DNA, 35 bp, Artificial Sequence
  Synthetic oligonucleotide
atgctcgtccactgctcctggtttcatcgctcaat

SEQ ID NO: 192239 - DNA, 35 bp, Artificial Sequence
  Synthetic oligonucleotide
gccgagctactcgtggtccccttgcacattctaat

SEQ ID NO: 192240 - DNA, 35 bp, Artificial Sequence
  Synthetic oligonucleotide
gcaacacctctcctgtaccctgcctctgcctgcat

SEQ ID NO: 192241 - DNA, 35 bp, Artificial Sequence
  Synthetic oligonucleotide
tcgttccctgccgctgtttccctatgctcggcact

SEQ ID NO: 192242 - DNA, 35 bp, Artificial Sequence
  Synthetic oligonucleotide
gatccacgtcgtcctgtctacttattccggtcact

SEQ ID NO: 192243 - DNA, 35 bp, Artificial Sequence
  Synthetic oligonucleotide
aggagcccactgccaacggtctaccgatccatcct

SEQ ID NO: 192244 - DNA, 35 bp, Artificial Sequence
  Synthetic oligonucleotide
tgactcgccctgtcggttcctcccttcgccaagct

SEQ ID NO: 192245 - DNA, 35 bp, Artificial Sequence
  Synthetic oligonucleotide
ttgctctccacccgttctctcagttcccacgtgct

SEQ ID NO: 192246 - DNA, 35 bp, Artificial Sequence
  Synthetic oligonucleotide
attgtccgccggcccgcttttatgtcccatctggt

SEQ ID NO: 192247 - DNA, 35 bp, Artificial Sequence
  Synthetic oligonucleotide
gacacccatgcaccacgagcatcgcctcaccctgt

SEQ ID NO: 192248 - DNA, 34 bp, Artificial Sequence
  Synthetic oligonucleotide
atcaccccaccacttcgttcgcattcaaagactt

SEQ ID NO: 192249 - DNA, 35 bp, Artificial Sequence
  Synthetic oligonucleotide
taaaccaggctcactgtactttccatacgcacctt

SEQ ID NO: 192250 - DNA, 35 bp, Artificial Sequence
  Synthetic oligonucleotide
gatagccacacgcatgaaatgggcccacttacctt

SEQ ID NO: 192251 - DNA, 35 bp, Artificial Sequence
  Synthetic oligonucleotide
tgcaaatgtcctatcagttggcccagtctctcctt

SEQ ID NO: 192252 - DNA, 35 bp, Artificial Sequence
  Synthetic oligonucleotide
aggttcgcaccatcccccatgatatctaggtcctt

SEQ ID NO: 192253 - DNA, 35 bp, Artificial Sequence
  Synthetic oligonucleotide
tcacgcccactgtctcgcacttcccgcccaccgtt

SEQ ID NO: 192254 - DNA, 35 bp, Artificial Sequence
  Synthetic oligonucleotide
tacccaccgccgccttctcttgctgtaagatcgtt

SEQ ID NO: 192255 - DNA, 36 bp, Artificial Sequence
  Synthetic oligonucleotide
tagggccgagggggggataacgttggtgggatacaa

SEQ ID NO: 192256 - DNA, 35 bp, Artificial Sequence
  Synthetic oligonucleotide
tcacataccccggagcccgcactaggaacatccaa

SEQ ID NO: 192257 - DNA, 36 bp, Artificial Sequence
  Synthetic oligonucleotide
gcaaaggagaggtgacgaattaatggggaagaggaa

SEQ ID NO: 192258 - DNA, 37 bp, Artificial Sequence
  Synthetic oligonucleotide
tccgacggtgacggggggggggcaaagggcgggctaa

SEQ ID NO: 192259 - DNA, 35 bp, Artificial Sequence
  Synthetic oligonucleotide
gtcgcgtgcgcccgtcaatctcctccgttcaacca

SEQ ID NO: 192260 - DNA, 35 bp, Artificial Sequence
  Synthetic oligonucleotide
tacacctccgctgtgattccatacttcgctcccca

SEQ ID NO: 192261 - DNA, 36 bp, Artificial Sequence
  Synthetic oligonucleotide
tatggctccgctaccggtacttataacatcttgcca

SEQ ID NO: 192262 - DNA, 36 bp, Artificial Sequence
  Synthetic oligonucleotide
tcccacggtcatgctattggcacacctccgactcca

SEQ ID NO: 192263 - DNA, 36 bp, Artificial Sequence
  Synthetic oligonucleotide
tgacggccaagcacgtcctatctgccctttcttcca

SEQ ID NO: 192264 - DNA, 36 bp, Artificial Sequence
  Synthetic oligonucleotide
gcactgtcgcagagggtctggggttgggggggagca

SEQ ID NO: 192265 - DNA, 36 bp, Artificial Sequence
  Synthetic oligonucleotide
tgctaaccctcaggacccccacatagcctcctcgca

SEQ ID NO: 192266 - DNA, 35 bp, Artificial Sequence
  Synthetic oligonucleotide
gatgtcctgctcccttatttcgtctattagtggca

SEQ ID NO: 192267 - DNA, 36 bp, Artificial Sequence
  Synthetic oligonucleotide
gtctgagccagaaagggggaaaggtcgagggtggca

SEQ ID NO: 192268 - DNA, 36 bp, Artificial Sequence
  Synthetic oligonucleotide
tgccttcgtaccatcgttgcatgaaacgcctactca

SEQ ID NO: 192269 - DNA, 36 bp, Artificial Sequence
  Synthetic oligonucleotide
gttggcccgcctaacttatggccacttgtcctctca

SEQ ID NO: 192270 - DNA, 36 bp, Artificial Sequence
  Synthetic oligonucleotide
tccgccccaagagcagtcgtatttcccaccatgtca

SEQ ID NO: 192271 - DNA, 37 bp, Artificial Sequence
  Synthetic oligonucleotide
gcagggggtgaggggcggggggcgtgctcaagaaaga

SEQ ID NO: 192272 - DNA, 37 bp, Artificial Sequence
  Synthetic oligonucleotide
gtgacgatagtgggaggggcgggtacacttggagaga

SEQ ID NO: 192273 - DNA, 37 bp, Artificial Sequence
  Synthetic oligonucleotide
tatggaggggatggaggaggtggtgtagtcggtgaga

SEQ ID NO: 192274 - DNA, 37 bp, Artificial Sequence
  Synthetic oligonucleotide
gatgggatgaatgacgggggcaagggctgaggttaga

SEQ ID NO: 192275 - DNA, 37 bp, Artificial Sequence
  Synthetic oligonucleotide
attccgtgtcaatctgtcccagcccctctccccacga

SEQ ID NO: 192276 - DNA, 35 bp, Artificial Sequence
  Synthetic oligonucleotide
gcgccccatcgtaacgtggctatctatcttcccga

SEQ ID NO: 192277 - DNA, 37 bp, Artificial Sequence
  Synthetic oligonucleotide
tcagatggagagggcgaaagtaaagtggggagtccga

SEQ ID NO: 192278 - DNA, 37 bp, Artificial Sequence
  Synthetic oligonucleotide
atgccgagtcgggcgggttcgagggtgggcgtggcga

SEQ ID NO: 192279 - DNA, 35 bp, Artificial Sequence
  Synthetic oligonucleotide
gcccaaccaccgttctttctcctcgacctagtcga

SEQ ID NO: 192280 - DNA, 37 bp, Artificial Sequence
  Synthetic oligonucleotide
tcacttgcgcattaccggtttctgtcctcgttttcga

SEQ ID NO: 192281 - DNA, 37 bp, Artificial Sequence
  Synthetic oligonucleotide
aagtgggaggaggtaaggtggcggggcatggggcgga

SEQ ID NO: 192282 - DNA, 37 bp, Artificial Sequence
  Synthetic oligonucleotide
acgccccggccggtctatatcccgctcattcttcgga

SEQ ID NO: 192283 - DNA, 37 bp, Artificial Sequence
  Synthetic oligonucleotide
gaagagggggggaagattggggtcatccgtgtaggga

SEQ ID NO: 192284 - DNA, 37 bp, Artificial Sequence
  Synthetic oligonucleotide
aaccaccacagggccattgccaccacaccatgtatga

SEQ ID NO: 192285 - DNA, 37 bp, Artificial Sequence
  Synthetic oligonucleotide
tgtacgttagcatcctctatccaaccgccttttatga

SEQ ID NO: 192286 - DNA, 37 bp, Artificial Sequence
  Synthetic oligonucleotide
tagagcaagagagggacacaaaagggggtaagactga

SEQ ID NO: 192287 - DNA, 38 bp, Artificial Sequence
  Synthetic oligonucleotide
ggggtacgaagggggtggagggcacagtagacgactga

SEQ ID NO: 192288 - DNA, 38 bp, Artificial Sequence
  Synthetic oligonucleotide
aacgaaccacgaaagtgcgagttctgacccttccctga

SEQ ID NO: 192289 - DNA, 38 bp, Artificial Sequence
  Synthetic oligonucleotide
gtagcccgcacatataagcatcaagcttctcctcctga

SEQ ID NO: 192290 - DNA, 38 bp, Artificial Sequence
  Synthetic oligonucleotide
gtgcgtgcacggtgctccttcgacctttacgttcctga

SEQ ID NO: 192291 - DNA, 38 bp, Artificial Sequence
  Synthetic oligonucleotide
agccacactgctccatgtctaatcctcttcgtcgctga

SEQ ID NO: 192292 - DNA, 36 bp, Artificial Sequence
  Synthetic oligonucleotide
atgaccccggtcccattctatacagtactcctctga

SEQ ID NO: 192293 - DNA, 38 bp, Artificial Sequence
  Synthetic oligonucleotide
gccacacagtctgcgtatccttcttctccttacagtga

SEQ ID NO: 192294 - DNA, 36 bp, Artificial Sequence
  Synthetic oligonucleotide
gtaccccaccctccgctaaaaagtttgtcctcgtga

SEQ ID NO: 192295 - DNA, 37 bp, Artificial Sequence
  Synthetic oligonucleotide
gtccgggcacgtatcccatcgcctgccccttctgtga

SEQ ID NO: 192296 - DNA, 38 bp, Artificial Sequence
  Synthetic oligonucleotide
gttactcactgagtgcactgaccccactcctctattga

SEQ ID NO: 192297 - DNA, 34 bp, Artificial Sequence
  Synthetic oligonucleotide
tgccccccccggcttagcagaaagcttcccttga

SEQ ID NO: 192298 - DNA, 38 bp, Artificial Sequence
  Synthetic oligonucleotide
cagacactccccgcccatgtccttagccgttcccttga

SEQ ID NO: 192299 - DNA, 36 bp, Artificial Sequence
  Synthetic oligonucleotide
tacatggtaccatctgcatcaacagctactccttga

SEQ ID NO: 192300 - DNA, 38 bp, Artificial Sequence
  Synthetic oligonucleotide
gccaccctcgccacgaaatcgctgtccatatcgcttga

SEQ ID NO: 192301 - DNA, 37 bp, Artificial Sequence
  Synthetic oligonucleotide
acacatcgcagtggattgtgggaagggtgggagttga

SEQ ID NO: 192302 - DNA, 38 bp, Artificial Sequence
  Synthetic oligonucleotide
tgcctcgtccgacccgcccccgacaccatgatcgttga

SEQ ID NO: 192303 - DNA, 38 bp, Artificial Sequence
  Synthetic oligonucleotide
gcagggagggtggggggcgaagagttatatggtgttga

SEQ ID NO: 192304 - DNA, 38 bp, Artificial Sequence
  Synthetic oligonucleotide
tcgagtgtcgcccagttccatcgctgatccccctttga

SEQ ID NO: 192305 - DNA, 36 bp, Artificial Sequence
  Synthetic oligonucleotide
taagcgcgagggggggggctggacaaaggataaata

SEQ ID NO: 192306 - DNA, 36 bp, Artificial Sequence
  Synthetic oligonucleotide
aacagcgcacatgccccccgccctagtcgtacgata

SEQ ID NO: 192307 - DNA, 36 bp, Artificial Sequence
  Synthetic oligonucleotide
tcaccccgctacatgcccgtatctaagctcgcccta

SEQ ID NO: 192308 - DNA, 34 bp, Artificial Sequence
  Synthetic oligonucleotide
gccccccttcgagtacactataatcacgctccta

SEQ ID NO: 192309 - DNA, 36 bp, Artificial Sequence
  Synthetic oligonucleotide
gcatctccgcccccatggattgctgactttctgcta

SEQ ID NO: 192310 - DNA, 36 bp, Artificial Sequence
  Synthetic oligonucleotide
atcaccaacatcgccacctgttcccgtttgggtcta

SEQ ID NO: 192311 - DNA, 36 bp, Artificial Sequence
  Synthetic oligonucleotide
acagtgaaagggcacgtggggggagacgcatgggta

SEQ ID NO: 192312 - DNA, 36 bp, Artificial Sequence
  Synthetic oligonucleotide
ttctgctccaccgctttcctgtagtacctgcatgta

SEQ ID NO: 192313 - DNA, 36 bp, Artificial Sequence
  Synthetic oligonucleotide
aacgggaggggcaaaaagcgtaagggggcgtgtgta

SEQ ID NO: 192314 - DNA, 36 bp, Artificial Sequence
  Synthetic oligonucleotide
tgtggggggggaggggaggggggcgactgacaatta

SEQ ID NO: 192315 - DNA, 36 bp, Artificial Sequence
  Synthetic oligonucleotide
actgctcagcctcattgtttcgcttctcctgtgtta

SEQ ID NO: 192316 - DNA, 35 bp, Artificial Sequence
  Synthetic oligonucleotide
gcctcggtcactccactcgactcctttaggcacac

SEQ ID NO: 192317 - DNA, 35 bp, Artificial Sequence
  Synthetic oligonucleotide
tgaacactcaacgtgcccaggtccattcataccac

SEQ ID NO: 192318 - DNA, 35 bp, Artificial Sequence
  Synthetic oligonucleotide
tgccagcatcccatgtctgtccgccgatcctccac

SEQ ID NO: 192319 - DNA, 35 bp, Artificial Sequence
  Synthetic oligonucleotide
tggacacggtcaccgaactatcctgccggtctcac

SEQ ID NO: 192320 - DNA, 35 bp, Artificial Sequence
  Synthetic oligonucleotide
tatcgccgacggcattgtctcttggccgtccctac

SEQ ID NO: 192321 - DNA, 35 bp, Artificial Sequence
  Synthetic oligonucleotide
taaaccgtgcccccagctgtcgcacagtcaacacc

SEQ ID NO: 192322 - DNA, 35 bp, Artificial Sequence
  Synthetic oligonucleotide
tccttccaccagtcaatcgctgaccttgcgcgacc

SEQ ID NO: 192323 - DNA, 35 bp, Artificial Sequence
  Synthetic oligonucleotide
tccctcaccgtcctctcgtctgactatccggtacc

SEQ ID NO: 192324 - DNA, 35 bp, Artificial Sequence
  Synthetic oligonucleotide
gccagaacacgttttctacttaggtacattccccc

SEQ ID NO: 192325 - DNA, 35 bp, Artificial Sequence
  Synthetic oligonucleotide
gtcgcctccgagttgttcacctggtcgccctcccc

SEQ ID NO: 192326 - DNA, 35 bp, Artificial Sequence
  Synthetic oligonucleotide
tgccactacgaggcttgaaactcagttcgctcccc

SEQ ID NO: 192327 - DNA, 35 bp, Artificial Sequence
  Synthetic oligonucleotide
agtgcatgctgtagtggcccaaactcccgcctccc

SEQ ID NO: 192328 - DNA, 35 bp, Artificial Sequence
  Synthetic oligonucleotide
tcgtggtgcgttcgcttcattttgtctgttctccc

SEQ ID NO: 192329 - DNA, 35 bp, Artificial Sequence
  Synthetic oligonucleotide
tccaccgttatagcatttatctttggtcctttgcc

SEQ ID NO: 192330 - DNA, 35 bp, Artificial Sequence
  Synthetic oligonucleotide
ggggcgcaacgtcatggcctcgtcgttccccatcc

SEQ ID NO: 192331 - DNA, 35 bp, Artificial Sequence
  Synthetic oligonucleotide
actgtccagggtcctgaccagcctaagctccatcc

SEQ ID NO: 192332 - DNA, 35 bp, Artificial Sequence
  Synthetic oligonucleotide
gtgcaaccgccctaatatgcacgcgataccactcc

SEQ ID NO: 192333 - DNA, 35 bp, Artificial Sequence
  Synthetic oligonucleotide
tgaggggtcagccagttatccttgtccccagctcc

SEQ ID NO: 192334 - DNA, 35 bp, Artificial Sequence
  Synthetic oligonucleotide
gagccgctgcaggcattccccccgaaccgtcgtcc

SEQ ID NO: 192335 - DNA, 35 bp, Artificial Sequence
  Synthetic oligonucleotide
tccaccgctcggccttgccataccgtacttcgtcc

SEQ ID NO: 192336 - DNA, 35 bp, Artificial Sequence
  Synthetic oligonucleotide
gtccactaaccaactccctgtcttgagccacttcc

SEQ ID NO: 192337 - DNA, 35 bp, Artificial Sequence
  Synthetic oligonucleotide
gctgttcaaacgcggaggcacttttcgccacttcc

SEQ ID NO: 192338 - DNA, 35 bp, Artificial Sequence
  Synthetic oligonucleotide
tcacaagcaatgcccttcgctgatcatgcccttcc

SEQ ID NO: 192339 - DNA, 35 bp, Artificial Sequence
  Synthetic oligonucleotide
gccccgcccaccttggttctacagtactaatacgc

SEQ ID NO: 192340 - DNA, 35 bp, Artificial Sequence
  Synthetic oligonucleotide
atccgcaactccatcatctatattacagctcgcgc

SEQ ID NO: 192341 - DNA, 35 bp, Artificial Sequence
  Synthetic oligonucleotide
gcccctactccgccatcatctctgatccccctcgc

SEQ ID NO: 192342 - DNA, 35 bp, Artificial Sequence
  Synthetic oligonucleotide
aacaccttctgacctgtctattatcttatgttcgc

SEQ ID NO: 192343 - DNA, 35 bp, Artificial Sequence
  Synthetic oligonucleotide
ggatcgcactaccatctccccgtggcacctctggc

SEQ ID NO: 192344 - DNA, 35 bp, Artificial Sequence
  Synthetic oligonucleotide
attgtgcggttgcgcttcatctcgcctgtccatgc

SEQ ID NO: 192345 - DNA, 35 bp, Artificial Sequence
  Synthetic oligonucleotide
gcaagctgccgtgtgccatttgccatctctcatgc

SEQ ID NO: 192346 - DNA, 35 bp, Artificial Sequence
  Synthetic oligonucleotide
tggtcctccagcctgcgccttcctgcagtccttgc

SEQ ID NO: 192347 - DNA, 35 bp, Artificial Sequence
  Synthetic oligonucleotide
acccgcaacgtcccgctagtcgtgggccctcaatc

SEQ ID NO: 192348 - DNA, 35 bp, Artificial Sequence
  Synthetic oligonucleotide
tacgacgcacagttatacatcccttttcagccatc

SEQ ID NO: 192349 - DNA, 35 bp, Artificial Sequence
  Synthetic oligonucleotide
acagactcgcgtgcaacgtaccgccttatctcatc

SEQ ID NO: 192350 - DNA, 35 bp, Artificial Sequence
  Synthetic oligonucleotide
gtgggtctgctgccctttctcctgcctgttcactc

SEQ ID NO: 192351 - DNA, 35 bp, Artificial Sequence
  Synthetic oligonucleotide
tatcccccgatccggttgaatactcgcatatgctc

SEQ ID NO: 192352 - DNA, 35 bp, Artificial Sequence
  Synthetic oligonucleotide
tccaccgacccattgcacctctcttaaccggtctc

SEQ ID NO: 192353 - DNA, 35 bp, Artificial Sequence
  Synthetic oligonucleotide
aacaccttcagctcgtcctcctttccctctttctc

SEQ ID NO: 192354 - DNA, 29 bp, Artificial Sequence
  Synthetic oligonucleotide
gccaactcaacgtgcgactactttttctc

SEQ ID NO: 192355 - DNA, 35 bp, Artificial Sequence
  Synthetic oligonucleotide
tgagtacacctgcagcacattcatcgttcgttgtc

SEQ ID NO: 192356 - DNA, 35 bp, Artificial Sequence
  Synthetic oligonucleotide
gggggacgggtggtgggggggtaatcgagtgattc

SEQ ID NO: 192357 - DNA, 35 bp, Artificial Sequence
  Synthetic oligonucleotide
aaccgccctccgcttggtcgacagttatgtccttc

SEQ ID NO: 192358 - DNA, 35 bp, Artificial Sequence
  Synthetic oligonucleotide
gtatccagcccctctccgaactaagtagtcttttc

SEQ ID NO: 192359 - DNA, 35 bp, Artificial Sequence
  Synthetic oligonucleotide
gagagggggggaacagccaagggggtaaatgggag

SEQ ID NO: 192360 - DNA, 35 bp, Artificial Sequence
  Synthetic oligonucleotide
gaaacagagcgaagggggggcgcacgtgcgaaacg

SEQ ID NO: 192361 - DNA, 35 bp, Artificial Sequence
  Synthetic oligonucleotide
gatatcgccggtgttttctgcgatgccgttccccg

SEQ ID NO: 192362 - DNA, 35 bp, Artificial Sequence
  Synthetic oligonucleotide
gcctccgccccgctatctatgtcacccggactccg

SEQ ID NO: 192363 - DNA, 35 bp, Artificial Sequence
  Synthetic oligonucleotide
aaacacgtccatatggcgctcgtccaactccctcg

SEQ ID NO: 192364 - DNA, 35 bp, Artificial Sequence
  Synthetic oligonucleotide
gaacggcctccaattgtgactatgttccttcttcg

SEQ ID NO: 192365 - DNA, 35 bp, Artificial Sequence
  Synthetic oligonucleotide
aactacccactcccttagccgtgcctgacctacgg

SEQ ID NO: 192366 - DNA, 35 bp, Artificial Sequence
  Synthetic oligonucleotide
tacaggggtagggcgggtggcaactgaactgaggg

SEQ ID NO: 192367 - DNA, 35 bp, Artificial Sequence
  Synthetic oligonucleotide
ggagaggacggggagggggttgctattcaaagggg

SEQ ID NO: 192368 - DNA, 35 bp, Artificial Sequence
  Synthetic oligonucleotide
gtagggcccgtagcggcacataggagggagggggg

SEQ ID NO: 192369 - DNA, 35 bp, Artificial Sequence
  Synthetic oligonucleotide
aagagcggccaatggaacgggaggatagggagtgg

SEQ ID NO: 192370 - DNA, 35 bp, Artificial Sequence
  Synthetic oligonucleotide
gccaatagcgcgttcactcgtaacgacccaccctg

SEQ ID NO: 192371 - DNA, 35 bp, Artificial Sequence
  Synthetic oligonucleotide
gaacccacccttcatttggtcttttatctgccctg

SEQ ID NO: 192372 - DNA, 35 bp, Artificial Sequence
  Synthetic oligonucleotide
ttccggccgaccgttgccgatttgtcacctctctg

SEQ ID NO: 192373 - DNA, 35 bp, Artificial Sequence
  Synthetic oligonucleotide
tactccacacgtctctctcgtatgtattccccgtg

SEQ ID NO: 192374 - DNA, 35 bp, Artificial Sequence
  Synthetic oligonucleotide
acacaccacctaacatgttcgccgtttcgctcttg

SEQ ID NO: 192375 - DNA, 35 bp, Artificial Sequence
  Synthetic oligonucleotide
tgattaccccgccccgtgagacacatccgtctcat

SEQ ID NO: 192376 - DNA, 35 bp, Artificial Sequence
  Synthetic oligonucleotide
gcccccacactggcttgttaccttgaaccttgact

SEQ ID NO: 192377 - DNA, 35 bp, Artificial Sequence
  Synthetic oligonucleotide
tgcaacaacaatccacatcgttcgggggcttacct

SEQ ID NO: 192378 - DNA, 35 bp, Artificial Sequence
  Synthetic oligonucleotide
aagggcggagggcatggggaggtaaacgcgggcct

SEQ ID NO: 192379 - DNA, 35 bp, Artificial Sequence
  Synthetic oligonucleotide
gaccgcgctgcagtgcacctcctactacgtgtcct

SEQ ID NO: 192380 - DNA, 35 bp, Artificial Sequence
  Synthetic oligonucleotide
gataccagatccggctgtctctctgggctcttcct

SEQ ID NO: 192381 - DNA, 35 bp, Artificial Sequence
  Synthetic oligonucleotide
gaccgatcacccgtttttcttactgttcctcagct

SEQ ID NO: 192382 - DNA, 35 bp, Artificial Sequence
  Synthetic oligonucleotide
tacgagctgtgaactgttgctccgccttccccgct

SEQ ID NO: 192383 - DNA, 35 bp, Artificial Sequence
  Synthetic oligonucleotide
gcgctcaccatcacgttccctgtgcgttccctgct

SEQ ID NO: 192384 - DNA, 35 bp, Artificial Sequence
  Synthetic oligonucleotide
agtgcacgtcagcctacaccttgtccaccgttcgt

SEQ ID NO: 192385 - DNA, 35 bp, Artificial Sequence
  Synthetic oligonucleotide
tgacagaaggggggcgagggggccaatgtgggggt

SEQ ID NO: 192386 - DNA, 35 bp, Artificial Sequence
  Synthetic oligonucleotide
tagtgtcacgatcaggagggttaggggggtggggt

SEQ ID NO: 192387 - DNA, 35 bp, Artificial Sequence
  Synthetic oligonucleotide
tcatgcgtccaacgccattttcgtcttctcttggt

SEQ ID NO: 192388 - DNA, 35 bp, Artificial Sequence
  Synthetic oligonucleotide
tgcacctcgctctttttctcgtacgatgctcctgt

SEQ ID NO: 192389 - DNA, 35 bp, Artificial Sequence
  Synthetic oligonucleotide
ttgtagcgcttggtctagtcttctcgtgctctctt

SEQ ID NO: 192390 - DNA, 34 bp, Artificial Sequence
  Synthetic oligonucleotide
tccgacgcgactgtttcttcgcttcatggttgtt

SEQ ID NO: 192391 - DNA, 35 bp, Artificial Sequence
  Synthetic oligonucleotide
acgacgctgtcctccgtccgttcctatggtttgtt

SEQ ID NO: 192392 - DNA, 35 bp, Artificial Sequence
  Synthetic oligonucleotide
actgccggtcacctttacgatttccacgggccttt

SEQ ID NO: 192393 - DNA, 35 bp, Artificial Sequence
  Synthetic oligonucleotide
gcacagtcctcattcgttatcccgctcctcgcttt

SEQ ID NO: 192394 - DNA, 35 bp, Artificial Sequence
  Synthetic oligonucleotide
gcttcccacacctcagcagttgcgtaacgctcttt

SEQ ID NO: 192395 - DNA, 35 bp, Artificial Sequence
  Synthetic oligonucleotide
accgacaccccgatagtgcttactgtccgcatttt

SEQ ID NO: 192396 - DNA, 35 bp, Artificial Sequence
  Synthetic oligonucleotide
gacgcaaagagccgcctcccgccccgtttcgaaaa

SEQ ID NO: 192397 - DNA, 36 bp, Artificial Sequence
  Synthetic oligonucleotide
agcctccccgctcccctggtcttagttgttagcaaa

SEQ ID NO: 192398 - DNA, 35 bp, Artificial Sequence
  Synthetic oligonucleotide
gccccatcgcatacccccgtaccctagttctacaa

SEQ ID NO: 192399 - DNA, 36 bp, Artificial Sequence
  Synthetic oligonucleotide
gaaaccgcccttggtccctaagtctttgcttatcaa

SEQ ID NO: 192400 - DNA, 36 bp, Artificial Sequence
  Synthetic oligonucleotide
tggtgcttcccatctatgcggcagtccttcttcaca

SEQ ID NO: 192401 - DNA, 36 bp, Artificial Sequence
  Synthetic oligonucleotide
gcccacattgtgctggttttcattgctccccgtaca

SEQ ID NO: 192402 - DNA, 36 bp, Artificial Sequence
  Synthetic oligonucleotide
acgcaagcctcggtatcgcactcaccggttatccca

SEQ ID NO: 192403 - DNA, 31 bp, Artificial Sequence
  Synthetic oligonucleotide
acttccccggcggattttcatgcccttccca

SEQ ID NO: 192404 - DNA, 35 bp, Artificial Sequence
  Synthetic oligonucleotide
gccacacccgcatcactggctacctctcggtgcca

SEQ ID NO: 192405 - DNA, 35 bp, Artificial Sequence
  Synthetic oligonucleotide
ttctgtgtgcaggtcccgctaccttcccttctcca

SEQ ID NO: 192406 - DNA, 35 bp, Artificial Sequence
  Synthetic oligonucleotide
tctgggggacgtacgggggcgcgggggagagtcca

SEQ ID NO: 192407 - DNA, 36 bp, Artificial Sequence
  Synthetic oligonucleotide
gatcacgtccccgtagtcgccattgctgtccgtcca

SEQ ID NO: 192408 - DNA, 36 bp, Artificial Sequence
  Synthetic oligonucleotide
acgaccgcatcctcccgccataaagccattgtcgca

SEQ ID NO: 192409 - DNA, 35 bp, Artificial Sequence
  Synthetic oligonucleotide
tagtgcagtgcttccgtttttttctgcgcctatca

SEQ ID NO: 192410 - DNA, 36 bp, Artificial Sequence
  Synthetic oligonucleotide
aacttgtgcagccttcacaatggccttgctccctca

SEQ ID NO: 192411 - DNA, 36 bp, Artificial Sequence
  Synthetic oligonucleotide
ttgtacccgcctcctattagtatgttccacgcttca

SEQ ID NO: 192412 - DNA, 37 bp, Artificial Sequence
  Synthetic oligonucleotide
tattcgccacagctgcgttaagctcccccgccgaaga

SEQ ID NO: 192413 - DNA, 37 bp, Artificial Sequence
  Synthetic oligonucleotide
aagttgttgcgggcaagggagggtgggccagcagaga

SEQ ID NO: 192414 - DNA, 37 bp, Artificial Sequence
  Synthetic oligonucleotide
tcccgcctcccgatcctgcttacgccctgccccccga

SEQ ID NO: 192415 - DNA, 37 bp, Artificial Sequence
  Synthetic oligonucleotide
tcaagtcacccaatgcgtctttagccttcttccccga

SEQ ID NO: 192416 - DNA, 37 bp, Artificial Sequence
  Synthetic oligonucleotide
acgacctgcttgtccttctccgcttatgagccgccga

SEQ ID NO: 192417 - DNA, 36 bp, Artificial Sequence
  Synthetic oligonucleotide
acgctccctcccgtacgttatatcatacttttccga

SEQ ID NO: 192418 - DNA, 37 bp, Artificial Sequence
  Synthetic oligonucleotide
gtccaccccgcattttgcatagccgttcctacgtcga

SEQ ID NO: 192419 - DNA, 37 bp, Artificial Sequence
  Synthetic oligonucleotide
tcgcatatctgccgtgaaccgccccagtacccttcga

SEQ ID NO: 192420 - DNA, 37 bp, Artificial Sequence
  Synthetic oligonucleotide
aacgaggcggaaagtttgtagggggtggggtgaagga

SEQ ID NO: 192421 - DNA, 35 bp, Artificial Sequence
  Synthetic oligonucleotide
gctcctcacaccgcataccgcccttgctcgcagga

SEQ ID NO: 192422 - DNA, 37 bp, Artificial Sequence
  Synthetic oligonucleotide
gagggggggaggataggtaagcagtcccggaaacgga

SEQ ID NO: 192423 - DNA, 37 bp, Artificial Sequence
  Synthetic oligonucleotide
tgagcctgcctccactctgtctagctccccccccgga

SEQ ID NO: 192424 - DNA, 37 bp, Artificial Sequence
  Synthetic oligonucleotide
tgtacacgaacgggctggggaagggggcgggaaggga

SEQ ID NO: 192425 - DNA, 37 bp, Artificial Sequence
  Synthetic oligonucleotide
taagcgtgggtggacacggggggggtaatatcaggga

SEQ ID NO: 192426 - DNA, 35 bp, Artificial Sequence
  Synthetic oligonucleotide
gagggcgggggggcgttagcagtagggtagcggga

SEQ ID NO: 192427 - DNA, 37 bp, Artificial Sequence
  Synthetic oligonucleotide
tcaggaggagacgcggaagggggtggtgccatgggga

SEQ ID NO: 192428 - DNA, 37 bp, Artificial Sequence
  Synthetic oligonucleotide
tgtgacgttcgcctgcccatgctccatcttatctgga

SEQ ID NO: 192429 - DNA, 37 bp, Artificial Sequence
  Synthetic oligonucleotide
gccaggggccgattaatgggaggggagtgacggtgga

SEQ ID NO: 192430 - DNA, 37 bp, Artificial Sequence
  Synthetic oligonucleotide
gtggggtcaagagaggatagaaggggatgtgggtgga

SEQ ID NO: 192431 - DNA, 36 bp, Artificial Sequence
  Synthetic oligonucleotide
agagaagcaggagggcgaggacgtgaaggatgtgga

SEQ ID NO: 192432 - DNA, 36 bp, Artificial Sequence
  Synthetic oligonucleotide
taccccccccacgatcttacgcgtagtctttttgga

SEQ ID NO: 192433 - DNA, 37 bp, Artificial Sequence
  Synthetic oligonucleotide
gaccagggtgggcggtggtgtgacgaggagggaatga

SEQ ID NO: 192434 - DNA, 38 bp, Artificial Sequence
  Synthetic oligonucleotide
tgtggcggggttcgagggaaaaatggaggggcggatga

SEQ ID NO: 192435 - DNA, 38 bp, Artificial Sequence
  Synthetic oligonucleotide
tcatgctccgctgacctattgcccgttccccgctatga

SEQ ID NO: 192436 - DNA, 36 bp, Artificial Sequence
  Synthetic oligonucleotide
tgcccgacttccgattactactcgccccactcctga

SEQ ID NO: 192437 - DNA, 38 bp, Artificial Sequence
  Synthetic oligonucleotide
ggagccatcactttactcctgcccctgtcctgtgctga

SEQ ID NO: 192438 - DNA, 38 bp, Artificial Sequence
  Synthetic oligonucleotide
tggggtggaagggtgggaaacggggtcgccagatctga

SEQ ID NO: 192439 - DNA, 38 bp, Artificial Sequence
  Synthetic oligonucleotide
gctgctggcaaagaggggggtgctggagaggggagtga

SEQ ID NO: 192440 - DNA, 37 bp, Artificial Sequence
  Synthetic oligonucleotide
gcgcacagccttgaaaatggaccctccccgcccgtga

SEQ ID NO: 192441 - DNA, 37 bp, Artificial Sequence
  Synthetic oligonucleotide
ggggagggaatggtggctataactgggtgggccgtga

SEQ ID NO: 192442 - DNA, 38 bp, Artificial Sequence
  Synthetic oligonucleotide
ggggctggccggaaatgcgcatactgtggggggggtga

SEQ ID NO: 192443 - DNA, 38 bp, Artificial Sequence
  Synthetic oligonucleotide
aagtcacgatccgccgcctccccaccatcactgtgtga

SEQ ID NO: 192444 - DNA, 37 bp, Artificial Sequence
  Synthetic oligonucleotide
agccgaaccagcttaccctgtaccatctaccttgtga

SEQ ID NO: 192445 - DNA, 38 bp, Artificial Sequence
  Synthetic oligonucleotide
gtggtccgcacgggtgggaggatgagggcaattattga

SEQ ID NO: 192446 - DNA, 37 bp, Artificial Sequence
  Synthetic oligonucleotide
tatgagaccggggtaggggtacggaggcgagggttga

SEQ ID NO: 192447 - DNA, 35 bp, Artificial Sequence
  Synthetic oligonucleotide
aagcgcggcccgctgccatcccccacacgctttga

SEQ ID NO: 192448 - DNA, 36 bp, Artificial Sequence
  Synthetic oligonucleotide
ttggagagcgggtgggtgggtagaacatgccaaata

SEQ ID NO: 192449 - DNA, 37 bp, Artificial Sequence
  Synthetic oligonucleotide
atacatccctcctctgctgtggcccctgtaacctata

SEQ ID NO: 192450 - DNA, 35 bp, Artificial Sequence
  Synthetic oligonucleotide
ttcgtgccatccaactgcttatccgtttatcacta

SEQ ID NO: 192451 - DNA, 36 bp, Artificial Sequence
  Synthetic oligonucleotide
agttcgccccccttgtgatctacagctctgttacta

SEQ ID NO: 192452 - DNA, 36 bp, Artificial Sequence
  Synthetic oligonucleotide
ttcctccgctcgcatctcccggctccaggattccta

SEQ ID NO: 192453 - DNA, 36 bp, Artificial Sequence
  Synthetic oligonucleotide
aataccgccccagaactgcccgccacccggttccta

SEQ ID NO: 192454 - DNA, 36 bp, Artificial Sequence
  Synthetic oligonucleotide
ttgctgtgcacttgcgcttacctcccacataggcta

SEQ ID NO: 192455 - DNA, 36 bp, Artificial Sequence
  Synthetic oligonucleotide
taatgcgcggcatgtctgttctctctccatcccgta

SEQ ID NO: 192456 - DNA, 35 bp, Artificial Sequence
  Synthetic oligonucleotide
gtgcaggaggagggggaccgggacacgccatcgta

SEQ ID NO: 192457 - DNA, 35 bp, Artificial Sequence
  Synthetic oligonucleotide
accactacaccatcgctgataaaggtttcttcgta

SEQ ID NO: 192458 - DNA, 36 bp, Artificial Sequence
  Synthetic oligonucleotide
gcgactcgctcctctgaccgcattacccacctgtta

SEQ ID NO: 192459 - DNA, 35 bp, Artificial Sequence
  Synthetic oligonucleotide
tgacgctaacggcgccttcccgagttccctttaac

SEQ ID NO: 192460 - DNA, 35 bp, Artificial Sequence
  Synthetic oligonucleotide
aatcagccaccgtgccttaacggacgcttcaccac

SEQ ID NO: 192461 - DNA, 35 bp, Artificial Sequence
  Synthetic oligonucleotide
tagaccctgtcacacttcacgcattatacacccac

SEQ ID NO: 192462 - DNA, 35 bp, Artificial Sequence
  Synthetic oligonucleotide
ttggggggcgggctggtagcacgagttggggccac

SEQ ID NO: 192463 - DNA, 35 bp, Artificial Sequence
  Synthetic oligonucleotide
atatcgcgctgacacttatccttcgtttatgccac

SEQ ID NO: 192464 - DNA, 35 bp, Artificial Sequence
  Synthetic oligonucleotide
gtactgccgcggtaaggcgcgaatcatctctccac

SEQ ID NO: 192465 - DNA, 35 bp, Artificial Sequence
  Synthetic oligonucleotide
accctcagccgtcgctactccttccccgcaggcac

SEQ ID NO: 192466 - DNA, 35 bp, Artificial Sequence
  Synthetic oligonucleotide
tctacaagcggagtgggctccatcaaccgtactac

SEQ ID NO: 192467 - DNA, 35 bp, Artificial Sequence
  Synthetic oligonucleotide
tactgctggaacactctagcacccagggccctacc

SEQ ID NO: 192468 - DNA, 35 bp, Artificial Sequence
  Synthetic oligonucleotide
gaccaccatccggtttttcccgtaattacgcaccc

SEQ ID NO: 192469 - DNA, 36 bp, Artificial Sequence
  Synthetic oligonucleotide
ggtgcactcacactcataacgttgccacccctaccc

SEQ ID NO: 192470 - DNA, 35 bp, Artificial Sequence
  Synthetic oligonucleotide
tctgtccgtgccatgggaactctcactcttcgccc

SEQ ID NO: 192471 - DNA, 35 bp, Artificial Sequence
  Synthetic oligonucleotide
tcccgtccactaactgcccgctgaatcttctgccc

SEQ ID NO: 192472 - DNA, 35 bp, Artificial Sequence
  Synthetic oligonucleotide
ttgctcactgtcgcttgagtcgccgagcccttccc

SEQ ID NO: 192473 - DNA, 35 bp, Artificial Sequence
  Synthetic oligonucleotide
aactggcccgtagcacgttccatcctgtactagcc

SEQ ID NO: 192474 - DNA, 35 bp, Artificial Sequence
  Synthetic oligonucleotide
ttcaactccgctacagagccttgtccttatgcgcc

SEQ ID NO: 192475 - DNA, 35 bp, Artificial Sequence
  Synthetic oligonucleotide
gagtgatgtcagcgtattgcatcgcctccgtctcc

SEQ ID NO: 192476 - DNA, 35 bp, Artificial Sequence
  Synthetic oligonucleotide
tcctgccgaaggcactttccttatgtaaacattcc

SEQ ID NO: 192477 - DNA, 35 bp, Artificial Sequence
  Synthetic oligonucleotide
tctggaaccccatctcctccgaccttgcgggacgc

SEQ ID NO: 192478 - DNA, 35 bp, Artificial Sequence
  Synthetic oligonucleotide
gtgctgtcccttctatccggtttgtaactctccgc

SEQ ID NO: 192479 - DNA, 35 bp, Artificial Sequence
  Synthetic oligonucleotide
tgtgtcccccgctttgttctaccgaccgattccgc

SEQ ID NO: 192480 - DNA, 35 bp, Artificial Sequence
  Synthetic oligonucleotide
agcccccgtccccggcattcccttcgccgcctcgc

SEQ ID NO: 192481 - DNA, 35 bp, Artificial Sequence
  Synthetic oligonucleotide
tagcaacctcgatccgtgatcactcccctgctggc

SEQ ID NO: 192482 - DNA, 35 bp, Artificial Sequence
  Synthetic oligonucleotide
aagtacgccgctttgttaaccctctcctctcctgc

SEQ ID NO: 192483 - DNA, 35 bp, Artificial Sequence
  Synthetic oligonucleotide
gcctcgctcattgcccagcggacccatctatctgc

SEQ ID NO: 192484 - DNA, 35 bp, Artificial Sequence
  Synthetic oligonucleotide
gtttcgcggtgtgtcgaccgttctgctgcccaatc

SEQ ID NO: 192485 - DNA, 35 bp, Artificial Sequence
  Synthetic oligonucleotide
gacgtcgcagtccctacaccctggttcatcaactc

SEQ ID NO: 192486 - DNA, 35 bp, Artificial Sequence
  Synthetic oligonucleotide
accagtgcctttacatgatatgcgcctcgctcctc

SEQ ID NO: 192487 - DNA, 35 bp, Artificial Sequence
  Synthetic oligonucleotide
tatccgcaccctcccacactgctccggcgttcctc

SEQ ID NO: 192488 - DNA, 35 bp, Artificial Sequence
  Synthetic oligonucleotide
atggggacgctgcttgaccactgacgttacatctc

SEQ ID NO: 192489 - DNA, 35 bp, Artificial Sequence
  Synthetic oligonucleotide
gccccaccgccgatgatcacctttgtttgtccgtc

SEQ ID NO: 192490 - DNA, 35 bp, Artificial Sequence
  Synthetic oligonucleotide
gtatcgcatcccccagctgcgttttgagtcccttc

SEQ ID NO: 192491 - DNA, 35 bp, Artificial Sequence
  Synthetic oligonucleotide
gcgacccacgctccgacccgctacatcgcgccttc

SEQ ID NO: 192492 - DNA, 35 bp, Artificial Sequence
  Synthetic oligonucleotide
agaccggtccttcgcatcctccaactttctccttc

SEQ ID NO: 192493 - DNA, 35 bp, Artificial Sequence
  Synthetic oligonucleotide
tgccactacctagcggaggcctcctttcgatcttc

SEQ ID NO: 192494 - DNA, 35 bp, Artificial Sequence
  Synthetic oligonucleotide
aggtcggtcctcaggttacaccaatcacacctttc

SEQ ID NO: 192495 - DNA, 35 bp, Artificial Sequence
  Synthetic oligonucleotide
gttgacgcggcgtagctatgccttctcttggtttc

SEQ ID NO: 192496 - DNA, 35 bp, Artificial Sequence
  Synthetic oligonucleotide
tgccatagccgccttgaaaggtattcccccgcacg

SEQ ID NO: 192497 - DNA, 35 bp, Artificial Sequence
  Synthetic oligonucleotide
actctccttccctctgtgccccgatcaccaagacg

SEQ ID NO: 192498 - DNA, 35 bp, Artificial Sequence
  Synthetic oligonucleotide
ggggagagtaagtaggaggagaggggtgtagtgcg

SEQ ID NO: 192499 - DNA, 35 bp, Artificial Sequence
  Synthetic oligonucleotide
tgactttcccccacctctcacggtccgcgcttgcg

SEQ ID NO: 192500 - DNA, 35 bp, Artificial Sequence
  Synthetic oligonucleotide
tgtcaaccggcccacttgcttttcatcgcgattcg

SEQ ID NO: 192501 - DNA, 35 bp, Artificial Sequence
  Synthetic oligonucleotide
tgaaccattcgtaccatcgtacacagctctcttcg

SEQ ID NO: 192502 - DNA, 35 bp, Artificial Sequence
  Synthetic oligonucleotide
taagcgcaagagggatgtaggggggtgagtgaagg

SEQ ID NO: 192503 - DNA, 35 bp, Artificial Sequence
  Synthetic oligonucleotide
cacgcccccactcatttcctgacaaaacagcacgg

SEQ ID NO: 192504 - DNA, 35 bp, Artificial Sequence
  Synthetic oligonucleotide
acgactcccatccagtgctagtgtaccttccgcgg

SEQ ID NO: 192505 - DNA, 35 bp, Artificial Sequence
  Synthetic oligonucleotide
tcattgatgcagatatcgcgcggagggggggaggg

SEQ ID NO: 192506 - DNA, 35 bp, Artificial Sequence
  Synthetic oligonucleotide
aatgcgggttgggagggcatattggagatgtaggg

SEQ ID NO: 192507 - DNA, 35 bp, Artificial Sequence
  Synthetic oligonucleotide
acagcaagtcgggtagggtgggagtacctttcggg

SEQ ID NO: 192508 - DNA, 35 bp, Artificial Sequence
  Synthetic oligonucleotide
gaccgatatattggtgagggggattgaggaggggg

SEQ ID NO: 192509 - DNA, 36 bp, Artificial Sequence
  Synthetic oligonucleotide
tagtgcgagctcagctaactgttgagggcggggggg

SEQ ID NO: 192510 - DNA, 35 bp, Artificial Sequence
  Synthetic oligonucleotide
tgctcgcccccatgttgcactacccgttacagtgg

SEQ ID NO: 192511 - DNA, 35 bp, Artificial Sequence
  Synthetic oligonucleotide
acagtactgcgcggtcaatcgatccccgacccctg

SEQ ID NO: 192512 - DNA, 35 bp, Artificial Sequence
  Synthetic oligonucleotide
gatgcgacgctctctctacggttttggcccccttg

SEQ ID NO: 192513 - DNA, 35 bp, Artificial Sequence
  Synthetic oligonucleotide
ttgtgccaccctcacctgatgcgaagtaatccttg

SEQ ID NO: 192514 - DNA, 35 bp, Artificial Sequence
  Synthetic oligonucleotide
gtggggggcaaaggcggaggcttggaagggaaaat

SEQ ID NO: 192515 - DNA, 35 bp, Artificial Sequence
  Synthetic oligonucleotide
agatggataggtggggacatgggaagtgaggagat

SEQ ID NO: 192516 - DNA, 35 bp, Artificial Sequence
  Synthetic oligonucleotide
taaagacggagggggggaaaagagtggttagcact

SEQ ID NO: 192517 - DNA, 35 bp, Artificial Sequence
  Synthetic oligonucleotide
gtacaccgttccgcactttactttcctgccggact

SEQ ID NO: 192518 - DNA, 35 bp, Artificial Sequence
  Synthetic oligonucleotide
tcgtcgtggccactgcgtaacgctccatcacacct

SEQ ID NO: 192519 - DNA, 35 bp, Artificial Sequence
  Synthetic oligonucleotide
gtgaccacccccttgatgattgatgcgcacaccct

SEQ ID NO: 192520 - DNA, 35 bp, Artificial Sequence
  Synthetic oligonucleotide
gcaacctcctggtgccgtgccatttgcccttccct

SEQ ID NO: 192521 - DNA, 35 bp, Artificial Sequence
  Synthetic oligonucleotide
ttccgccaccgccaccgccccattaagccacgcct

SEQ ID NO: 192522 - DNA, 35 bp, Artificial Sequence
  Synthetic oligonucleotide
ggacaggcctcggtctatccttctcgtcgttgcct

SEQ ID NO: 192523 - DNA, 34 bp, Artificial Sequence
  Synthetic oligonucleotide
ttaacgaagccctccttgtagttacacctttcct

SEQ ID NO: 192524 - DNA, 35 bp, Artificial Sequence
  Synthetic oligonucleotide
aaatgcgccgaaccatcttgagtacctttcccgct

SEQ ID NO: 192525 - DNA, 35 bp, Artificial Sequence
  Synthetic oligonucleotide
tcagaatgtcacatcccgccttccgtattgtcgct

SEQ ID NO: 192526 - DNA, 35 bp, Artificial Sequence
  Synthetic oligonucleotide
gtggagcaaggtgttaggatggagggaggcacggt

SEQ ID NO: 192527 - DNA, 35 bp, Artificial Sequence
  Synthetic oligonucleotide
tagatgcttcccgcgcgcgcttcaccccacctggt

SEQ ID NO: 192528 - DNA, 35 bp, Artificial Sequence
  Synthetic oligonucleotide
acatccacggttgttcgtttaccacctttttttgt

SEQ ID NO: 192529 - DNA, 35 bp, Artificial Sequence
  Synthetic oligonucleotide
acactaccttcagaccgtttctctaccaccacatt

SEQ ID NO: 192530 - DNA, 35 bp, Artificial Sequence
  Synthetic oligonucleotide
gttgatcgccggacttatgattctatcgatacctt

SEQ ID NO: 192531 - DNA, 35 bp, Artificial Sequence
  Synthetic oligonucleotide
acccgacctccgcctcctggatccctacgagcctt

SEQ ID NO: 192532 - DNA, 35 bp, Artificial Sequence
  Synthetic oligonucleotide
gtcgcaagcactgttccgcactccaatgccgcctt

SEQ ID NO: 192533 - DNA, 35 bp, Artificial Sequence
  Synthetic oligonucleotide
actccatggcgccgttttctatccggttgcgcctt

SEQ ID NO: 192534 - DNA, 35 bp, Artificial Sequence
  Synthetic oligonucleotide
tagcaggtcgccgcttagctgacgctcacttcctt

SEQ ID NO: 192535 - DNA, 35 bp, Artificial Sequence
  Synthetic oligonucleotide
gtacgaccaggcgccctgtacccagtttaccgctt

SEQ ID NO: 192536 - DNA, 35 bp, Artificial Sequence
  Synthetic oligonucleotide
tcctatccacccgggcattgatccgatatgtgctt

SEQ ID NO: 192537 - DNA, 35 bp, Artificial Sequence
  Synthetic oligonucleotide
atgcgacctcccgtaacgctgtcccaccctggttt

SEQ ID NO: 192538 - DNA, 35 bp, Artificial Sequence
  Synthetic oligonucleotide
gaaccacgtcctccctgtcatcgttcagttggaaa

SEQ ID NO: 192539 - DNA, 36 bp, Artificial Sequence
  Synthetic oligonucleotide
actcagtgaccatttcccgtctttccagcgtgacaa

SEQ ID NO: 192540 - DNA, 36 bp, Artificial Sequence
  Synthetic oligonucleotide
atgctcgcttcactcccgtcgtatcacttcgcccaa

SEQ ID NO: 192541 - DNA, 36 bp, Artificial Sequence
  Synthetic oligonucleotide
gaacggggaggggttcgtgggcggtaatcagggcaa

SEQ ID NO: 192542 - DNA, 36 bp, Artificial Sequence
  Synthetic oligonucleotide
atgcagacctcttgctcattgccccacgctattcaa

SEQ ID NO: 192543 - DNA, 36 bp, Artificial Sequence
  Synthetic oligonucleotide
gccaccaccgccttttaccctatctctagaccggaa

SEQ ID NO: 192544 - DNA, 36 bp, Artificial Sequence
  Synthetic oligonucleotide
tacgacaccctgcctccctgacgaacctgtagataa

SEQ ID NO: 192545 - DNA, 36 bp, Artificial Sequence
  Synthetic oligonucleotide
atccctccccactgatgttaacacacggtaggttaa

SEQ ID NO: 192546 - DNA, 35 bp, Artificial Sequence
  Synthetic oligonucleotide
gccggaataagggcaagggaaagaagagccagaca

SEQ ID NO: 192547 - DNA, 35 bp, Artificial Sequence
  Synthetic oligonucleotide
gtctgagcgcccgccgatcccccgctaccgagaca

SEQ ID NO: 192548 - DNA, 36 bp, Artificial Sequence
  Synthetic oligonucleotide
gcaccttcctgcctatacggttttctgtagtctaca

SEQ ID NO: 192549 - DNA, 35 bp, Artificial Sequence
  Synthetic oligonucleotide
aacgacctctcctgcgctggctggtgctccaccca

SEQ ID NO: 192550 - DNA, 35 bp, Artificial Sequence
  Synthetic oligonucleotide
gcgcccccgcctcgtgttcataccttcgctcccca

SEQ ID NO: 192551 - DNA, 36 bp, Artificial Sequence
  Synthetic oligonucleotide
gcgatcgcagggtcaccctgccatagtacttcccca

SEQ ID NO: 192552 - DNA, 35 bp, Artificial Sequence
  Synthetic oligonucleotide
gcgcccactgcagattctctggctactcgctccca

SEQ ID NO: 192553 - DNA, 36 bp, Artificial Sequence
  Synthetic oligonucleotide
tcctccctcatccgttctgcatcagttatgattcca

SEQ ID NO: 192554 - DNA, 35 bp, Artificial Sequence
  Synthetic oligonucleotide
gttggaggggagcaggagcaaggaaaagtgtagca

SEQ ID NO: 192555 - DNA, 35 bp, Artificial Sequence
  Synthetic oligonucleotide
tccacgcattccggcacatcctctgcgtctccgca

SEQ ID NO: 192556 - DNA, 35 bp, Artificial Sequence
  Synthetic oligonucleotide
gccaactcggatactcccgccctgtgcctcttgca

SEQ ID NO: 192557 - DNA, 36 bp, Artificial Sequence
  Synthetic oligonucleotide
gtcgtaaccccgcgtgattatgttcgcccgtgatca

SEQ ID NO: 192558 - DNA, 35 bp, Artificial Sequence
  Synthetic oligonucleotide
tcaaaccatccgctgactcatgcagtcataactca

SEQ ID NO: 192559 - DNA, 36 bp, Artificial Sequence
  Synthetic oligonucleotide
gcaacatctgactgcatcggtctccctaacacttca

SEQ ID NO: 192560 - DNA, 36 bp, Artificial Sequence
  Synthetic oligonucleotide
accatcgcgcccatggacacctcaccaggcacttca

SEQ ID NO: 192561 - DNA, 36 bp, Artificial Sequence
  Synthetic oligonucleotide
tcatccgccctcactgtccacgcattcaggctttca

SEQ ID NO: 192562 - DNA, 35 bp, Artificial Sequence
  Synthetic oligonucleotide
gttccacgtactacccttgcacgagcggtttttca

SEQ ID NO: 192563 - DNA, 37 bp, Artificial Sequence
  Synthetic oligonucleotide
ttcccacccctctgtttcttattgaaccactacaaga

SEQ ID NO: 192564 - DNA, 36 bp, Artificial Sequence
  Synthetic oligonucleotide
gattgcctccatgccattcacatccttctacccaga

SEQ ID NO: 192565 - DNA, 37 bp, Artificial Sequence
  Synthetic oligonucleotide
tcagaggtagagggcgatcgtatgagcggggggcaga

SEQ ID NO: 192566 - DNA, 37 bp, Artificial Sequence
  Synthetic oligonucleotide
gaaggaagagaggtgggacaggaggagaaaaaagaga

SEQ ID NO: 192567 - DNA, 36 bp, Artificial Sequence
  Synthetic oligonucleotide
ggacgggggaggggggatcgattggacatgcagaga

SEQ ID NO: 192568 - DNA, 36 bp, Artificial Sequence
  Synthetic oligonucleotide
gtgaggaggagggtagcgtgggtccggcggaaacga

SEQ ID NO: 192569 - DNA, 37 bp, Artificial Sequence
  Synthetic oligonucleotide
tgaacaccgctctcattccccccttctcacgggacga

SEQ ID NO: 192570 - DNA, 37 bp, Artificial Sequence
  Synthetic oligonucleotide
tattcgccccccactgggatctccactgtctaaccga

SEQ ID NO: 192571 - DNA, 37 bp, Artificial Sequence
  Synthetic oligonucleotide
atgcactccacaagcactgcgatcacgtttctcccga

SEQ ID NO: 192572 - DNA, 36 bp, Artificial Sequence
  Synthetic oligonucleotide
tgacaccccccggaggtattcttcttcgctttccga

SEQ ID NO: 192573 - DNA, 37 bp, Artificial Sequence
  Synthetic oligonucleotide
gtggtgagaggggatgactgcggggaagaggatgcga

SEQ ID NO: 192574 - DNA, 36 bp, Artificial Sequence
  Synthetic oligonucleotide
gcgcgcacgtcgcttgctaatcattccccccctcga

SEQ ID NO: 192575 - DNA, 37 bp, Artificial Sequence
  Synthetic oligonucleotide
gtgtagtcgcagccgttcaaaacccgcaccttttcga

SEQ ID NO: 192576 - DNA, 37 bp, Artificial Sequence
  Synthetic oligonucleotide
tagtggtagagacaagggtgagagagcgtggagagga

SEQ ID NO: 192577 - DNA, 37 bp, Artificial Sequence
  Synthetic oligonucleotide
gacgtgttgggcgggtgggtgtatgggtaacggagga

SEQ ID NO: 192578 - DNA, 37 bp, Artificial Sequence
  Synthetic oligonucleotide
tgtgcctcactgcgctgtactattccttcatcacgga

SEQ ID NO: 192579 - DNA, 36 bp, Artificial Sequence
  Synthetic oligonucleotide
agcagaaggggaggccgaaaagcttgggaggaggga

SEQ ID NO: 192580 - DNA, 36 bp, Artificial Sequence
  Synthetic oligonucleotide
actgagaaggggataaggtgaggtgggatagcggga

SEQ ID NO: 192581 - DNA, 36 bp, Artificial Sequence
  Synthetic oligonucleotide
gcataacggaggatgaacgaaggataggggatggga

SEQ ID NO: 192582 - DNA, 37 bp, Artificial Sequence
  Synthetic oligonucleotide
tccacctcgctctttacgcatgacctatccttatgga

SEQ ID NO: 192583 - DNA, 36 bp, Artificial Sequence
  Synthetic oligonucleotide
tctccatccctatcgttgcctgccgtgttgccatga

SEQ ID NO: 192584 - DNA, 38 bp, Artificial Sequence
  Synthetic oligonucleotide
tccgctacctcacatgcctgtttatacactcctcatga

SEQ ID NO: 192585 - DNA, 37 bp, Artificial Sequence
  Synthetic oligonucleotide
gtaccacgtcctccgccgcctcagtctttatcgatga

SEQ ID NO: 192586 - DNA, 37 bp, Artificial Sequence
  Synthetic oligonucleotide
gaagggagggagtgccggggatgagtggacagtatga

SEQ ID NO: 192587 - DNA, 36 bp, Artificial Sequence
  Synthetic oligonucleotide
atccaacgcatgttctgccgccggggcccacactga

SEQ ID NO: 192588 - DNA, 38 bp, Artificial Sequence
  Synthetic oligonucleotide
gtgatcacgagtgcggagggagagagcgaggagactga

SEQ ID NO: 192589 - DNA, 38 bp, Artificial Sequence
  Synthetic oligonucleotide
tagacgcgacagacgcaatctcgtgccgtttttcctga

SEQ ID NO: 192590 - DNA, 38 bp, Artificial Sequence
  Synthetic oligonucleotide
tgcgggatatgtcgtaggggagcggagggggagagtga

SEQ ID NO: 192591 - DNA, 38 bp, Artificial Sequence
  Synthetic oligonucleotide
tgttaccgccctcagctctgccgacctacacctagtga

SEQ ID NO: 192592 - DNA, 37 bp, Artificial Sequence
  Synthetic oligonucleotide
tgcaggaaggggagctaagtggggtgagaggaggtga

SEQ ID NO: 192593 - DNA, 38 bp, Artificial Sequence
  Synthetic oligonucleotide
gaggaggagggacaaggtttggtggagatagatggtga

SEQ ID NO: 192594 - DNA, 37 bp, Artificial Sequence
  Synthetic oligonucleotide
tgcatcacgcggccgttccatctatctcccagtgtga

SEQ ID NO: 192595 - DNA, 38 bp, Artificial Sequence
  Synthetic oligonucleotide
gtggaggggaccggatgctggatggggcagctgtgtga

SEQ ID NO: 192596 - DNA, 38 bp, Artificial Sequence
  Synthetic oligonucleotide
gacaggagcgtaaagaacggggtgggaggcgaagttga

SEQ ID NO: 192597 - DNA, 38 bp, Artificial Sequence
  Synthetic oligonucleotide
gcaaggggggcgggtatagggcgactggaagatgttga

SEQ ID NO: 192598 - DNA, 36 bp, Artificial Sequence
  Synthetic oligonucleotide
actatcgcgccggtggttgtctcttttcgcccccta

SEQ ID NO: 192599 - DNA, 36 bp, Artificial Sequence
  Synthetic oligonucleotide
tctgtgagccctcagtgtcaccatccattccagcta

SEQ ID NO: 192600 - DNA, 36 bp, Artificial Sequence
  Synthetic oligonucleotide
gcacgcttgtcgtccacggcattcacctccattcta

SEQ ID NO: 192601 - DNA, 36 bp, Artificial Sequence
  Synthetic oligonucleotide
tgtgggagtgacaatcgtgggaagggtaggggcgta

SEQ ID NO: 192602 - DNA, 35 bp, Artificial Sequence
  Synthetic oligonucleotide
acatggggaggtgtggggacgggctagcggaggta

SEQ ID NO: 192603 - DNA, 36 bp, Artificial Sequence
  Synthetic oligonucleotide
atccacctcagcactcacgcagcacgctacctggta

SEQ ID NO: 192604 - DNA, 36 bp, Artificial Sequence
  Synthetic oligonucleotide
accatcccctctggtatcctccgtatgtttgcctta

SEQ ID NO: 192605 - DNA, 35 bp, Artificial Sequence
  Synthetic oligonucleotide
accctcccctgtacccctggtctgatttccgctta

SEQ ID NO: 192606 - DNA, 35 bp, Artificial Sequence
  Synthetic oligonucleotide
tctgattcagctcccccgctcacgccaggccttta

SEQ ID NO: 192607 - DNA, 36 bp, Artificial Sequence
  Synthetic oligonucleotide
tccggttccatcatgttatctatcctgtgcgcttta

SEQ ID NO: 192608 - DNA, 36 bp, Artificial Sequence
  Synthetic oligonucleotide
gacgaagttggagagggggacgaggagcatggttta

SEQ ID NO: 192609 - DNA, 35 bp, Artificial Sequence
  Synthetic oligonucleotide
aaccccgcgactagctctctactcagttctgcaac

SEQ ID NO: 192610 - DNA, 35 bp, Artificial Sequence
  Synthetic oligonucleotide
tactaatcggagtaccatcgccctgttatgtccac

SEQ ID NO: 192611 - DNA, 35 bp, Artificial Sequence
  Synthetic oligonucleotide
actactcgccccgccgcccgatcaggtgggatcac

SEQ ID NO: 192612 - DNA, 35 bp, Artificial Sequence
  Synthetic oligonucleotide
gtttcgcccactcctttttgtacagggtaattcac

SEQ ID NO: 192613 - DNA, 35 bp, Artificial Sequence
  Synthetic oligonucleotide
gagagggtgggagggtactaattgctccgggggac

SEQ ID NO: 192614 - DNA, 35 bp, Artificial Sequence
  Synthetic oligonucleotide
gcaagtccgacgcctgctttgtaccattgatgtac

SEQ ID NO: 192615 - DNA, 35 bp, Artificial Sequence
  Synthetic oligonucleotide
tactacccgcttaccaagtggccatggatcacacc

SEQ ID NO: 192616 - DNA, 35 bp, Artificial Sequence
  Synthetic oligonucleotide
atgtacccggtcattgtatttaaaccgccgccacc

SEQ ID NO: 192617 - DNA, 35 bp, Artificial Sequence
  Synthetic oligonucleotide
tccggaccggcgcacgttcctcttagcgctccacc

SEQ ID NO: 192618 - DNA, 35 bp, Artificial Sequence
  Synthetic oligonucleotide
gattccacctagtgaaacgtgtacgtgggcttacc

SEQ ID NO: 192619 - DNA, 35 bp, Artificial Sequence
  Synthetic oligonucleotide
acagtacgggtcatctcttttgcgcccctgtcccc

SEQ ID NO: 192620 - DNA, 35 bp, Artificial Sequence
  Synthetic oligonucleotide
atactgaccgcccatgcatatgctgcactgctccc

SEQ ID NO: 192621 - DNA, 35 bp, Artificial Sequence
  Synthetic oligonucleotide
accactccgccctccctaaaagacggcgatctccc

SEQ ID NO: 192622 - DNA, 35 bp, Artificial Sequence
  Synthetic oligonucleotide
acactcgcgtacctcagcgttttcttggtcttccc

SEQ ID NO: 192623 - DNA, 35 bp, Artificial Sequence
  Synthetic oligonucleotide
agacacagtacattttcacctacccacgctacgcc

SEQ ID NO: 192624 - DNA, 35 bp, Artificial Sequence
  Synthetic oligonucleotide
tcggaccagccaccgcctctattcggaccaccgcc

SEQ ID NO: 192625 - DNA, 35 bp, Artificial Sequence
  Synthetic oligonucleotide
tgtcatccatctacactaccgcccggctggctgcc

SEQ ID NO: 192626 - DNA, 35 bp, Artificial Sequence
  Synthetic oligonucleotide
tttgtacgctcacgatgtgcgctctggtgccctcc

SEQ ID NO: 192627 - DNA, 35 bp, Artificial Sequence
  Synthetic oligonucleotide
ttcgtccacccccatcacgcaagatttgtgcctcc

SEQ ID NO: 192628 - DNA, 35 bp, Artificial Sequence
  Synthetic oligonucleotide
gaaagcacccctcctatatgttgactcgcctgtcc

SEQ ID NO: 192629 - DNA, 35 bp, Artificial Sequence
  Synthetic oligonucleotide
tttccacccacatggcaggcaggcttccccttagc

SEQ ID NO: 192630 - DNA, 35 bp, Artificial Sequence
  Synthetic oligonucleotide
gacatgacgcccatagtttagtcctgctacaccgc

SEQ ID NO: 192631 - DNA, 35 bp, Artificial Sequence
  Synthetic oligonucleotide
gatttacgccaaaactgttcatggtcttgccccgc

SEQ ID NO: 192632 - DNA, 35 bp, Artificial Sequence
  Synthetic oligonucleotide
gttcgccctctgatccttgttcgccctttctgcgc

SEQ ID NO: 192633 - DNA, 35 bp, Artificial Sequence
  Synthetic oligonucleotide
tacccccgcccaaatttctcaccgtgttgtttcgc

SEQ ID NO: 192634 - DNA, 35 bp, Artificial Sequence
  Synthetic oligonucleotide
acacgcatgtctcatccactctttatgcttcgtgc

SEQ ID NO: 192635 - DNA, 35 bp, Artificial Sequence
  Synthetic oligonucleotide
gttctgaggcagagccttctcccaccctcgttatc

SEQ ID NO: 192636 - DNA, 35 bp, Artificial Sequence
  Synthetic oligonucleotide
tctgcctccatcggaaggccctttacacactactc

SEQ ID NO: 192637 - DNA, 35 bp, Artificial Sequence
  Synthetic oligonucleotide
agtcccccaagcgctccggcctcgcatctatcctc

SEQ ID NO: 192638 - DNA, 35 bp, Artificial Sequence
  Synthetic oligonucleotide
gtgctatactcgattcgcttctgcccacgctcctc

SEQ ID NO: 192639 - DNA, 35 bp, Artificial Sequence
  Synthetic oligonucleotide
attccacacgcgtcgaagcttagctttgtctcctc

SEQ ID NO: 192640 - DNA, 35 bp, Artificial Sequence
  Synthetic oligonucleotide
ttcgaagaaacgaacggcgcctccaccttctcctc

SEQ ID NO: 192641 - DNA, 35 bp, Artificial Sequence
  Synthetic oligonucleotide
gcactacgcgatactgcacccttggattccatctc

SEQ ID NO: 192642 - DNA, 35 bp, Artificial Sequence
  Synthetic oligonucleotide
ttgtcattcgctttagtacaagccactccgttctc

SEQ ID NO: 192643 - DNA, 35 bp, Artificial Sequence
  Synthetic oligonucleotide
tatgcgtcgaagtccctcccgacctgtggccattc

SEQ ID NO: 192644 - DNA, 35 bp, Artificial Sequence
  Synthetic oligonucleotide
gtcagtactgctgccttcgaattctccatcacttc

SEQ ID NO: 192645 - DNA, 35 bp, Artificial Sequence
  Synthetic oligonucleotide
tccccgcctcacacttctgttatgtccattccttc

SEQ ID NO: 192646 - DNA, 35 bp, Artificial Sequence
  Synthetic oligonucleotide
ttgacgaatgacgggggggtggggaagggaccgag

SEQ ID NO: 192647 - DNA, 30 bp, Artificial Sequence
  Synthetic oligonucleotide
tcagagacgaggaagagtggagggtgggag

SEQ ID NO: 192648 - DNA, 35 bp, Artificial Sequence
  Synthetic oligonucleotide
gaaccaccgcccccccaacatgctcaggaaatgag

SEQ ID NO: 192649 - DNA, 35 bp, Artificial Sequence
  Synthetic oligonucleotide
gcagggggaagagtgggtggaacggaatggaaacg

SEQ ID NO: 192650 - DNA, 35 bp, Artificial Sequence
  Synthetic oligonucleotide
acagcccacacaccgcccaaatacgtaatgccacg

SEQ ID NO: 192651 - DNA, 35 bp, Artificial Sequence
  Synthetic oligonucleotide
acccaccacattccggttgtatcatctcctccacg

SEQ ID NO: 192652 - DNA, 35 bp, Artificial Sequence
  Synthetic oligonucleotide
gcgtccctcgcccgtcgttcttatgcccccccccg

SEQ ID NO: 192653 - DNA, 35 bp, Artificial Sequence
  Synthetic oligonucleotide
gggtggtgggggggttttgcggatggcacatcgcg

SEQ ID NO: 192654 - DNA, 35 bp, Artificial Sequence
  Synthetic oligonucleotide
tccatgcccaccccgacgttgacttccgtatctcg

SEQ ID NO: 192655 - DNA, 35 bp, Artificial Sequence
  Synthetic oligonucleotide
ttgcacgctgtcttttcgtcccctctccgccgtcg

SEQ ID NO: 192656 - DNA, 35 bp, Artificial Sequence
  Synthetic oligonucleotide
gtccgcaccatggtttcctctgcactattgtttcg

SEQ ID NO: 192657 - DNA, 35 bp, Artificial Sequence
  Synthetic oligonucleotide
tgagcccccactgttgtttttctttcttccctagg

SEQ ID NO: 192658 - DNA, 35 bp, Artificial Sequence
  Synthetic oligonucleotide
taacttccaccgcgccctctctccgatctgatggg

SEQ ID NO: 192659 - DNA, 35 bp, Artificial Sequence
  Synthetic oligonucleotide
tgcttgcctcgcagatacaattgccttccttcatg

SEQ ID NO: 192660 - DNA, 35 bp, Artificial Sequence
  Synthetic oligonucleotide
ttacatggaacggggtggaaacagggggacgtatg

SEQ ID NO: 192661 - DNA, 35 bp, Artificial Sequence
  Synthetic oligonucleotide
gacgcgatccgcacactgaccctccgctttgactg

SEQ ID NO: 192662 - DNA, 35 bp, Artificial Sequence
  Synthetic oligonucleotide
tttacgccatagcgcctgctgtccacccacttctg

SEQ ID NO: 192663 - DNA, 35 bp, Artificial Sequence
  Synthetic oligonucleotide
ttcgcacgtccgtcccttgtttctccctcaccgtg

SEQ ID NO: 192664 - DNA, 35 bp, Artificial Sequence
  Synthetic oligonucleotide
agggggggcgggtggtactgagggatgtaagattg

SEQ ID NO: 192665 - DNA, 35 bp, Artificial Sequence
  Synthetic oligonucleotide
gtcgtccctcgcctcctgaaaattcacttgtgttg

SEQ ID NO: 192666 - DNA, 35 bp, Artificial Sequence
  Synthetic oligonucleotide
tccgccctctccctgccgattaagtcccgctcaat

SEQ ID NO: 192667 - DNA, 35 bp, Artificial Sequence
  Synthetic oligonucleotide
acacacccgctaattcctgtggtacatggtaacat

SEQ ID NO: 192668 - DNA, 35 bp, Artificial Sequence
  Synthetic oligonucleotide
gtacagctcagtcaccttcccctctactggctcat

SEQ ID NO: 192669 - DNA, 35 bp, Artificial Sequence
  Synthetic oligonucleotide
accacaccgccactaatagcttatagttcaccact

SEQ ID NO: 192670 - DNA, 34 bp, Artificial Sequence
  Synthetic oligonucleotide
tcgccatccctctgccatccttgtcctaccgcct

SEQ ID NO: 192671 - DNA, 35 bp, Artificial Sequence
  Synthetic oligonucleotide
agtatgcgccaactagctgcaacgtgtcctgtcct

SEQ ID NO: 192672 - DNA, 35 bp, Artificial Sequence
  Synthetic oligonucleotide
gtccactgtctcgcgccgacacccatacacgtgct

SEQ ID NO: 192673 - DNA, 35 bp, Artificial Sequence
  Synthetic oligonucleotide
tctgtcactccactgtgacccctttattgctttct

SEQ ID NO: 192674 - DNA, 35 bp, Artificial Sequence
  Synthetic oligonucleotide
tgccacatcgtaggtcagcctttctagcctctcgt

SEQ ID NO: 192675 - DNA, 35 bp, Artificial Sequence
  Synthetic oligonucleotide
gaccaacacgttacatcctcgtccatgaccatatt

SEQ ID NO: 192676 - DNA, 35 bp, Artificial Sequence
  Synthetic oligonucleotide
actcaccccccgtttaggagtgtcccattttactt

SEQ ID NO: 192677 - DNA, 35 bp, Artificial Sequence
  Synthetic oligonucleotide
actccatgtcatctatccccccccgtacgatggtt

SEQ ID NO: 192678 - DNA, 35 bp, Artificial Sequence
  Synthetic oligonucleotide
ttcatcctgcctctttgtgcaagcctctctatgtt

SEQ ID NO: 192679 - DNA, 35 bp, Artificial Sequence
  Synthetic oligonucleotide
gattcatccgcctagcatacccccctcagctattt

SEQ ID NO: 192680 - DNA, 35 bp, Artificial Sequence
  Synthetic oligonucleotide
ttcacacgctcgcactgctacggatcccccatttt

SEQ ID NO: 192681 - DNA, 36 bp, Artificial Sequence
  Synthetic oligonucleotide
gatccgctgatgtgcgccgcacaccctccctttcaa

SEQ ID NO: 192682 - DNA, 36 bp, Artificial Sequence
  Synthetic oligonucleotide
ggatggggtgcaggggcggagagggaatgagtagaa

SEQ ID NO: 192683 - DNA, 36 bp, Artificial Sequence
  Synthetic oligonucleotide
aactcatggcggaggagggggtcctgggtggtggaa

SEQ ID NO: 192684 - DNA, 34 bp, Artificial Sequence
  Synthetic oligonucleotide
tctccagtacgcatccatctgctagaacccataa

SEQ ID NO: 192685 - DNA, 36 bp, Artificial Sequence
  Synthetic oligonucleotide
acctccacctcgcgtgaattaccccgtaggtactaa

SEQ ID NO: 192686 - DNA, 36 bp, Artificial Sequence
  Synthetic oligonucleotide
agcactcaagcaaatgcgatcctccaccggcccaca

SEQ ID NO: 192687 - DNA, 36 bp, Artificial Sequence
  Synthetic oligonucleotide
gcagggacatccgactcagggcgggtgggtcaacca

SEQ ID NO: 192688 - DNA, 36 bp, Artificial Sequence
  Synthetic oligonucleotide
gtgcctgtccgcaagcccctcgaactggtccaccca

SEQ ID NO: 192689 - DNA, 36 bp, Artificial Sequence
  Synthetic oligonucleotide
atgctccacccctcagtacagaccacgtgtcgccca

SEQ ID NO: 192690 - DNA, 35 bp, Artificial Sequence
  Synthetic oligonucleotide
tatccaccgctctcggattcgctccataattccca

SEQ ID NO: 192691 - DNA, 36 bp, Artificial Sequence
  Synthetic oligonucleotide
acacccgcatgtggtccttttccgtcgcctttccca

SEQ ID NO: 192692 - DNA, 36 bp, Artificial Sequence
  Synthetic oligonucleotide
tgaaccccttcaacgcgctcccctccgaccatgcca

SEQ ID NO: 192693 - DNA, 35 bp, Artificial Sequence
  Synthetic oligonucleotide
gctcgcgttggtgtacgtgctcctcttcttctcca

SEQ ID NO: 192694 - DNA, 36 bp, Artificial Sequence
  Synthetic oligonucleotide
atcctgagccgctgaccatccctgacccattatgca

SEQ ID NO: 192695 - DNA, 35 bp, Artificial Sequence
  Synthetic oligonucleotide
gtgtcccagcccaccgcttcctgcaactgattgca

SEQ ID NO: 192696 - DNA, 35 bp, Artificial Sequence
  Synthetic oligonucleotide
tgcccatgccacacctttgttcgacttgcccatca

SEQ ID NO: 192697 - DNA, 36 bp, Artificial Sequence
  Synthetic oligonucleotide
gcttgggcgccgctttcccacctggttcctccatca

SEQ ID NO: 192698 - DNA, 38 bp, Artificial Sequence
  Synthetic oligonucleotide
gcgggggagaagggtacggggagtagcagacgtgaaga

SEQ ID NO: 192699 - DNA, 36 bp, Artificial Sequence
  Synthetic oligonucleotide
ggtactggaacaaggggggatggtgcgaagggcaga

SEQ ID NO: 192700 - DNA, 37 bp, Artificial Sequence
  Synthetic oligonucleotide
gtgaccacgcacctttgcctctgcctctctagggaga

SEQ ID NO: 192701 - DNA, 37 bp, Artificial Sequence
  Synthetic oligonucleotide
gggggcggaggaacgggagctctggggacatggtaga

SEQ ID NO: 192702 - DNA, 37 bp, Artificial Sequence
  Synthetic oligonucleotide
attgtcccacactttgttaaaccgtcccgttgcccga

SEQ ID NO: 192703 - DNA, 37 bp, Artificial Sequence
  Synthetic oligonucleotide
tagctcgcctcaatctctcctcttttaccgtctccga

SEQ ID NO: 192704 - DNA, 36 bp, Artificial Sequence
  Synthetic oligonucleotide
gcctcccgccgcccacattccgcaatctattctcga

SEQ ID NO: 192705 - DNA, 37 bp, Artificial Sequence
  Synthetic oligonucleotide
taagacagtagacgggagcggtgtggaggggtgtcga

SEQ ID NO: 192706 - DNA, 37 bp, Artificial Sequence
  Synthetic oligonucleotide
acgatcactcacgccgttcacccagctcggtcttcga

SEQ ID NO: 192707 - DNA, 37 bp, Artificial Sequence
  Synthetic oligonucleotide
acgcctgacacagttgcaccacctcccatcctaagga

SEQ ID NO: 192708 - DNA, 37 bp, Artificial Sequence
  Synthetic oligonucleotide
gtcctcaaccgtctctcgtgtctacccctcacccgga

SEQ ID NO: 192709 - DNA, 35 bp, Artificial Sequence
  Synthetic oligonucleotide
gtcgggaaggtgcatcgggcacggaagggaaggga

SEQ ID NO: 192710 - DNA, 37 bp, Artificial Sequence
  Synthetic oligonucleotide
acaaggggcaaggaacggggggcacacacgtgaggga

SEQ ID NO: 192711 - DNA, 37 bp, Artificial Sequence
  Synthetic oligonucleotide
agccccgccactcctctcttacgtattgacctcggga

SEQ ID NO: 192712 - DNA, 37 bp, Artificial Sequence
  Synthetic oligonucleotide
ttagtcacggggcggtgggaaagggttatagggggga

SEQ ID NO: 192713 - DNA, 37 bp, Artificial Sequence
  Synthetic oligonucleotide
actgggggacgtgcgaaggaggaaggggaaacatgga

SEQ ID NO: 192714 - DNA, 37 bp, Artificial Sequence
  Synthetic oligonucleotide
gactaagagaggatggacgagtattggcaaaggtgga

SEQ ID NO: 192715 - DNA, 38 bp, Artificial Sequence
  Synthetic oligonucleotide
tggggaagtgcgaaggaaagggtaaagggcatcaatga

SEQ ID NO: 192716 - DNA, 35 bp, Artificial Sequence
  Synthetic oligonucleotide
taccgaagcgttattctgccatcatcacaccctga

SEQ ID NO: 192717 - DNA, 37 bp, Artificial Sequence
  Synthetic oligonucleotide
gagacgtccagggtcacttccgcacactcccccctga

SEQ ID NO: 192718 - DNA, 38 bp, Artificial Sequence
  Synthetic oligonucleotide
gtgtctgcatccccgtactgatcgacccctctgcctga

SEQ ID NO: 192719 - DNA, 36 bp, Artificial Sequence
  Synthetic oligonucleotide
tgagcccctcgaggtcctctatgtctgccctcctga

SEQ ID NO: 192720 - DNA, 38 bp, Artificial Sequence
  Synthetic oligonucleotide
ggtacgtgctgccaccttgtcttaaccacatctcctga

SEQ ID NO: 192721 - DNA, 38 bp, Artificial Sequence
  Synthetic oligonucleotide
gagcatcaccagcactctattacgtaaccttctcctga

SEQ ID NO: 192722 - DNA, 37 bp, Artificial Sequence
  Synthetic oligonucleotide
ggttcgtcccacagtaattacgtactctctcttctga

SEQ ID NO: 192723 - DNA, 37 bp, Artificial Sequence
  Synthetic oligonucleotide
gatgtggtgtgggggacggtataggggctggtagtga

SEQ ID NO: 192724 - DNA, 37 bp, Artificial Sequence
  Synthetic oligonucleotide
tgtagacggggacgaggggggccgaaattgtaggtga

SEQ ID NO: 192725 - DNA, 36 bp, Artificial Sequence
  Synthetic oligonucleotide
gtggggggggaaaggcgggtcttttggagactgtga

SEQ ID NO: 192726 - DNA, 38 bp, Artificial Sequence
  Synthetic oligonucleotide
aatgcagagggcggggggggatgaacagatcattgtga

SEQ ID NO: 192727 - DNA, 38 bp, Artificial Sequence
  Synthetic oligonucleotide
tacgcccacgccctgcggatggaccccccttattgtga

SEQ ID NO: 192728 - DNA, 37 bp, Artificial Sequence
  Synthetic oligonucleotide
tgtcaacgcaatctttccctgtcccgttcgtttgtga

SEQ ID NO: 192729 - DNA, 37 bp, Artificial Sequence
  Synthetic oligonucleotide
ttgcctccatcccctctgtatccgtttgaaacattga

SEQ ID NO: 192730 - DNA, 37 bp, Artificial Sequence
  Synthetic oligonucleotide
aaccccctcccttgtcattcgtcaggctccatcttga

SEQ ID NO: 192731 - DNA, 38 bp, Artificial Sequence
  Synthetic oligonucleotide
acaggaggcggatgggaagtggtgtgggcggatcttga

SEQ ID NO: 192732 - DNA, 38 bp, Artificial Sequence
  Synthetic oligonucleotide
actgtacgcggcctaaggttaactcccccctctcttga

SEQ ID NO: 192733 - DNA, 37 bp, Artificial Sequence
  Synthetic oligonucleotide
gacgacttcctctccggtgttcgctacccccctttga

SEQ ID NO: 192734 - DNA, 36 bp, Artificial Sequence
  Synthetic oligonucleotide
tgacccctctcgtgcctccagggaactggaacccta

SEQ ID NO: 192735 - DNA, 35 bp, Artificial Sequence
  Synthetic oligonucleotide
tagatacatcgccgtcataatgcgccctgccccta

SEQ ID NO: 192736 - DNA, 36 bp, Artificial Sequence
  Synthetic oligonucleotide
gtccacttcccattttatcgtgtgctctgtccccta

SEQ ID NO: 192737 - DNA, 36 bp, Artificial Sequence
  Synthetic oligonucleotide
accccagtacgtgcgctacgttacgtgtcccctcta

SEQ ID NO: 192738 - DNA, 35 bp, Artificial Sequence
  Synthetic oligonucleotide
aatcgcaacatggactcgcgcctccaccacctgta

SEQ ID NO: 192739 - DNA, 36 bp, Artificial Sequence
  Synthetic oligonucleotide
tgagcgccgatcacattctctgtttccaagccgtta

SEQ ID NO: 192740 - DNA, 35 bp, Artificial Sequence
  Synthetic oligonucleotide
gcaatgggacggacaggatgggaaggggtgtgaac

SEQ ID NO: 192741 - DNA, 35 bp, Artificial Sequence
  Synthetic oligonucleotide
agtgccagtgccgctgcccttcgacctatgataac

SEQ ID NO: 192742 - DNA, 35 bp, Artificial Sequence
  Synthetic oligonucleotide
gtccctgtcctcctacaccccctaccagtcgtaac

SEQ ID NO: 192743 - DNA, 35 bp, Artificial Sequence
  Synthetic oligonucleotide
gatgtacccgcccctgactacttaacacagtccac

SEQ ID NO: 192744 - DNA, 35 bp, Artificial Sequence
  Synthetic oligonucleotide
agtggcccacgctgacttccacgaacgatttccac

SEQ ID NO: 192745 - DNA, 35 bp, Artificial Sequence
  Synthetic oligonucleotide
gaacccgatactatgactttacatgaccatttcac

SEQ ID NO: 192746 - DNA, 35 bp, Artificial Sequence
  Synthetic oligonucleotide
gtcctgtctgtgcatgtccctagcgccatctctac

SEQ ID NO: 192747 - DNA, 35 bp, Artificial Sequence
  Synthetic oligonucleotide
ggttggcccactcgtccgtctgttcatcgtccacc

SEQ ID NO: 192748 - DNA, 34 bp, Artificial Sequence
  Synthetic oligonucleotide
tgtgctcgcccggcacagcccgtatttttcaccc

SEQ ID NO: 192749 - DNA, 35 bp, Artificial Sequence
  Synthetic oligonucleotide
gttagtcacgcctgaggtccccgtccgtacgcccc

SEQ ID NO: 192750 - DNA, 35 bp, Artificial Sequence
  Synthetic oligonucleotide
gccccagatctgtcccccgctatgtgccgcagccc

SEQ ID NO: 192751 - DNA, 35 bp, Artificial Sequence
  Synthetic oligonucleotide
gcatacaggtcggttatttcagcgcccgttcgccc

SEQ ID NO: 192752 - DNA, 35 bp, Artificial Sequence
  Synthetic oligonucleotide
acaacctccctcaggtgcttcacataccaatgccc

SEQ ID NO: 192753 - DNA, 35 bp, Artificial Sequence
  Synthetic oligonucleotide
gatgccgttcacccccgttccgctgggctttgccc

SEQ ID NO: 192754 - DNA, 35 bp, Artificial Sequence
  Synthetic oligonucleotide
acccttcgcggccggacctctaatggatgcctccc

SEQ ID NO: 192755 - DNA, 35 bp, Artificial Sequence
  Synthetic oligonucleotide
atccgttcatagttacaccccgtccacatgctccc

SEQ ID NO: 192756 - DNA, 35 bp, Artificial Sequence
  Synthetic oligonucleotide
gtcacttatgccagcataatgtattgttctctccc

SEQ ID NO: 192757 - DNA, 35 bp, Artificial Sequence
  Synthetic oligonucleotide
tcctgcgccattatttctttctagcacatcgatcc

SEQ ID NO: 192758 - DNA, 35 bp, Artificial Sequence
  Synthetic oligonucleotide
actcagctgtccttgaagccttctagtaccactcc

SEQ ID NO: 192759 - DNA, 35 bp, Artificial Sequence
  Synthetic oligonucleotide
tacaacctccgcacctcaacatgagcgtgtgctcc

SEQ ID NO: 192760 - DNA, 35 bp, Artificial Sequence
  Synthetic oligonucleotide
tagaaaaaggaggagggggggaggaggctaacagc

SEQ ID NO: 192761 - DNA, 35 bp, Artificial Sequence
  Synthetic oligonucleotide
tcggtgcgcctgtctcccgtctgcctcgataacgc

SEQ ID NO: 192762 - DNA, 32 bp, Artificial Sequence
  Synthetic oligonucleotide
gatcgccgcctcacccccacactcggaaccgc

SEQ ID NO: 192763 - DNA, 35 bp, Artificial Sequence
  Synthetic oligonucleotide
taacaagcagcttgatctcacgtcccgttctccgc

SEQ ID NO: 192764 - DNA, 29 bp, Artificial Sequence
  Synthetic oligonucleotide
ttgcccgcccgttaattcctgtctttcgc

SEQ ID NO: 192765 - DNA, 35 bp, Artificial Sequence
  Synthetic oligonucleotide
tccccccccactcctctatgtagaactagccgtgc

SEQ ID NO: 192766 - DNA, 35 bp, Artificial Sequence
  Synthetic oligonucleotide
gctgttgcctccccctatgtctcagggcactgtgc

SEQ ID NO: 192767 - DNA, 35 bp, Artificial Sequence
  Synthetic oligonucleotide
tgtgcccgccccgccgcctcattgactacttttgc

SEQ ID NO: 192768 - DNA, 35 bp, Artificial Sequence
  Synthetic oligonucleotide
gagtgtcgctccaccgctgtcatctggcttgaatc

SEQ ID NO: 192769 - DNA, 35 bp, Artificial Sequence
  Synthetic oligonucleotide
gtccgaccctccgctgactcgatcgcttccctatc

SEQ ID NO: 192770 - DNA, 36 bp, Artificial Sequence
  Synthetic oligonucleotide
gccacggtccttgctcgttgacccctccttttactc

SEQ ID NO: 192771 - DNA, 35 bp, Artificial Sequence
  Synthetic oligonucleotide
acacgcctcaggctctctcattgcgcgaacccctc

SEQ ID NO: 192772 - DNA, 35 bp, Artificial Sequence
  Synthetic oligonucleotide
gtcaccgtcgtctgaaccgccttttagttgtcctc

SEQ ID NO: 192773 - DNA, 35 bp, Artificial Sequence
  Synthetic oligonucleotide
ggacgctcgactgttccgccgtcctgtgctttgtc

SEQ ID NO: 192774 - DNA, 32 bp, Artificial Sequence
  Synthetic oligonucleotide
tcgacatgtaaattgatcccgccgcctaattc

SEQ ID NO: 192775 - DNA, 35 bp, Artificial Sequence
  Synthetic oligonucleotide
ggaagccctcaacgccccattgtcacatgaccttc

SEQ ID NO: 192776 - DNA, 35 bp, Artificial Sequence
  Synthetic oligonucleotide
tgccggtaccggtgccatccttgcgttaattcttc

SEQ ID NO: 192777 - DNA, 35 bp, Artificial Sequence
  Synthetic oligonucleotide
tccgccccaaccaacgctgagtagtcaagttcttc

SEQ ID NO: 192778 - DNA, 35 bp, Artificial Sequence
  Synthetic oligonucleotide
ggacgcgacaggccgccgagtcttgccgttctttc

SEQ ID NO: 192779 - DNA, 35 bp, Artificial Sequence
  Synthetic oligonucleotide
accccgtgacagaccttttacgtgccatctttttc

SEQ ID NO: 192780 - DNA, 35 bp, Artificial Sequence
  Synthetic oligonucleotide
tgcaccatcgcgtaggccgatgaccttcccttacg

SEQ ID NO: 192781 - DNA, 35 bp, Artificial Sequence
  Synthetic oligonucleotide
cacaccttgttggcggtctccttgatctacctccg

SEQ ID NO: 192782 - DNA, 35 bp, Artificial Sequence
  Synthetic oligonucleotide
gagtccgagtgctttgtccccctcgttcctcttcg

SEQ ID NO: 192783 - DNA, 35 bp, Artificial Sequence
  Synthetic oligonucleotide
tacgtccgtcgctaatcctcactgcacatccccgg

SEQ ID NO: 192784 - DNA, 35 bp, Artificial Sequence
  Synthetic oligonucleotide
tccgtgcgcgccatttcttcacgcctcttgcccgg

SEQ ID NO: 192785 - DNA, 35 bp, Artificial Sequence
  Synthetic oligonucleotide
actgatgcatgtcaccgcgcattaccccccccggg

SEQ ID NO: 192786 - DNA, 35 bp, Artificial Sequence
  Synthetic oligonucleotide
ttccagggacacgagggggacgggaaacagggggg

SEQ ID NO: 192787 - DNA, 35 bp, Artificial Sequence
  Synthetic oligonucleotide
gagcagagggaaagggcatgctgggcgagagtggg

SEQ ID NO: 192788 - DNA, 35 bp, Artificial Sequence
  Synthetic oligonucleotide
tagcctcctctcgcggaccacgaatgcaaccctgg

SEQ ID NO: 192789 - DNA, 35 bp, Artificial Sequence
  Synthetic oligonucleotide
tcacccgacctgtgatgtgctctcccctcagtatg

SEQ ID NO: 192790 - DNA, 35 bp, Artificial Sequence
  Synthetic oligonucleotide
gtccgttaccacctccatcctgtattcaagtgctg

SEQ ID NO: 192791 - DNA, 35 bp, Artificial Sequence
  Synthetic oligonucleotide
gaatgggcaatgggggtttggagaggcggagtgtg

SEQ ID NO: 192792 - DNA, 35 bp, Artificial Sequence
  Synthetic oligonucleotide
gaccacttgtgcgtgtaacccacaccgccccctat

SEQ ID NO: 192793 - DNA, 35 bp, Artificial Sequence
  Synthetic oligonucleotide
tgaccatcctcactctataggctatctctagtact

SEQ ID NO: 192794 - DNA, 35 bp, Artificial Sequence
  Synthetic oligonucleotide
tccacgctcacccgtcctctcagtctccctgtact

SEQ ID NO: 192795 - DNA, 35 bp, Artificial Sequence
  Synthetic oligonucleotide
tgtgccgttcgaatggcgcctgaactcccgtacct

SEQ ID NO: 192796 - DNA, 35 bp, Artificial Sequence
  Synthetic oligonucleotide
tacaccctcggggttgcttcatcagacccgaccct

SEQ ID NO: 192797 - DNA, 35 bp, Artificial Sequence
  Synthetic oligonucleotide
acatctaccccaagctgaatgagctccacgtgcct

SEQ ID NO: 192798 - DNA, 35 bp, Artificial Sequence
  Synthetic oligonucleotide
gcagtctaaaggaaggaaggggggtgaggtgcgct

SEQ ID NO: 192799 - DNA, 35 bp, Artificial Sequence
  Synthetic oligonucleotide
tgcactgccctctcacgaatcatgtcacacatgct

SEQ ID NO: 192800 - DNA, 35 bp, Artificial Sequence
  Synthetic oligonucleotide
gcaccccactgtttggaactgcgcctcgcacctct

SEQ ID NO: 192801 - DNA, 35 bp, Artificial Sequence
  Synthetic oligonucleotide
tgctccacgcatctaaagtttatcctccagcctct

SEQ ID NO: 192802 - DNA, 35 bp, Artificial Sequence
  Synthetic oligonucleotide
gtgcatgcgtacttttcatggtttcgtgcctccgt

SEQ ID NO: 192803 - DNA, 35 bp, Artificial Sequence
  Synthetic oligonucleotide
tccgccgtcttcccgctacacaccattatctccgt

SEQ ID NO: 192804 - DNA, 31 bp, Artificial Sequence
  Synthetic oligonucleotide
gatggggtgggactgtagtctttacggcggt

SEQ ID NO: 192805 - DNA, 35 bp, Artificial Sequence
  Synthetic oligonucleotide
tgggtgggggggcagggcgcatcgttctcacctgt

SEQ ID NO: 192806 - DNA, 35 bp, Artificial Sequence
  Synthetic oligonucleotide
gccatccgaaactgtccttggccgcccgacccgtt

SEQ ID NO: 192807 - DNA, 35 bp, Artificial Sequence
  Synthetic oligonucleotide
ggtaccacccgccgttccagtaaacatcctccgtt

SEQ ID NO: 192808 - DNA, 35 bp, Artificial Sequence
  Synthetic oligonucleotide
gatcgaacgtcactaggtttcctcccactatcgtt

SEQ ID NO: 192809 - DNA, 35 bp, Artificial Sequence
  Synthetic oligonucleotide
aacggggcgccgggtggggtgggttttactaggtt

SEQ ID NO: 192810 - DNA, 36 bp, Artificial Sequence
  Synthetic oligonucleotide
atctcatgtcgccgtcctcttatgcctctttgccaa

SEQ ID NO: 192811 - DNA, 37 bp, Artificial Sequence
  Synthetic oligonucleotide
gaggattagggggagggggtaactgagggcacatcaa

SEQ ID NO: 192812 - DNA, 35 bp, Artificial Sequence
  Synthetic oligonucleotide
gctgcgaggggggtggaaggaactcgggtggctaa

SEQ ID NO: 192813 - DNA, 36 bp, Artificial Sequence
  Synthetic oligonucleotide
ggtcacggccacgctcgcacttacaccatctcgtaa

SEQ ID NO: 192814 - DNA, 35 bp, Artificial Sequence
  Synthetic oligonucleotide
gcccaatcagtgtgcgtcgtgtactcctctcgtaa

SEQ ID NO: 192815 - DNA, 36 bp, Artificial Sequence
  Synthetic oligonucleotide
aatccatcattcttcgtcgttgcctctgggcgcaca

SEQ ID NO: 192816 - DNA, 36 bp, Artificial Sequence
  Synthetic oligonucleotide
gatcccgatcaagtgtgcatcgctgccatcctcaca

SEQ ID NO: 192817 - DNA, 36 bp, Artificial Sequence
  Synthetic oligonucleotide
aagcgagaaacggaagggtaggttcgtagggggaca

SEQ ID NO: 192818 - DNA, 34 bp, Artificial Sequence
  Synthetic oligonucleotide
tcccccttgtccctgagtacgctctggttctaca

SEQ ID NO: 192819 - DNA, 35 bp, Artificial Sequence
  Synthetic oligonucleotide
gtgcgcttgactgccaattgtccggcttaccacca

SEQ ID NO: 192820 - DNA, 35 bp, Artificial Sequence
  Synthetic oligonucleotide
agtagcgcgggacgggacggaagggagggggacca

SEQ ID NO: 192821 - DNA, 36 bp, Artificial Sequence
  Synthetic oligonucleotide
gccggatttccgccgtgtacctcttacctcttacca

SEQ ID NO: 192822 - DNA, 35 bp, Artificial Sequence
  Synthetic oligonucleotide
atccccttccgtgtctatcccagtacacaccgcca

SEQ ID NO: 192823 - DNA, 36 bp, Artificial Sequence
  Synthetic oligonucleotide
atccacctatctgtagttagtaggtctgttcctcca

SEQ ID NO: 192824 - DNA, 36 bp, Artificial Sequence
  Synthetic oligonucleotide
gtactcttccatcctgataacggtcgctccatcgca

SEQ ID NO: 192825 - DNA, 34 bp, Artificial Sequence
  Synthetic oligonucleotide
acgactggcgcgtatcttggaggggggaggggca

SEQ ID NO: 192826 - DNA, 36 bp, Artificial Sequence
  Synthetic oligonucleotide
gaacccgacgtgcgcttcaccttccaactccatgca

SEQ ID NO: 192827 - DNA, 35 bp, Artificial Sequence
  Synthetic oligonucleotide
gcccgcgatgacctgatttcaggcgccccctctca

SEQ ID NO: 192828 - DNA, 26 bp, Artificial Sequence
  Synthetic oligonucleotide
tcacgggtcgcctcgcacctctctca

SEQ ID NO: 192829 - DNA, 36 bp, Artificial Sequence
  Synthetic oligonucleotide
acacgggtcagttttgctacttcctcacttccttca

SEQ ID NO: 192830 - DNA, 35 bp, Artificial Sequence
  Synthetic oligonucleotide
acaccgccgcacataaatcagccactcgcgcttca

SEQ ID NO: 192831 - DNA, 36 bp, Artificial Sequence
  Synthetic oligonucleotide
atacgccgacgttttcgatcatagcctcactcttca

SEQ ID NO: 192832 - DNA, 36 bp, Artificial Sequence
  Synthetic oligonucleotide
tagtacgtccgtcccgctaccctacacgtccgttca

SEQ ID NO: 192833 - DNA, 37 bp, Artificial Sequence
  Synthetic oligonucleotide
gtgaccacgctcactggtggcccttcccattccaaga

SEQ ID NO: 192834 - DNA, 37 bp, Artificial Sequence
  Synthetic oligonucleotide
tagggagggggaggttagagagcgtgatgtattgaga

SEQ ID NO: 192835 - DNA, 37 bp, Artificial Sequence
  Synthetic oligonucleotide
atgccccgacccttcctctcatccttcagtctataga

SEQ ID NO: 192836 - DNA, 37 bp, Artificial Sequence
  Synthetic oligonucleotide
tcccgtgtccaatttattcaccgcccttctctgtaga

SEQ ID NO: 192837 - DNA, 37 bp, Artificial Sequence
  Synthetic oligonucleotide
tcatgcccgacctggctatacacctcactttctacga

SEQ ID NO: 192838 - DNA, 37 bp, Artificial Sequence
  Synthetic oligonucleotide
ataccgcccgcctgctccccgtgatcaattattacga

SEQ ID NO: 192839 - DNA, 35 bp, Artificial Sequence
  Synthetic oligonucleotide
gccctgccatttgcctggtatcccgtttcttacga

SEQ ID NO: 192840 - DNA, 36 bp, Artificial Sequence
  Synthetic oligonucleotide
acgtccccgaccgttactaccgccctacagttacga

SEQ ID NO: 192841 - DNA, 36 bp, Artificial Sequence
  Synthetic oligonucleotide
ttgatcatcccgtcagtgcccaccttgttctaccga

SEQ ID NO: 192842 - DNA, 37 bp, Artificial Sequence
  Synthetic oligonucleotide
gtgcatggtttgaatgtgcgctccccccatctgccga

SEQ ID NO: 192843 - DNA, 37 bp, Artificial Sequence
  Synthetic oligonucleotide
agccatgccccaccccccgactgccatccaattgcga

SEQ ID NO: 192844 - DNA, 37 bp, Artificial Sequence
  Synthetic oligonucleotide
gacacccgatcgtaagccacccttttcctctcgtcga

SEQ ID NO: 192845 - DNA, 36 bp, Artificial Sequence
  Synthetic oligonucleotide
gggagggaagaggtaggagggccacgggtatgagga

SEQ ID NO: 192846 - DNA, 37 bp, Artificial Sequence
  Synthetic oligonucleotide
tgcgatggctggaggggaagaatggatagggtgagga

SEQ ID NO: 192847 - DNA, 36 bp, Artificial Sequence
  Synthetic oligonucleotide
gtacgccaaggctgtctacttttcttccttcccgga

SEQ ID NO: 192848 - DNA, 37 bp, Artificial Sequence
  Synthetic oligonucleotide
tagtcgttgcggctcatcgtttctttctcctctcgga

SEQ ID NO: 192849 - DNA, 35 bp, Artificial Sequence
  Synthetic oligonucleotide
gcaagaagctcctgtgctggtgggataggggggga

SEQ ID NO: 192850 - DNA, 37 bp, Artificial Sequence
  Synthetic oligonucleotide
aaaggggacgatagagcatgggactgtggggatggga

SEQ ID NO: 192851 - DNA, 37 bp, Artificial Sequence
  Synthetic oligonucleotide
cgaccttcttctcaccgccgagccgcaccctctggga

SEQ ID NO: 192852 - DNA, 37 bp, Artificial Sequence
  Synthetic oligonucleotide
gtcatatcacaacgtttctagctacaccgcccctgga

SEQ ID NO: 192853 - DNA, 37 bp, Artificial Sequence
  Synthetic oligonucleotide
ttcaatcccgccctatgatctcttgaacctgcctgga

SEQ ID NO: 192854 - DNA, 38 bp, Artificial Sequence
  Synthetic oligonucleotide
gtcaagcactcaagggaggggggaagagcggggaatga

SEQ ID NO: 192855 - DNA, 38 bp, Artificial Sequence
  Synthetic oligonucleotide
gaacacgcgggaggagggtggggtgggtgccaacatga

SEQ ID NO: 192856 - DNA, 35 bp, Artificial Sequence
  Synthetic oligonucleotide
atccgcctactggttccgttacatatccctcatga

SEQ ID NO: 192857 - DNA, 37 bp, Artificial Sequence
  Synthetic oligonucleotide
gacggtgtaaagtagcgggggtagagcaggggtatga

SEQ ID NO: 192858 - DNA, 37 bp, Artificial Sequence
  Synthetic oligonucleotide
gtgtgcccctcctctttgctatccctacagccactga

SEQ ID NO: 192859 - DNA, 36 bp, Artificial Sequence
  Synthetic oligonucleotide
tgatgaccgttcgccgctcgtacccattatacctga

SEQ ID NO: 192860 - DNA, 38 bp, Artificial Sequence
  Synthetic oligonucleotide
atggtcacacgtccattaacgatttgctccctccctga

SEQ ID NO: 192861 - DNA, 37 bp, Artificial Sequence
  Synthetic oligonucleotide
tcccgctccatgtcctatcgtctcccccagttcctga

SEQ ID NO: 192862 - DNA, 36 bp, Artificial Sequence
  Synthetic oligonucleotide
gcgtcggtccgtaccctatcccttctcgttcgctga

SEQ ID NO: 192863 - DNA, 38 bp, Artificial Sequence
  Synthetic oligonucleotide
tcccgaccttggtgtacgctcccttccttgtatgctga

SEQ ID NO: 192864 - DNA, 35 bp, Artificial Sequence
  Synthetic oligonucleotide
cccggggggggggacgggaaaaggagtggctctga

SEQ ID NO: 192865 - DNA, 35 bp, Artificial Sequence
  Synthetic oligonucleotide
tttgctgccactagcccctcccacgccatgtctga

SEQ ID NO: 192866 - DNA, 37 bp, Artificial Sequence
  Synthetic oligonucleotide
gggacggagtacaggagcggtgatttgtggggcgtga

SEQ ID NO: 192867 - DNA, 38 bp, Artificial Sequence
  Synthetic oligonucleotide
gaaggcggggcgaatctcggaaagggatgggggtgtga

SEQ ID NO: 192868 - DNA, 38 bp, Artificial Sequence
  Synthetic oligonucleotide
tggagctccaagaggtacgccaccactcgctccattga

SEQ ID NO: 192869 - DNA, 38 bp, Artificial Sequence
  Synthetic oligonucleotide
ggggggtgggaaaggttgtgggagaatgtggggattga

SEQ ID NO: 192870 - DNA, 38 bp, Artificial Sequence
  Synthetic oligonucleotide
actccaccgtttgggagggatagggggggctctattga

SEQ ID NO: 192871 - DNA, 37 bp, Artificial Sequence
  Synthetic oligonucleotide
gtccgcctcgcctgatcctcgtttctttccttattga

SEQ ID NO: 192872 - DNA, 38 bp, Artificial Sequence
  Synthetic oligonucleotide
tgccccacccccacaaggtgctgtaacagtacccttga

SEQ ID NO: 192873 - DNA, 38 bp, Artificial Sequence
  Synthetic oligonucleotide
gtctcgccgatcgtcgttgcaacaccactgccccttga

SEQ ID NO: 192874 - DNA, 38 bp, Artificial Sequence
  Synthetic oligonucleotide
aatgcggggtcgggtgggatactgagaagggtccttga

SEQ ID NO: 192875 - DNA, 38 bp, Artificial Sequence
  Synthetic oligonucleotide
gtcaccccgactctgtatgcctttcaccgtttgcttga

SEQ ID NO: 192876 - DNA, 36 bp, Artificial Sequence
  Synthetic oligonucleotide
atggccccatcaggcgttaccctttcgtactcttga

SEQ ID NO: 192877 - DNA, 36 bp, Artificial Sequence
  Synthetic oligonucleotide
gcagaccccctccctttagtgctcccgtactttata

SEQ ID NO: 192878 - DNA, 36 bp, Artificial Sequence
  Synthetic oligonucleotide
gtccgaacctcggtatcagattttactgccctccta

SEQ ID NO: 192879 - DNA, 36 bp, Artificial Sequence
  Synthetic oligonucleotide
ttgccctcgctttcaatgacgctgtcacacttccta

SEQ ID NO: 192880 - DNA, 36 bp, Artificial Sequence
  Synthetic oligonucleotide
ggattgtcctgacgcgtctattcgcctatcccctta

SEQ ID NO: 192881 - DNA, 35 bp, Artificial Sequence
  Synthetic oligonucleotide
tatctcgcgttcacgactcactatcaacgccctta

SEQ ID NO: 192882 - DNA, 36 bp, Artificial Sequence
  Synthetic oligonucleotide
gggagggaaatcgggtgggtggttgacaccgagtta

SEQ ID NO: 192883 - DNA, 36 bp, Artificial Sequence
  Synthetic oligonucleotide
gagtctcacgctgccctccgtttcatggtactttta

SEQ ID NO: 192884 - DNA, 35 bp, Artificial Sequence
  Synthetic oligonucleotide
atacaccccctttgtgctgttccattttcgaagac

SEQ ID NO: 192885 - DNA, 35 bp, Artificial Sequence
  Synthetic oligonucleotide
gcaaccaggcatcaagtccctctctctccgcggac

SEQ ID NO: 192886 - DNA, 35 bp, Artificial Sequence
  Synthetic oligonucleotide
aaccgccgcacctctcatgttcagattctgtttac

SEQ ID NO: 192887 - DNA, 35 bp, Artificial Sequence
  Synthetic oligonucleotide
atgttcaccctccagctgaattctgactatccacc

SEQ ID NO: 192888 - DNA, 35 bp, Artificial Sequence
  Synthetic oligonucleotide
tggaacccctctccgtgctccatgtatcgccaccc

SEQ ID NO: 192889 - DNA, 35 bp, Artificial Sequence
  Synthetic oligonucleotide
gttgcccctatgtctgtccacttgcgctgataccc

SEQ ID NO: 192890 - DNA, 35 bp, Artificial Sequence
  Synthetic oligonucleotide
ttgctaccgcagcaaacaccatacatcgcgacccc

SEQ ID NO: 192891 - DNA, 35 bp, Artificial Sequence
  Synthetic oligonucleotide
tctgggtcgctctacatgccagtcaatgacccccc

SEQ ID NO: 192892 - DNA, 35 bp, Artificial Sequence
  Synthetic oligonucleotide
tacgccctttccgctcacacatttcatacgtcccc

SEQ ID NO: 192893 - DNA, 35 bp, Artificial Sequence
  Synthetic oligonucleotide
gttgttctgcaacacattgagtaccgattccgccc

SEQ ID NO: 192894 - DNA, 35 bp, Artificial Sequence
  Synthetic oligonucleotide
tgttgcacagctcgagaactgtctcccgcgatccc

SEQ ID NO: 192895 - DNA, 34 bp, Artificial Sequence
  Synthetic oligonucleotide
gattcgattgccggtctatattccaccatgtccc

SEQ ID NO: 192896 - DNA, 35 bp, Artificial Sequence
  Synthetic oligonucleotide
acgccgccatcattcccgacctgtactctaacgcc

SEQ ID NO: 192897 - DNA, 35 bp, Artificial Sequence
  Synthetic oligonucleotide
atgtcgccccaatccgttagtatcgacgtctcgcc

SEQ ID NO: 192898 - DNA, 35 bp, Artificial Sequence
  Synthetic oligonucleotide
ttgatctgccactgctattccaggtcccccttgcc

SEQ ID NO: 192899 - DNA, 35 bp, Artificial Sequence
  Synthetic oligonucleotide
ggagcgctacggataaccgttcttggtccacctcc

SEQ ID NO: 192900 - DNA, 35 bp, Artificial Sequence
  Synthetic oligonucleotide
gcctgaggtactgcttggctcatctacatatctcc

SEQ ID NO: 192901 - DNA, 35 bp, Artificial Sequence
  Synthetic oligonucleotide
ggacgagccttctctttgctatcctcgcctagtcc

SEQ ID NO: 192902 - DNA, 35 bp, Artificial Sequence
  Synthetic oligonucleotide
tgcggatgcccgttgacctcgcctctttttattcc

SEQ ID NO: 192903 - DNA, 35 bp, Artificial Sequence
  Synthetic oligonucleotide
gaccatactcacattgggctccaaaccactgttcc

SEQ ID NO: 192904 - DNA, 35 bp, Artificial Sequence
  Synthetic oligonucleotide
atccatcactgtgttacccctttcgcgtctgacgc

SEQ ID NO: 192905 - DNA, 35 bp, Artificial Sequence
  Synthetic oligonucleotide
acccccattcgtactgctccgtattttactgatgc

SEQ ID NO: 192906 - DNA, 35 bp, Artificial Sequence
  Synthetic oligonucleotide
acatcccaccctagcccggtatcattcccgcctgc

SEQ ID NO: 192907 - DNA, 35 bp, Artificial Sequence
  Synthetic oligonucleotide
accgtccccatactcgcgttacttgccatctctgc

SEQ ID NO: 192908 - DNA, 35 bp, Artificial Sequence
  Synthetic oligonucleotide
acatttgcccgcccccctgatcacgttgatgttgc

SEQ ID NO: 192909 - DNA, 35 bp, Artificial Sequence
  Synthetic oligonucleotide
tactccccagcctggacggttccgatccggacatc

SEQ ID NO: 192910 - DNA, 35 bp, Artificial Sequence
  Synthetic oligonucleotide
tccgctccagccacactttcgactatggccctatc

SEQ ID NO: 192911 - DNA, 35 bp, Artificial Sequence
  Synthetic oligonucleotide
gacccacatactcgcgtcggttcccatttcctatc

SEQ ID NO: 192912 - DNA, 35 bp, Artificial Sequence
  Synthetic oligonucleotide
gccccatccgccgacctgttacccttgcctttatc

SEQ ID NO: 192913 - DNA, 35 bp, Artificial Sequence
  Synthetic oligonucleotide
gcccaatgctcttcgttcctagcctgaactacctc

SEQ ID NO: 192914 - DNA, 35 bp, Artificial Sequence
  Synthetic oligonucleotide
taccgcatctggacttttttagcgccataaccctc

SEQ ID NO: 192915 - DNA, 35 bp, Artificial Sequence
  Synthetic oligonucleotide
taggtcaacatccgtattgcgctattcttgccctc

SEQ ID NO: 192916 - DNA, 35 bp, Artificial Sequence
  Synthetic oligonucleotide
ttgcctccatctggcagagacttccatatttgctc

SEQ ID NO: 192917 - DNA, 35 bp, Artificial Sequence
  Synthetic oligonucleotide
ttggacccgtagcgctaggccgcgaatttcttctc

SEQ ID NO: 192918 - DNA, 35 bp, Artificial Sequence
  Synthetic oligonucleotide
aatcgcactcctcgtctctgcggatagcatccttc

SEQ ID NO: 192919 - DNA, 35 bp, Artificial Sequence
  Synthetic oligonucleotide
ggggggatggaacatggtggtgctggtaaggcaag

SEQ ID NO: 192920 - DNA, 35 bp, Artificial Sequence
  Synthetic oligonucleotide
ggtgaaggtgaagggaagtgaggccaccggcgaag

SEQ ID NO: 192921 - DNA, 35 bp, Artificial Sequence
  Synthetic oligonucleotide
ggacagggggagggggtacgtggtccagggtgaag

SEQ ID NO: 192922 - DNA, 35 bp, Artificial Sequence
  Synthetic oligonucleotide
gagggtggagggtatgccatgaggtaggtgatgag

SEQ ID NO: 192923 - DNA, 35 bp, Artificial Sequence
  Synthetic oligonucleotide
agcgcgcacccgccttagagctcatccctgccccg

SEQ ID NO: 192924 - DNA, 35 bp, Artificial Sequence
  Synthetic oligonucleotide
atcgccgccccaccatgccgtttgtgtttttcccg

SEQ ID NO: 192925 - DNA, 35 bp, Artificial Sequence
  Synthetic oligonucleotide
gcgacttgcctttgttgccgcatcctgaaactccg

SEQ ID NO: 192926 - DNA, 35 bp, Artificial Sequence
  Synthetic oligonucleotide
gccgacgatcctccgctgctgccactaacatagcg

SEQ ID NO: 192927 - DNA, 35 bp, Artificial Sequence
  Synthetic oligonucleotide
tacccaacaccaccactcgtacatgcacagtagcg

SEQ ID NO: 192928 - DNA, 35 bp, Artificial Sequence
  Synthetic oligonucleotide
agtgtcccaccttccctatgctgttcaattcatcg

SEQ ID NO: 192929 - DNA, 35 bp, Artificial Sequence
  Synthetic oligonucleotide
ggacacgcggagaagggctggaaggggtctatggg

SEQ ID NO: 192930 - DNA, 35 bp, Artificial Sequence
  Synthetic oligonucleotide
gccctcctgcccgaattactgtctcacgaagcatg

SEQ ID NO: 192931 - DNA, 35 bp, Artificial Sequence
  Synthetic oligonucleotide
gctcgccaccgccgcttgcccccggacttagactg

SEQ ID NO: 192932 - DNA, 35 bp, Artificial Sequence
  Synthetic oligonucleotide
tgcctcctccgttctcgtgactctgcccttttttg

SEQ ID NO: 192933 - DNA, 35 bp, Artificial Sequence
  Synthetic oligonucleotide
gccgttccagcctaccttattgtactcaaacccat

SEQ ID NO: 192934 - DNA, 35 bp, Artificial Sequence
  Synthetic oligonucleotide
actggctcccattttagtacactgacctgccccat

SEQ ID NO: 192935 - DNA, 35 bp, Artificial Sequence
  Synthetic oligonucleotide
acacgcccacccccgcggaaagctaccagacctat

SEQ ID NO: 192936 - DNA, 35 bp, Artificial Sequence
  Synthetic oligonucleotide
tccactctacggacagccactctcgctatcattat

SEQ ID NO: 192937 - DNA, 35 bp, Artificial Sequence
  Synthetic oligonucleotide
atgctctgcacttcctgtatcgctaatctttccct

SEQ ID NO: 192938 - DNA, 35 bp, Artificial Sequence
  Synthetic oligonucleotide
gtccatccgattgtccgcgcgtctgacccatgcct

SEQ ID NO: 192939 - DNA, 35 bp, Artificial Sequence
  Synthetic oligonucleotide
tcaacaccatacgtagtcactccccgcttttgcct

SEQ ID NO: 192940 - DNA, 35 bp, Artificial Sequence
  Synthetic oligonucleotide
gatccaaccagactgtccgctccggttcccctcct

SEQ ID NO: 192941 - DNA, 35 bp, Artificial Sequence
  Synthetic oligonucleotide
gcatcgcacctctgattcctaatgccatcgctcct

SEQ ID NO: 192942 - DNA, 35 bp, Artificial Sequence
  Synthetic oligonucleotide
atccccccccgccgacgcacgtcacatcctctcct

SEQ ID NO: 192943 - DNA, 35 bp, Artificial Sequence
  Synthetic oligonucleotide
gaatcacgcatctgggtgccgccgtactgcttcct

SEQ ID NO: 192944 - DNA, 35 bp, Artificial Sequence
  Synthetic oligonucleotide
gtgagggggacgaccgggttaaaggcgaaggggct

SEQ ID NO: 192945 - DNA, 35 bp, Artificial Sequence
  Synthetic oligonucleotide
gccatggctcactgtacacacctttttgcactgct

SEQ ID NO: 192946 - DNA, 35 bp, Artificial Sequence
  Synthetic oligonucleotide
tgtcccggccattagcgaagctatctacacctgct

SEQ ID NO: 192947 - DNA, 35 bp, Artificial Sequence
  Synthetic oligonucleotide
taacactcctcctggtaccgcacaccagagcttct

SEQ ID NO: 192948 - DNA, 35 bp, Artificial Sequence
  Synthetic oligonucleotide
gccttgcactgcctcatttaccaaacacgttccgt

SEQ ID NO: 192949 - DNA, 35 bp, Artificial Sequence
  Synthetic oligonucleotide
acctcactctcaccgctcgaagatcagcacctcgt

SEQ ID NO: 192950 - DNA, 35 bp, Artificial Sequence
  Synthetic oligonucleotide
gtgaatcgcggcgtattccgatctcgccctccctt

SEQ ID NO: 192951 - DNA, 35 bp, Artificial Sequence
  Synthetic oligonucleotide
tcctcaccgacaaacacctcgcgtttggagtcctt

SEQ ID NO: 192952 - DNA, 35 bp, Artificial Sequence
  Synthetic oligonucleotide
tactcccgtcatctcttttcgtctggcgtgtcctt

SEQ ID NO: 192953 - DNA, 35 bp, Artificial Sequence
  Synthetic oligonucleotide
gcgcactccgtcggttccgtctctcgttgttggtt

SEQ ID NO: 192954 - DNA, 35 bp, Artificial Sequence
  Synthetic oligonucleotide
tgatgcaacgcacgctgccgtacctagcctagttt

SEQ ID NO: 192955 - DNA, 35 bp, Artificial Sequence
  Synthetic oligonucleotide
gtcgctgttccaccttttgtcaagccatccgcaaa

SEQ ID NO: 192956 - DNA, 36 bp, Artificial Sequence
  Synthetic oligonucleotide
ttcgctgcccgtgtgtacgtcctcctttgatcccaa

SEQ ID NO: 192957 - DNA, 36 bp, Artificial Sequence
  Synthetic oligonucleotide
agcatcggactcatcctgtccactcgcctctagcaa

SEQ ID NO: 192958 - DNA, 36 bp, Artificial Sequence
  Synthetic oligonucleotide
gaccatgcgcccgcctagattcccgctcttgttcaa

SEQ ID NO: 192959 - DNA, 36 bp, Artificial Sequence
  Synthetic oligonucleotide
tactacgttgcccttgcatttgataccactcttgaa

SEQ ID NO: 192960 - DNA, 36 bp, Artificial Sequence
  Synthetic oligonucleotide
tagcacagaccgacttgtcattacctaccgccataa

SEQ ID NO: 192961 - DNA, 35 bp, Artificial Sequence
  Synthetic oligonucleotide
tccgcggaggacacaatgaaggaaaaggcggataa

SEQ ID NO: 192962 - DNA, 36 bp, Artificial Sequence
  Synthetic oligonucleotide
ggtgatacagtcgaagtgtggggggtggggcggtaa

SEQ ID NO: 192963 - DNA, 34 bp, Artificial Sequence
  Synthetic oligonucleotide
acttcagccatcaccctcgtcgttttcccattaa

SEQ ID NO: 192964 - DNA, 36 bp, Artificial Sequence
  Synthetic oligonucleotide
acaccccctctgtctcggtcactgacctgtccttaa

SEQ ID NO: 192965 - DNA, 35 bp, Artificial Sequence
  Synthetic oligonucleotide
gatgccatcctctggagttttcttatattcacaca

SEQ ID NO: 192966 - DNA, 36 bp, Artificial Sequence
  Synthetic oligonucleotide
attaccgccacatttcttttgctcgacgccttgcca

SEQ ID NO: 192967 - DNA, 36 bp, Artificial Sequence
  Synthetic oligonucleotide
gaccacccagtaagggttatcttactcctctatcca

SEQ ID NO: 192968 - DNA, 36 bp, Artificial Sequence
  Synthetic oligonucleotide
gagcaccggagcgtactcgcagccccttccagtcca

SEQ ID NO: 192969 - DNA, 36 bp, Artificial Sequence
  Synthetic oligonucleotide
tatccgtcacctccgtcctttgtcatttgaattcca

SEQ ID NO: 192970 - DNA, 36 bp, Artificial Sequence
  Synthetic oligonucleotide
aatttgccgccgctcttgtgcgtctgaacccttcca

SEQ ID NO: 192971 - DNA, 35 bp, Artificial Sequence
  Synthetic oligonucleotide
gtccaccagcccagacggatcggcctcaccactca

SEQ ID NO: 192972 - DNA, 36 bp, Artificial Sequence
  Synthetic oligonucleotide
aaggagagcaaagggggcaagagggggtggcgctca

SEQ ID NO: 192973 - DNA, 35 bp, Artificial Sequence
  Synthetic oligonucleotide
accaccgccccatgatggctcctttgcatccttca

SEQ ID NO: 192974 - DNA, 36 bp, Artificial Sequence
  Synthetic oligonucleotide
tccgatgcccatctccttgtaggtactgtttcttca

SEQ ID NO: 192975 - DNA, 37 bp, Artificial Sequence
  Synthetic oligonucleotide
tgagatagggggcgcaaggaaagggcactgaaggaga

SEQ ID NO: 192976 - DNA, 37 bp, Artificial Sequence
  Synthetic oligonucleotide
acccaacaccacatctttagggtccctctttgaacga

SEQ ID NO: 192977 - DNA, 37 bp, Artificial Sequence
  Synthetic oligonucleotide
tccagtcgccacttgatcccacttcccctttgaccga

SEQ ID NO: 192978 - DNA, 35 bp, Artificial Sequence
  Synthetic oligonucleotide
atcgccccggacaccttctcgataagccataccga

SEQ ID NO: 192979 - DNA, 37 bp, Artificial Sequence
  Synthetic oligonucleotide
gcaatggggacaaggaggagaagaagagcttggccga

SEQ ID NO: 192980 - DNA, 37 bp, Artificial Sequence
  Synthetic oligonucleotide
tcacgtagcccattgtcagcctcacccgcgttgccga

SEQ ID NO: 192981 - DNA, 37 bp, Artificial Sequence
  Synthetic oligonucleotide
tccacccgctaccaggcctttgacgctccccaagcga

SEQ ID NO: 192982 - DNA, 37 bp, Artificial Sequence
  Synthetic oligonucleotide
gctgtatcacctgtcctcttgtatgtttgcccctcga

SEQ ID NO: 192983 - DNA, 36 bp, Artificial Sequence
  Synthetic oligonucleotide
ggatggggtcggggggtacatacaggggagagtcga

SEQ ID NO: 192984 - DNA, 37 bp, Artificial Sequence
  Synthetic oligonucleotide
atgtcagccccgttctgcgttcctcaagtgccttcga

SEQ ID NO: 192985 - DNA, 37 bp, Artificial Sequence
  Synthetic oligonucleotide
ttgaggggggacggatggggactatatgggaggagga

SEQ ID NO: 192986 - DNA, 35 bp, Artificial Sequence
  Synthetic oligonucleotide
gaatcgcaaagcggaaagggggcgaggaaagcgga

SEQ ID NO: 192987 - DNA, 37 bp, Artificial Sequence
  Synthetic oligonucleotide
tgtacgctgatctgcttgcatacccctcctccgcgga

SEQ ID NO: 192988 - DNA, 36 bp, Artificial Sequence
  Synthetic oligonucleotide
tgataaaggggggtggggcagacaggcgtcgaggga

SEQ ID NO: 192989 - DNA, 37 bp, Artificial Sequence
  Synthetic oligonucleotide
gcatataggcgggatagggaatgaagggatggaggga

SEQ ID NO: 192990 - DNA, 36 bp, Artificial Sequence
  Synthetic oligonucleotide
tctcatgcgatagggacgggggggaccggggaatga

SEQ ID NO: 192991 - DNA, 37 bp, Artificial Sequence
  Synthetic oligonucleotide
gacgtccacgtagagtctcttcctccttcccccatga

SEQ ID NO: 192992 - DNA, 37 bp, Artificial Sequence
  Synthetic oligonucleotide
gcccaggtccctgggtgttccgtatcttctctcatga

SEQ ID NO: 192993 - DNA, 38 bp, Artificial Sequence
  Synthetic oligonucleotide
gggaatggtaaggagggaggggtagaagccggagatga

SEQ ID NO: 192994 - DNA, 38 bp, Artificial Sequence
  Synthetic oligonucleotide
acgacggtggtgggggggggatgaggctgtcattatga

SEQ ID NO: 192995 - DNA, 38 bp, Artificial Sequence
  Synthetic oligonucleotide
gagtaggggcccaaggataagcaacggggagagactga

SEQ ID NO: 192996 - DNA, 38 bp, Artificial Sequence
  Synthetic oligonucleotide
acaacgcacaatatctttaactgccacccccgacctga

SEQ ID NO: 192997 - DNA, 37 bp, Artificial Sequence
  Synthetic oligonucleotide
tgcatcgcctgtgagctccaccctacgttccccctga

SEQ ID NO: 192998 - DNA, 37 bp, Artificial Sequence
  Synthetic oligonucleotide
attctcaccgtcacgaactgcataccctctgccctga

SEQ ID NO: 192999 - DNA, 38 bp, Artificial Sequence
  Synthetic oligonucleotide
gacgggtggagtgggtgcgacgggctctgtcttcctga

SEQ ID NO: 193000 - DNA, 38 bp, Artificial Sequence
  Synthetic oligonucleotide
atccgcatccgcattgcgatcacctcacgaccttctga

SEQ ID NO: 193001 - DNA, 38 bp, Artificial Sequence
  Synthetic oligonucleotide
tgctccaccgccacactgcatactggcatccgacgtga

SEQ ID NO: 193002 - DNA, 37 bp, Artificial Sequence
  Synthetic oligonucleotide
tacccgcaccccctctgcgtcgtataccgcccggtga

SEQ ID NO: 193003 - DNA, 38 bp, Artificial Sequence
  Synthetic oligonucleotide
gacaccgcccgaaggggcaagaacagggggggcggtga

SEQ ID NO: 193004 - DNA, 35 bp, Artificial Sequence
  Synthetic oligonucleotide
gtgactgggaagggagaacgggttataccgggtga

SEQ ID NO: 193005 - DNA, 37 bp, Artificial Sequence
  Synthetic oligonucleotide
gcggggtgggaggggcattatcggacaaaatgggtga

SEQ ID NO: 193006 - DNA, 38 bp, Artificial Sequence
  Synthetic oligonucleotide
acgtgtttgccgcagtgtcctttcccatctcactgtga

SEQ ID NO: 193007 - DNA, 36 bp, Artificial Sequence
  Synthetic oligonucleotide
tcctgtcgctatctctgttctctcgtcctcaattga

SEQ ID NO: 193008 - DNA, 37 bp, Artificial Sequence
  Synthetic oligonucleotide
gtccgagcgggtggaacgggggggcggagccgattga

SEQ ID NO: 193009 - DNA, 38 bp, Artificial Sequence
  Synthetic oligonucleotide
gaacatgcgcaacgtctgccctttgataccacccttga

SEQ ID NO: 193010 - DNA, 37 bp, Artificial Sequence
  Synthetic oligonucleotide
gacacgtccatcgccttcgatccagctccacgcttga

SEQ ID NO: 193011 - DNA, 37 bp, Artificial Sequence
  Synthetic oligonucleotide
tgttcacccgcagatctacgcttgtccgtcctcttga

SEQ ID NO: 193012 - DNA, 38 bp, Artificial Sequence
  Synthetic oligonucleotide
atcacgctcgtgatccgtgcgtaacctaccccttttga

SEQ ID NO: 193013 - DNA, 37 bp, Artificial Sequence
  Synthetic oligonucleotide
gtgccctcttcaggtcgtttgccgccctttcttttga

SEQ ID NO: 193014 - DNA, 35 bp, Artificial Sequence
  Synthetic oligonucleotide
aacacgctcacccccttcagtaagctccacccata

SEQ ID NO: 193015 - DNA, 36 bp, Artificial Sequence
  Synthetic oligonucleotide
agcaaccgcagcccatgttatcgcccctcgcccata

SEQ ID NO: 193016 - DNA, 35 bp, Artificial Sequence
  Synthetic oligonucleotide
agacctcccgatcgctcctctgggccaattccata

SEQ ID NO: 193017 - DNA, 36 bp, Artificial Sequence
  Synthetic oligonucleotide
atttcgccgccgcaatctaggttcatccaggcacta

SEQ ID NO: 193018 - DNA, 36 bp, Artificial Sequence
  Synthetic oligonucleotide
gtaccccctgttatctctatctcgaggctgttacta

SEQ ID NO: 193019 - DNA, 35 bp, Artificial Sequence
  Synthetic oligonucleotide
accctcccgtacgcatgccaagctttaccaaccta

SEQ ID NO: 193020 - DNA, 35 bp, Artificial Sequence
  Synthetic oligonucleotide
gattgctgtcccgtctttacgctccctctggccta

SEQ ID NO: 193021 - DNA, 36 bp, Artificial Sequence
  Synthetic oligonucleotide
tgcatggccaggccgtttcattcactctacctccta

SEQ ID NO: 193022 - DNA, 35 bp, Artificial Sequence
  Synthetic oligonucleotide
tcgccactttcagcacgcccccccgtcctgtccta

SEQ ID NO: 193023 - DNA, 35 bp, Artificial Sequence
  Synthetic oligonucleotide
gcctccatcggccctgtattcatctaccattgcta

SEQ ID NO: 193024 - DNA, 36 bp, Artificial Sequence
  Synthetic oligonucleotide
tgtcacctccggccccctgacactaatacgtactta

SEQ ID NO: 193025 - DNA, 35 bp, Artificial Sequence
  Synthetic oligonucleotide
agtcatcccacctgaatacggtccgtgcactctta

SEQ ID NO: 193026 - DNA, 36 bp, Artificial Sequence
  Synthetic oligonucleotide
gaggagaggcgatgagggagggtgcgttcgatgtta

SEQ ID NO: 193027 - DNA, 35 bp, Artificial Sequence
  Synthetic oligonucleotide
tgaccgcgtagagtttagtcccgttttccgtccac

SEQ ID NO: 193028 - DNA, 34 bp, Artificial Sequence
  Synthetic oligonucleotide
gtgagccccactaacatcgtcctacggcttccac

SEQ ID NO: 193029 - DNA, 34 bp, Artificial Sequence
  Synthetic oligonucleotide
acgcccggtgtttctgcctctcttcccttgctac

SEQ ID NO: 193030 - DNA, 35 bp, Artificial Sequence
  Synthetic oligonucleotide
gtgacccatcaatgttcacgcttgtccctgccacc

SEQ ID NO: 193031 - DNA, 35 bp, Artificial Sequence
  Synthetic oligonucleotide
gtagctcgatgtacgctcgcccatcttctgaaccc

SEQ ID NO: 193032 - DNA, 35 bp, Artificial Sequence
  Synthetic oligonucleotide
acccctctcctcgatggttttcgaggtattacccc

SEQ ID NO: 193033 - DNA, 35 bp, Artificial Sequence
  Synthetic oligonucleotide
tgatacgaccagtcgtcgataccagcaagcccccc

SEQ ID NO: 193034 - DNA, 35 bp, Artificial Sequence
  Synthetic oligonucleotide
atcactctgctatcgtttatttcgacacctgcccc

SEQ ID NO: 193035 - DNA, 35 bp, Artificial Sequence
  Synthetic oligonucleotide
gaacgttgcccccgtgacacaggttattgctcccc

SEQ ID NO: 193036 - DNA, 35 bp, Artificial Sequence
  Synthetic oligonucleotide
ttcgccagtccagctctttcctaaacgctttgccc

SEQ ID NO: 193037 - DNA, 35 bp, Artificial Sequence
  Synthetic oligonucleotide
tgtggccccaccatacctgataacagccttctccc

SEQ ID NO: 193038 - DNA, 35 bp, Artificial Sequence
  Synthetic oligonucleotide
tgtgctgcctcctcatctaatcgcctcgggagtcc

SEQ ID NO: 193039 - DNA, 35 bp, Artificial Sequence
  Synthetic oligonucleotide
gcccctgcccatgttgcatcccgcttccatagtcc

SEQ ID NO: 193040 - DNA, 35 bp, Artificial Sequence
  Synthetic oligonucleotide
taggtcactcgtcacactcatcgttgccacattcc

SEQ ID NO: 193041 - DNA, 35 bp, Artificial Sequence
  Synthetic oligonucleotide
tgtgtgcctcgcctgattatacctgcggcccttcc

SEQ ID NO: 193042 - DNA, 35 bp, Artificial Sequence
  Synthetic oligonucleotide
gtacgcagacccaacggtgatctacttggccttcc

SEQ ID NO: 193043 - DNA, 35 bp, Artificial Sequence
  Synthetic oligonucleotide
gatccagctgtgtgtacatgcttgtcccttcttcc

SEQ ID NO: 193044 - DNA, 35 bp, Artificial Sequence
  Synthetic oligonucleotide
gtcgacacacccattaggccctcacgttttaacgc

SEQ ID NO: 193045 - DNA, 35 bp, Artificial Sequence
  Synthetic oligonucleotide
atgtgctgggccgccctctaacatccctcccacgc

SEQ ID NO: 193046 - DNA, 35 bp, Artificial Sequence
  Synthetic oligonucleotide
tccctgcatccctgtgtaactcagaacccccccgc

SEQ ID NO: 193047 - DNA, 35 bp, Artificial Sequence
  Synthetic oligonucleotide
tccccggtcctcaccagctttctcactcgcctcgc

SEQ ID NO: 193048 - DNA, 35 bp, Artificial Sequence
  Synthetic oligonucleotide
tagcctcgaacgtttacactcgccactgacttcgc

SEQ ID NO: 193049 - DNA, 35 bp, Artificial Sequence
  Synthetic oligonucleotide
atacgcccctctggtactcgttcagccacccctgc

SEQ ID NO: 193050 - DNA, 35 bp, Artificial Sequence
  Synthetic oligonucleotide
aggaacgctgtaccactgaaacactgcccctctgc

SEQ ID NO: 193051 - DNA, 35 bp, Artificial Sequence
  Synthetic oligonucleotide
atcatgccctctgaactcttatgaattgcctgtgc

SEQ ID NO: 193052 - DNA, 35 bp, Artificial Sequence
  Synthetic oligonucleotide
tatcgccctctgtgaagtgccactcttcatattgc

SEQ ID NO: 193053 - DNA, 35 bp, Artificial Sequence
  Synthetic oligonucleotide
ggacctcgctgagccgctgcccctctctatcttgc

SEQ ID NO: 193054 - DNA, 35 bp, Artificial Sequence
  Synthetic oligonucleotide
atctcccccatcgtagtactcccgctctaggaatc

SEQ ID NO: 193055 - DNA, 35 bp, Artificial Sequence
  Synthetic oligonucleotide
gcaatctccctgcggccacacctgtctaggccatc

SEQ ID NO: 193056 - DNA, 35 bp, Artificial Sequence
  Synthetic oligonucleotide
gcaggtccccgtagttctttgactctccttacctc

SEQ ID NO: 193057 - DNA, 35 bp, Artificial Sequence
  Synthetic oligonucleotide
gtgcccccagaccggcgttgtgcgcaccgatcctc

SEQ ID NO: 193058 - DNA, 35 bp, Artificial Sequence
  Synthetic oligonucleotide
aaggattgcgcacctcgacgacctgcctacatctc

SEQ ID NO: 193059 - DNA, 36 bp, Artificial Sequence
  Synthetic oligonucleotide
gcctcgcgcgcctttctgatttagtctgcatccgtc

SEQ ID NO: 193060 - DNA, 33 bp, Artificial Sequence
  Synthetic oligonucleotide
acactgtccgggtaaacatccccccttcgtttc

SEQ ID NO: 193061 - DNA, 35 bp, Artificial Sequence
  Synthetic oligonucleotide
gtaaggagtagcgacggggaggaaggaacggtaag

SEQ ID NO: 193062 - DNA, 35 bp, Artificial Sequence
  Synthetic oligonucleotide
accggggcctcacagttctatcatatgtcacctag

SEQ ID NO: 193063 - DNA, 35 bp, Artificial Sequence
  Synthetic oligonucleotide
atgatcctcccgcgtgcttccactggcgctctacg

SEQ ID NO: 193064 - DNA, 35 bp, Artificial Sequence
  Synthetic oligonucleotide
acttacatcccagaggtctggtcccacactcatcg

SEQ ID NO: 193065 - DNA, 35 bp, Artificial Sequence
  Synthetic oligonucleotide
tgccacggcctcaataccctcccaccttaccacgg

SEQ ID NO: 193066 - DNA, 35 bp, Artificial Sequence
  Synthetic oligonucleotide
aacaaggacaagaggcggagaaggggttgtggcgg

SEQ ID NO: 193067 - DNA, 35 bp, Artificial Sequence
  Synthetic oligonucleotide
ggagccccccgcggttgtctgccttcccatcaatg

SEQ ID NO: 193068 - DNA, 35 bp, Artificial Sequence
  Synthetic oligonucleotide
atcatacgcgagatcccaggcctcaccaccacttg

SEQ ID NO: 193069 - DNA, 35 bp, Artificial Sequence
  Synthetic oligonucleotide
gtggagcaggggcgtgagagggaggaagacagttg

SEQ ID NO: 193070 - DNA, 35 bp, Artificial Sequence
  Synthetic oligonucleotide
gtgcgaactttctgcccgggcccttcgatactttg

SEQ ID NO: 193071 - DNA, 35 bp, Artificial Sequence
  Synthetic oligonucleotide
tacagccccgctcctgagtctcgtaacgtcgcaat

SEQ ID NO: 193072 - DNA, 35 bp, Artificial Sequence
  Synthetic oligonucleotide
tagagcccgatccgcctgcctttagaatttaacat

SEQ ID NO: 193073 - DNA, 35 bp, Artificial Sequence
  Synthetic oligonucleotide
agttcgtcctcggcttcgagttctgtcttcaccat

SEQ ID NO: 193074 - DNA, 35 bp, Artificial Sequence
  Synthetic oligonucleotide
tgagatcgcatcattcgataacttctcgctcccat

SEQ ID NO: 193075 - DNA, 35 bp, Artificial Sequence
  Synthetic oligonucleotide
tcctcgccgcccgctgttacttacctccaccgcat

SEQ ID NO: 193076 - DNA, 36 bp, Artificial Sequence
  Synthetic oligonucleotide
gattaagcgaagagggggaaaaggggagtaattgat

SEQ ID NO: 193077 - DNA, 35 bp, Artificial Sequence
  Synthetic oligonucleotide
tagggcgaatgggggagagagggcatgaagcttat

SEQ ID NO: 193078 - DNA, 35 bp, Artificial Sequence
  Synthetic oligonucleotide
aagaggggccggaagaatatggagcgtacggttat

SEQ ID NO: 193079 - DNA, 35 bp, Artificial Sequence
  Synthetic oligonucleotide
atcatactcctcgcctcggcctcctatcgagacct

SEQ ID NO: 193080 - DNA, 35 bp, Artificial Sequence
  Synthetic oligonucleotide
gcgtacgccgagcgccacgactcacatccttacct

SEQ ID NO: 193081 - DNA, 35 bp, Artificial Sequence
  Synthetic oligonucleotide
gagctgctgccccgcgccttcctaccgagctccct

SEQ ID NO: 193082 - DNA, 35 bp, Artificial Sequence
  Synthetic oligonucleotide
gcacccttccgtcttctcttcgtgagggattccct

SEQ ID NO: 193083 - DNA, 35 bp, Artificial Sequence
  Synthetic oligonucleotide
gaggacataccgcccgtcgagcgatccgtttccct

SEQ ID NO: 193084 - DNA, 35 bp, Artificial Sequence
  Synthetic oligonucleotide
tgcccttactgaaagtgcttacgacctcctatcct

SEQ ID NO: 193085 - DNA, 35 bp, Artificial Sequence
  Synthetic oligonucleotide
tgaactcaatcgctcatcaagcgtatcaacctcct

SEQ ID NO: 193086 - DNA, 35 bp, Artificial Sequence
  Synthetic oligonucleotide
actcagcttggtgtcgcccttctccagatcctcct

SEQ ID NO: 193087 - DNA, 35 bp, Artificial Sequence
  Synthetic oligonucleotide
tgactgctcccaggctcatgtcctcttaacttcct

SEQ ID NO: 193088 - DNA, 35 bp, Artificial Sequence
  Synthetic oligonucleotide
atgtaccgctacacatcatccacagtccccgggct

SEQ ID NO: 193089 - DNA, 35 bp, Artificial Sequence
  Synthetic oligonucleotide
atgctgttggcctgtaacgtgccatcccattctct

SEQ ID NO: 193090 - DNA, 35 bp, Artificial Sequence
  Synthetic oligonucleotide
gaaggagcatcccgttgttcattcgtaatccttct

SEQ ID NO: 193091 - DNA, 35 bp, Artificial Sequence
  Synthetic oligonucleotide
acagtcgaggtggggggacggatagtgggcaaagt

SEQ ID NO: 193092 - DNA, 35 bp, Artificial Sequence
  Synthetic oligonucleotide
gttgccctaaatgcccttccccctactgaggtcgt

SEQ ID NO: 193093 - DNA, 35 bp, Artificial Sequence
  Synthetic oligonucleotide
gaaacacatcagcatgagcgcaggggcgggggggt

SEQ ID NO: 193094 - DNA, 35 bp, Artificial Sequence
  Synthetic oligonucleotide
gacgcccctcccgatcgcctactcacggagcactt

SEQ ID NO: 193095 - DNA, 35 bp, Artificial Sequence
  Synthetic oligonucleotide
tgtggtcgtacacattactctctcagttccgcctt

SEQ ID NO: 193096 - DNA, 35 bp, Artificial Sequence
  Synthetic oligonucleotide
tcacccgcctcacagccattacccatgcagtgctt

SEQ ID NO: 193097 - DNA, 35 bp, Artificial Sequence
  Synthetic oligonucleotide
tctcgcctcactctgcgcgagctttcaccttggtt

SEQ ID NO: 193098 - DNA, 35 bp, Artificial Sequence
  Synthetic oligonucleotide
aacttccacgcaggacgcatatcgcaccacacttt

SEQ ID NO: 193099 - DNA, 35 bp, Artificial Sequence
  Synthetic oligonucleotide
tccgatcattctgctgcccttttcactagtccttt

SEQ ID NO: 193100 - DNA, 35 bp, Artificial Sequence
  Synthetic oligonucleotide
tgtacatgcgcagccagtccacccgtctagttttt

SEQ ID NO: 193101 - DNA, 36 bp, Artificial Sequence
  Synthetic oligonucleotide
atcgtagggcgggggggtagcacagggtaacaccaa

SEQ ID NO: 193102 - DNA, 35 bp, Artificial Sequence
  Synthetic oligonucleotide
acgtacctcacccccggaattgctcctaagtagaa

SEQ ID NO: 193103 - DNA, 36 bp, Artificial Sequence
  Synthetic oligonucleotide
gtggcaaccgccgctaaaatagaacaccccccgtaa

SEQ ID NO: 193104 - DNA, 35 bp, Artificial Sequence
  Synthetic oligonucleotide
gagtagcgggagggtggaagggcgatgggccgtaa

SEQ ID NO: 193105 - DNA, 36 bp, Artificial Sequence
  Synthetic oligonucleotide
gatccgcccttctgcaccttccgatcacagatcaca

SEQ ID NO: 193106 - DNA, 35 bp, Artificial Sequence
  Synthetic oligonucleotide
ttaccccagacttctcgccacgtacaccgttacca

SEQ ID NO: 193107 - DNA, 36 bp, Artificial Sequence
  Synthetic oligonucleotide
tctcattgcccacatgtcacggcgccgggccaccca

SEQ ID NO: 193108 - DNA, 36 bp, Artificial Sequence
  Synthetic oligonucleotide
gacccaacaaggctgaataaagcctcactctaccca

SEQ ID NO: 193109 - DNA, 35 bp, Artificial Sequence
  Synthetic oligonucleotide
gttgtccatctgctaacgaccattattcttaccca

SEQ ID NO: 193110 - DNA, 36 bp, Artificial Sequence
  Synthetic oligonucleotide
ttaccgccccatggatttagaatgtgtttcccccca

SEQ ID NO: 193111 - DNA, 36 bp, Artificial Sequence
  Synthetic oligonucleotide
atggcgtgtgccctgtctttaatgttccgctgccca

SEQ ID NO: 193112 - DNA, 36 bp, Artificial Sequence
  Synthetic oligonucleotide
ggtcatccgtacacacgtatggcttccattattcca

SEQ ID NO: 193113 - DNA, 36 bp, Artificial Sequence
  Synthetic oligonucleotide
acccgaccccctgctaatgccagcaggtttattcca

SEQ ID NO: 193114 - DNA, 36 bp, Artificial Sequence
  Synthetic oligonucleotide
tgcactccaacctccgtgtgtccacctcgaactgca

SEQ ID NO: 193115 - DNA, 36 bp, Artificial Sequence
  Synthetic oligonucleotide
gacaagaacaggaggagaagatgaggctgaagtgca

SEQ ID NO: 193116 - DNA, 36 bp, Artificial Sequence
  Synthetic oligonucleotide
gctggacacctcgcactgataataacaccacgctca

SEQ ID NO: 193117 - DNA, 36 bp, Artificial Sequence
  Synthetic oligonucleotide
gtcgccaacccccctgccgtgcgaagcttatattca

SEQ ID NO: 193118 - DNA, 34 bp, Artificial Sequence
  Synthetic oligonucleotide
acgccaacccaggccacatgctcttctagcttca

SEQ ID NO: 193119 - DNA, 37 bp, Artificial Sequence
  Synthetic oligonucleotide
acgccgacagggtggaggacggatgggaggtagaaga

SEQ ID NO: 193120 - DNA, 37 bp, Artificial Sequence
  Synthetic oligonucleotide
gcacggggatgaaggcggtggaggcggaagtagcaga

SEQ ID NO: 193121 - DNA, 36 bp, Artificial Sequence
  Synthetic oligonucleotide
acacgctcctcccgtctttatttttcagtccgcaga

SEQ ID NO: 193122 - DNA, 37 bp, Artificial Sequence
  Synthetic oligonucleotide
gtcgccgcacaccacctgctcaatttgccccttgaga

SEQ ID NO: 193123 - DNA, 37 bp, Artificial Sequence
  Synthetic oligonucleotide
tccgacgctctctctgtctgcttcccgattctgacga

SEQ ID NO: 193124 - DNA, 37 bp, Artificial Sequence
  Synthetic oligonucleotide
tccacaccaattgggtctgaacccccgcacataccga

SEQ ID NO: 193125 - DNA, 37 bp, Artificial Sequence
  Synthetic oligonucleotide
tggatgtcccacctagctaagcccacgcccttaccga

SEQ ID NO: 193126 - DNA, 37 bp, Artificial Sequence
  Synthetic oligonucleotide
acctctgccatctgttcgtcctcacagccaatgccga

SEQ ID NO: 193127 - DNA, 37 bp, Artificial Sequence
  Synthetic oligonucleotide
cagcccgcaccgcccacgggttgttaaacacctccga

SEQ ID NO: 193128 - DNA, 37 bp, Artificial Sequence
  Synthetic oligonucleotide
gtatcccgcgtacggactaacaagccctcctctccga

SEQ ID NO: 193129 - DNA, 37 bp, Artificial Sequence
  Synthetic oligonucleotide
tcccatacgacctgctgcttatcttgacgccacgcga

SEQ ID NO: 193130 - DNA, 35 bp, Artificial Sequence
  Synthetic oligonucleotide
tacagccacccatcagatcatctgcaccatctcga

SEQ ID NO: 193131 - DNA, 37 bp, Artificial Sequence
  Synthetic oligonucleotide
tacacctatcctgatttccataacgctgttccttcga

SEQ ID NO: 193132 - DNA, 37 bp, Artificial Sequence
  Synthetic oligonucleotide
gcctccggcctgagcttatcatcttccacccttagga

SEQ ID NO: 193133 - DNA, 37 bp, Artificial Sequence
  Synthetic oligonucleotide
ggtaccacgccccccggtttcgcccctcaaatacgga

SEQ ID NO: 193134 - DNA, 37 bp, Artificial Sequence
  Synthetic oligonucleotide
gaggatgagggggggatactaagcagtggctggcgga

SEQ ID NO: 193135 - DNA, 37 bp, Artificial Sequence
  Synthetic oligonucleotide
gaacatcgatgctgccccttcgtcccctctttgcgga

SEQ ID NO: 193136 - DNA, 37 bp, Artificial Sequence
  Synthetic oligonucleotide
atggggacagtgagtaagtggaaaggggagcacggga

SEQ ID NO: 193137 - DNA, 36 bp, Artificial Sequence
  Synthetic oligonucleotide
gaaaaacgtggacaagggctaggtgggtggacggga

SEQ ID NO: 193138 - DNA, 37 bp, Artificial Sequence
  Synthetic oligonucleotide
tcgagggtcaagtcatgggggcgggaagtgctcggga

SEQ ID NO: 193139 - DNA, 37 bp, Artificial Sequence
  Synthetic oligonucleotide
tgaagtggagtgggggactatggaagaggacagggga

SEQ ID NO: 193140 - DNA, 36 bp, Artificial Sequence
  Synthetic oligonucleotide
atacgcctcggagctctaacgccttcctttcgggga

SEQ ID NO: 193141 - DNA, 37 bp, Artificial Sequence
  Synthetic oligonucleotide
tacacaaaaggggcggaaacgggagggagaccctgga

SEQ ID NO: 193142 - DNA, 38 bp, Artificial Sequence
  Synthetic oligonucleotide
tccaccattctgcctgcattacgaaccaacctgtatga

SEQ ID NO: 193143 - DNA, 38 bp, Artificial Sequence
  Synthetic oligonucleotide
gtgatctctgtcacgcgtgcccatcccgccttttatga

SEQ ID NO: 193144 - DNA, 37 bp, Artificial Sequence
  Synthetic oligonucleotide
atctgcgcaggtttaacggccccatcctcttttatga

SEQ ID NO: 193145 - DNA, 37 bp, Artificial Sequence
  Synthetic oligonucleotide
tgtataccacacgatccacacatgctctggctcctga

SEQ ID NO: 193146 - DNA, 37 bp, Artificial Sequence
  Synthetic oligonucleotide
tagtgccgcgcccgacttcctgtacttcgcctgctga

SEQ ID NO: 193147 - DNA, 37 bp, Artificial Sequence
  Synthetic oligonucleotide
gtccgccccatcttttggcccattgcacttttagtga

SEQ ID NO: 193148 - DNA, 38 bp, Artificial Sequence
  Synthetic oligonucleotide
gtgaccccccgactacgccactgtcagtccttgcgtga

SEQ ID NO: 193149 - DNA, 38 bp, Artificial Sequence
  Synthetic oligonucleotide
tgaagcggaggggagggtagatgaggcgcagagggtga

SEQ ID NO: 193150 - DNA, 38 bp, Artificial Sequence
  Synthetic oligonucleotide
acgaaggggggggcggtatagcggggcgaaaggggtga

SEQ ID NO: 193151 - DNA, 38 bp, Artificial Sequence
  Synthetic oligonucleotide
aacgcgggtcgggtgggtactttgggaatatattgtga

SEQ ID NO: 193152 - DNA, 36 bp, Artificial Sequence
  Synthetic oligonucleotide
tacggtgtgaggagggaggggtcggggctttattga

SEQ ID NO: 193153 - DNA, 38 bp, Artificial Sequence
  Synthetic oligonucleotide
tccagctcacgttccattgtttaatccaccacccttga

SEQ ID NO: 193154 - DNA, 37 bp, Artificial Sequence
  Synthetic oligonucleotide
ggtgggtaggtggagcaatagggcgataacaggttga

SEQ ID NO: 193155 - DNA, 37 bp, Artificial Sequence
  Synthetic oligonucleotide
tcacatgtcacatacttttttgcgcctcataatttga

SEQ ID NO: 193156 - DNA, 37 bp, Artificial Sequence
  Synthetic oligonucleotide
tccacccgtagtcacgcatttaacaacgcccttttga

SEQ ID NO: 193157 - DNA, 38 bp, Artificial Sequence
  Synthetic oligonucleotide
acgcggtcagttggtccccgccccactcttttttttga

SEQ ID NO: 193158 - DNA, 36 bp, Artificial Sequence
  Synthetic oligonucleotide
gagacacagccagcccgtctttcatcccagccaata

SEQ ID NO: 193159 - DNA, 36 bp, Artificial Sequence
  Synthetic oligonucleotide
gagtgcccggcccctgcgtactccgacttataccta

SEQ ID NO: 193160 - DNA, 35 bp, Artificial Sequence
  Synthetic oligonucleotide
tgacttgcctccacgtatcacctatttggccccta

SEQ ID NO: 193161 - DNA, 35 bp, Artificial Sequence
  Synthetic oligonucleotide
ttgtactcccctgtcttgcttgagcaagctcgcta

SEQ ID NO: 193162 - DNA, 36 bp, Artificial Sequence
  Synthetic oligonucleotide
acttatcacatctgttctgctttcgacacctgtcta

SEQ ID NO: 193163 - DNA, 36 bp, Artificial Sequence
  Synthetic oligonucleotide
tgatggggggtggggtgagtagttaggcgaatagta

SEQ ID NO: 193164 - DNA, 36 bp, Artificial Sequence
  Synthetic oligonucleotide
gcatcctctccgttgccatcaggacgcccatccgta

SEQ ID NO: 193165 - DNA, 34 bp, Artificial Sequence
  Synthetic oligonucleotide
tgatgcgcaagcttctcttactggccctcctgta

SEQ ID NO: 193166 - DNA, 36 bp, Artificial Sequence
  Synthetic oligonucleotide
tccacccaccgctatgaaagcttgctaggtctctta

SEQ ID NO: 193167 - DNA, 35 bp, Artificial Sequence
  Synthetic oligonucleotide
tgcggctagcaacggcatctgtccttttcgccaac

SEQ ID NO: 193168 - DNA, 35 bp, Artificial Sequence
  Synthetic oligonucleotide
ttcaccacccgccttcagtacgcattgccccacac

SEQ ID NO: 193169 - DNA, 35 bp, Artificial Sequence
  Synthetic oligonucleotide
tgctatggcctcggtttcgcgcgcttctactacac

SEQ ID NO: 193170 - DNA, 35 bp, Artificial Sequence
  Synthetic oligonucleotide
tccagtcgccactacacgttcgccgttcccaccac

SEQ ID NO: 193171 - DNA, 35 bp, Artificial Sequence
  Synthetic oligonucleotide
tatgcgtctgcactcatttcccagtccgggcccac

SEQ ID NO: 193172 - DNA, 35 bp, Artificial Sequence
  Synthetic oligonucleotide
agtcacccccccgttcacgagttcacgtcgtgcac

SEQ ID NO: 193173 - DNA, 35 bp, Artificial Sequence
  Synthetic oligonucleotide
tgtcccatcaactgttcaccgttgccgttttgcac

SEQ ID NO: 193174 - DNA, 35 bp, Artificial Sequence
  Synthetic oligonucleotide
acggtcaccccgtggttctcggattccgccttcac

SEQ ID NO: 193175 - DNA, 35 bp, Artificial Sequence
  Synthetic oligonucleotide
tgacctccaagctccagttctccccggctcacgac

SEQ ID NO: 193176 - DNA, 35 bp, Artificial Sequence
  Synthetic oligonucleotide
ttcaactgccttgcccccgccgccaagagcccgac

SEQ ID NO: 193177 - DNA, 35 bp, Artificial Sequence
  Synthetic oligonucleotide
gtgtcgcgccgtccgtcgagctatgcactctctac

SEQ ID NO: 193178 - DNA, 35 bp, Artificial Sequence
  Synthetic oligonucleotide
gcgtgactgccagtctttccacattcttcccgtac

SEQ ID NO: 193179 - DNA, 35 bp, Artificial Sequence
  Synthetic oligonucleotide
gagccacccaccatctatcgggacaattgtcgtac

SEQ ID NO: 193180 - DNA, 35 bp, Artificial Sequence
  Synthetic oligonucleotide
gggtgggccacctagccagtattcgggcgggaacc

SEQ ID NO: 193181 - DNA, 35 bp, Artificial Sequence
  Synthetic oligonucleotide
tatccgatcaccttgtaccacgcgtctctaccacc

SEQ ID NO: 193182 - DNA, 35 bp, Artificial Sequence
  Synthetic oligonucleotide
tgtgacaacgactgcactatccaaagtctgttacc

SEQ ID NO: 193183 - DNA, 35 bp, Artificial Sequence
  Synthetic oligonucleotide
gctgactagccgatcgggttcttgagccacctccc

SEQ ID NO: 193184 - DNA, 35 bp, Artificial Sequence
  Synthetic oligonucleotide
tctcgctccgtatgcatttgccataggtcattccc

SEQ ID NO: 193185 - DNA, 35 bp, Artificial Sequence
  Synthetic oligonucleotide
ggtcacggtgccctacgtggtttcccggttttccc

SEQ ID NO: 193186 - DNA, 35 bp, Artificial Sequence
  Synthetic oligonucleotide
gttacggcgtgagttattgcccctgtttccacgcc

SEQ ID NO: 193187 - DNA, 35 bp, Artificial Sequence
  Synthetic oligonucleotide
gcgaccccgcattatcgcctgtgacttcctaggcc

SEQ ID NO: 193188 - DNA, 35 bp, Artificial Sequence
  Synthetic oligonucleotide
actcaagaccgtctcctccgtggcacatccatgcc

SEQ ID NO: 193189 - DNA, 36 bp, Artificial Sequence
  Synthetic oligonucleotide
tccacgcgcatattcacagcgtacacttacattgcc

SEQ ID NO: 193190 - DNA, 35 bp, Artificial Sequence
  Synthetic oligonucleotide
atccacgcccggcctcgctagaccgtcgttcctcc

SEQ ID NO: 193191 - DNA, 35 bp, Artificial Sequence
  Synthetic oligonucleotide
taaccgggtcccccatgaatgccaactgttgctcc

SEQ ID NO: 193192 - DNA, 35 bp, Artificial Sequence
  Synthetic oligonucleotide
gaaaccagcctcgccatgctgaaaaacctttctcc

SEQ ID NO: 193193 - DNA, 35 bp, Artificial Sequence
  Synthetic oligonucleotide
gcaccgttcagtccaataaataccgtccctagtcc

SEQ ID NO: 193194 - DNA, 35 bp, Artificial Sequence
  Synthetic oligonucleotide
aacccattgccgcttgcccgtgcctcacgtcgtcc

SEQ ID NO: 193195 - DNA, 35 bp, Artificial Sequence
  Synthetic oligonucleotide
atgacccctgtgctgtactccatacccggtattcc

SEQ ID NO: 193196 - DNA, 35 bp, Artificial Sequence
  Synthetic oligonucleotide
gtacacgcggagattagtgcgtcacccctccttcc

SEQ ID NO: 193197 - DNA, 35 bp, Artificial Sequence
  Synthetic oligonucleotide
gtacgctcacccgccctgaactattctctgcgagc

SEQ ID NO: 193198 - DNA, 35 bp, Artificial Sequence
  Synthetic oligonucleotide
tcacatccgcataccgacgtgctactaccacaggc

SEQ ID NO: 193199 - DNA, 35 bp, Artificial Sequence
  Synthetic oligonucleotide
gttgctccgccgccttctaattacgccgtgctggc

SEQ ID NO: 193200 - DNA, 35 bp, Artificial Sequence
  Synthetic oligonucleotide
acaccctgcgctaccccgtttgacgatacccatgc

SEQ ID NO: 193201 - DNA, 35 bp, Artificial Sequence
  Synthetic oligonucleotide
tatgcacgaacctatcttccgccacattgtactgc

SEQ ID NO: 193202 - DNA, 35 bp, Artificial Sequence
  Synthetic oligonucleotide
acatcactctgtcactgcatttatccggggcctgc

SEQ ID NO: 193203 - DNA, 35 bp, Artificial Sequence
  Synthetic oligonucleotide
tcttcccccgccgatttcgtcgtttagccctctgc

SEQ ID NO: 193204 - DNA, 35 bp, Artificial Sequence
  Synthetic oligonucleotide
tcagtgtcgcactcgatccaccacccgctccttgc

SEQ ID NO: 193205 - DNA, 35 bp, Artificial Sequence
  Synthetic oligonucleotide
ttgcacccgccatttatccacacgccttctcttgc

SEQ ID NO: 193206 - DNA, 35 bp, Artificial Sequence
  Synthetic oligonucleotide
agagacaaacagccggggagtaggggtggagtatc

SEQ ID NO: 193207 - DNA, 34 bp, Artificial Sequence
  Synthetic oligonucleotide
tccactacccgcgagatcgcgttcgtcccacctc

SEQ ID NO: 193208 - DNA, 35 bp, Artificial Sequence
  Synthetic oligonucleotide
gtccatcttacatcgtgtgcggttactacactctc

SEQ ID NO: 193209 - DNA, 29 bp, Artificial Sequence
  Synthetic oligonucleotide
tcacgcccgtcgcactccggtcacctctc

SEQ ID NO: 193210 - DNA, 35 bp, Artificial Sequence
  Synthetic oligonucleotide
acatcgccgtctgcccttatcgcacgatctgtctc

SEQ ID NO: 193211 - DNA, 35 bp, Artificial Sequence
  Synthetic oligonucleotide
tgtgcatgtccaacgctacccggtcctatattctc

SEQ ID NO: 193212 - DNA, 35 bp, Artificial Sequence
  Synthetic oligonucleotide
gtctgacacctgttcattttcgacttaactgagtc

SEQ ID NO: 193213 - DNA, 35 bp, Artificial Sequence
  Synthetic oligonucleotide
tgtttcgcctccctatgtctagtccgcctatggtc

SEQ ID NO: 193214 - DNA, 35 bp, Artificial Sequence
  Synthetic oligonucleotide
tccgcggcccttcaagctttggttatgttgccttc

SEQ ID NO: 193215 - DNA, 35 bp, Artificial Sequence
  Synthetic oligonucleotide
gcgtagctctcctgtccgcgatttccgtatgcttc

SEQ ID NO: 193216 - DNA, 35 bp, Artificial Sequence
  Synthetic oligonucleotide
aacatccacgcttctcagcgacattgtctgtcttc

SEQ ID NO: 193217 - DNA, 35 bp, Artificial Sequence
  Synthetic oligonucleotide
gatctccacttccactgcgtttctgctcacagttc

SEQ ID NO: 193218 - DNA, 35 bp, Artificial Sequence
  Synthetic oligonucleotide
atggtaggagtccgggtgggtgggagtgggggttc

SEQ ID NO: 193219 - DNA, 35 bp, Artificial Sequence
  Synthetic oligonucleotide
ttggttggtcggcctgcacttttgttccccatttc

SEQ ID NO: 193220 - DNA, 35 bp, Artificial Sequence
  Synthetic oligonucleotide
tcactcgctggactgacttaatatcgctcaccacg

SEQ ID NO: 193221 - DNA, 35 bp, Artificial Sequence
  Synthetic oligonucleotide
acatgtcccacctatcttgctccctgttttgtacg

SEQ ID NO: 193222 - DNA, 35 bp, Artificial Sequence
  Synthetic oligonucleotide
ggggtctccgtccatctgcccacctgtccgttacg

SEQ ID NO: 193223 - DNA, 35 bp, Artificial Sequence
  Synthetic oligonucleotide
attgacctcattgctccctcgcccaagccgccccg

SEQ ID NO: 193224 - DNA, 35 bp, Artificial Sequence
  Synthetic oligonucleotide
atccgcgtactactatcgttccgcccgttctttcg

SEQ ID NO: 193225 - DNA, 35 bp, Artificial Sequence
  Synthetic oligonucleotide
gaatgagcagataaagcaagtgaggcgggtgtagg

SEQ ID NO: 193226 - DNA, 35 bp, Artificial Sequence
  Synthetic oligonucleotide
gcacatataggcgagagagggggtacgatgagggg

SEQ ID NO: 193227 - DNA, 35 bp, Artificial Sequence
  Synthetic oligonucleotide
tctctgtgacagcaccgacccacgccgcccgactg

SEQ ID NO: 193228 - DNA, 35 bp, Artificial Sequence
  Synthetic oligonucleotide
gagcaccgccacaatcgttcttaccccgctccctg

SEQ ID NO: 193229 - DNA, 35 bp, Artificial Sequence
  Synthetic oligonucleotide
tagttgtatcacagttgttcacgtgccctttcctg

SEQ ID NO: 193230 - DNA, 35 bp, Artificial Sequence
  Synthetic oligonucleotide
taaggagcgaggggccgggtcggggggaagaccat

SEQ ID NO: 193231 - DNA, 35 bp, Artificial Sequence
  Synthetic oligonucleotide
gggggcgcccgacttcctgttttactccatcgcat

SEQ ID NO: 193232 - DNA, 35 bp, Artificial Sequence
  Synthetic oligonucleotide
acataccactgtccgcccttcgagtacatcccact

SEQ ID NO: 193233 - DNA, 35 bp, Artificial Sequence
  Synthetic oligonucleotide
gacgcgtgccgatattctccctttggcccatacct

SEQ ID NO: 193234 - DNA, 35 bp, Artificial Sequence
  Synthetic oligonucleotide
gtctacagccccactcaaagtcgaatttgctgcct

SEQ ID NO: 193235 - DNA, 35 bp, Artificial Sequence
  Synthetic oligonucleotide
agtacgaaggcctccgtttatcctcgccctatgct

SEQ ID NO: 193236 - DNA, 35 bp, Artificial Sequence
  Synthetic oligonucleotide
gatgcccactctgcactcgcccgagcgacactgct

SEQ ID NO: 193237 - DNA, 35 bp, Artificial Sequence
  Synthetic oligonucleotide
gccactctagcttacccgccgtgtttacgcctgct

SEQ ID NO: 193238 - DNA, 35 bp, Artificial Sequence
  Synthetic oligonucleotide
acacccccaccacatggatatgccgtatgtgatct

SEQ ID NO: 193239 - DNA, 35 bp, Artificial Sequence
  Synthetic oligonucleotide
ttcacctccactgactactaaatagaagtttatct

SEQ ID NO: 193240 - DNA, 35 bp, Artificial Sequence
  Synthetic oligonucleotide
accatccgcccttatgctactctgacgtccattct

SEQ ID NO: 193241 - DNA, 35 bp, Artificial Sequence
  Synthetic oligonucleotide
gaacggacagcccgtgcgtctttatcccgttttct

SEQ ID NO: 193242 - DNA, 35 bp, Artificial Sequence
  Synthetic oligonucleotide
gatcccccgtactggtcgtcctacacccacgacgt

SEQ ID NO: 193243 - DNA, 35 bp, Artificial Sequence
  Synthetic oligonucleotide
gacacccccactaccggtggcttctttcccaccgt

SEQ ID NO: 193244 - DNA, 35 bp, Artificial Sequence
  Synthetic oligonucleotide
tcatccagcccagaaccactagctccaccccccgt

SEQ ID NO: 193245 - DNA, 35 bp, Artificial Sequence
  Synthetic oligonucleotide
gcatcctgtgctttctagttccctgccatctcatt

SEQ ID NO: 193246 - DNA, 35 bp, Artificial Sequence
  Synthetic oligonucleotide
gccgtagactgttctccatgtaccctctctctgtt

SEQ ID NO: 193247 - DNA, 34 bp, Artificial Sequence
  Synthetic oligonucleotide
gcatcccctgaccgagcctataagccatctcttt

SEQ ID NO: 193248 - DNA, 35 bp, Artificial Sequence
  Synthetic oligonucleotide
gatcaccggtcccagtgtgccgccgttagccgttt

SEQ ID NO: 193249 - DNA, 36 bp, Artificial Sequence
  Synthetic oligonucleotide
acagagacggcataatgaagggggagggctgagcaa

SEQ ID NO: 193250 - DNA, 36 bp, Artificial Sequence
  Synthetic oligonucleotide
tagacgggagggggggcggtgactgatgaatttcaa

SEQ ID NO: 193251 - DNA, 36 bp, Artificial Sequence
  Synthetic oligonucleotide
tcgtgaacgcacttgtgccgtaactgtcccatctaa

SEQ ID NO: 193252 - DNA, 36 bp, Artificial Sequence
  Synthetic oligonucleotide
atgacgcctgtcctgtgaaccccccgcctcaagtaa

SEQ ID NO: 193253 - DNA, 35 bp, Artificial Sequence
  Synthetic oligonucleotide
gtgcccttcgctccatatagttatcccatctaaca

SEQ ID NO: 193254 - DNA, 36 bp, Artificial Sequence
  Synthetic oligonucleotide
ttgatccgagcctccccctgcgtttctagattcaca

SEQ ID NO: 193255 - DNA, 35 bp, Artificial Sequence
  Synthetic oligonucleotide
gagctcgacgtactcccccacgctgccttcctaca

SEQ ID NO: 193256 - DNA, 36 bp, Artificial Sequence
  Synthetic oligonucleotide
gccacattactccagccctgcgtttttagccgacca

SEQ ID NO: 193257 - DNA, 36 bp, Artificial Sequence
  Synthetic oligonucleotide
gctccacctctgattcggtcattaaacgcacgccca

SEQ ID NO: 193258 - DNA, 32 bp, Artificial Sequence
  Synthetic oligonucleotide
gtcaacgcaggacacgtaggcccgatctccca

SEQ ID NO: 193259 - DNA, 35 bp, Artificial Sequence
  Synthetic oligonucleotide
tctaccctcctcctcggaatgacatgtaagtccca

SEQ ID NO: 193260 - DNA, 32 bp, Artificial Sequence
  Synthetic oligonucleotide
ttgcatgcgcagtttcctgtcctccccccgca

SEQ ID NO: 193261 - DNA, 36 bp, Artificial Sequence
  Synthetic oligonucleotide
ggagagaagaggtaggtataggggtggagctaggca

SEQ ID NO: 193262 - DNA, 36 bp, Artificial Sequence
  Synthetic oligonucleotide
acaaagtgaaggacgggaaggagggcatgtgatgca

SEQ ID NO: 193263 - DNA, 35 bp, Artificial Sequence
  Synthetic oligonucleotide
ttgggcgggcacgaagggacgggaccaacggtgca

SEQ ID NO: 193264 - DNA, 36 bp, Artificial Sequence
  Synthetic oligonucleotide
gtatgcggccacctgcttctccacgccctgtgtgca

SEQ ID NO: 193265 - DNA, 35 bp, Artificial Sequence
  Synthetic oligonucleotide
tgactaccctgccccctgatcttggcacacgatca

SEQ ID NO: 193266 - DNA, 35 bp, Artificial Sequence
  Synthetic oligonucleotide
gcctcccaccaactcagatgcacgtctttcgatca

SEQ ID NO: 193267 - DNA, 36 bp, Artificial Sequence
  Synthetic oligonucleotide
agtgatgcgccactatcgtttctttccgtactgtca

SEQ ID NO: 193268 - DNA, 36 bp, Artificial Sequence
  Synthetic oligonucleotide
ttcccgcattccgccacatcgtatcctgtctcttca

SEQ ID NO: 193269 - DNA, 36 bp, Artificial Sequence
  Synthetic oligonucleotide
tgcctaccactgcgttgtcaaatcgttccctgttca

SEQ ID NO: 193270 - DNA, 37 bp, Artificial Sequence
  Synthetic oligonucleotide
tggagtcacgggggggcgggagtacatgggcacaaga

SEQ ID NO: 193271 - DNA, 37 bp, Artificial Sequence
  Synthetic oligonucleotide
aaagatcgcggcgaaaggcgtagagggggcggggaga

SEQ ID NO: 193272 - DNA, 36 bp, Artificial Sequence
  Synthetic oligonucleotide
gttaccgcatcccatcctgcacagtcctatcttaga

SEQ ID NO: 193273 - DNA, 37 bp, Artificial Sequence
  Synthetic oligonucleotide
tccccgcccggctaagttctttctgcaccatctacga

SEQ ID NO: 193274 - DNA, 37 bp, Artificial Sequence
  Synthetic oligonucleotide
tgcacccaactgtcttttcgagtcccacccagcccga

SEQ ID NO: 193275 - DNA, 35 bp, Artificial Sequence
  Synthetic oligonucleotide
tccctcgtcctaccgcgcctacccgctttgcccga

SEQ ID NO: 193276 - DNA, 36 bp, Artificial Sequence
  Synthetic oligonucleotide
tccgcctaacgacagcagccccccgtactccgccga

SEQ ID NO: 193277 - DNA, 35 bp, Artificial Sequence
  Synthetic oligonucleotide
gtacctcgcgcaacttgtaatatccctcatgccga

SEQ ID NO: 193278 - DNA, 37 bp, Artificial Sequence
  Synthetic oligonucleotide
gccaaccattgcgtttattctaccgccgctgcctcga

SEQ ID NO: 193279 - DNA, 37 bp, Artificial Sequence
  Synthetic oligonucleotide
gagtacgaggtggggggtaataggtagattaagagga

SEQ ID NO: 193280 - DNA, 37 bp, Artificial Sequence
  Synthetic oligonucleotide
gacctgaaggagggggtagggaataaggtgcggagga

SEQ ID NO: 193281 - DNA, 36 bp, Artificial Sequence
  Synthetic oligonucleotide
tcacctgcccctggtctgtttttttccgttcacgga

SEQ ID NO: 193282 - DNA, 35 bp, Artificial Sequence
  Synthetic oligonucleotide
tcgttactggccccatttgctacttatctcccgga

SEQ ID NO: 193283 - DNA, 37 bp, Artificial Sequence
  Synthetic oligonucleotide
gtcgattcaggcggaaggtgggggctggatggccgga

SEQ ID NO: 193284 - DNA, 37 bp, Artificial Sequence
  Synthetic oligonucleotide
tatgtggaggagggggcgtataagcagacaaggcgga

SEQ ID NO: 193285 - DNA, 37 bp, Artificial Sequence
  Synthetic oligonucleotide
gacgtcggtggaggcggggacatctctcggaggcgga

SEQ ID NO: 193286 - DNA, 37 bp, Artificial Sequence
  Synthetic oligonucleotide
gcacactgggtgttatggaagggcgcgaagggcggga

SEQ ID NO: 193287 - DNA, 37 bp, Artificial Sequence
  Synthetic oligonucleotide
atacgcgggggaggaggggccttcataccagggggga

SEQ ID NO: 193288 - DNA, 37 bp, Artificial Sequence
  Synthetic oligonucleotide
agcgggggttagagagggaaaagtaaggtggtgggga

SEQ ID NO: 193289 - DNA, 37 bp, Artificial Sequence
  Synthetic oligonucleotide
gacgaccgggtgcgtgtttcgatgggtggggctggga

SEQ ID NO: 193290 - DNA, 35 bp, Artificial Sequence
  Synthetic oligonucleotide
tagcccttccgcatctccttgcccgcttcgtggga

SEQ ID NO: 193291 - DNA, 37 bp, Artificial Sequence
  Synthetic oligonucleotide
gagtacgcaccattgcttctctccatgtcctactgga

SEQ ID NO: 193292 - DNA, 38 bp, Artificial Sequence
  Synthetic oligonucleotide
gtgagaagggggtaggtgagtgagggccagcgaaatga

SEQ ID NO: 193293 - DNA, 37 bp, Artificial Sequence
  Synthetic oligonucleotide
gtccgaagccgcctggtcccccgtccgcatttaatga

SEQ ID NO: 193294 - DNA, 38 bp, Artificial Sequence
  Synthetic oligonucleotide
gtccgggtgggagggaagtgacagggaatgaagcatga

SEQ ID NO: 193295 - DNA, 38 bp, Artificial Sequence
  Synthetic oligonucleotide
ggacacctgttctctgcctactttgccaacctctatga

SEQ ID NO: 193296 - DNA, 37 bp, Artificial Sequence
  Synthetic oligonucleotide
acacgcgtgatctgaaatcgctcaccccctttcctga

SEQ ID NO: 193297 - DNA, 37 bp, Artificial Sequence
  Synthetic oligonucleotide
ttgcgcactgcgtttattctggttccctcccatctga

SEQ ID NO: 193298 - DNA, 36 bp, Artificial Sequence
  Synthetic oligonucleotide
tccaccgccagtatcctcttggtacttacattctga

SEQ ID NO: 193299 - DNA, 37 bp, Artificial Sequence
  Synthetic oligonucleotide
gattcctcgcctccttatagttccgcactccccgtga

SEQ ID NO: 193300 - DNA, 36 bp, Artificial Sequence
  Synthetic oligonucleotide
ggacccctccccgtaaacttgccatctcaatcgtga

SEQ ID NO: 193301 - DNA, 38 bp, Artificial Sequence
  Synthetic oligonucleotide
gacgggtaaagggggtcgggcaagtactgggttggtga

SEQ ID NO: 193302 - DNA, 38 bp, Artificial Sequence
  Synthetic oligonucleotide
acagtcctctcctgccgctaagcccctacggtcattga

SEQ ID NO: 193303 - DNA, 29 bp, Artificial Sequence
  Synthetic oligonucleotide
tcatccgcctcctcccgtagaattattga

SEQ ID NO: 193304 - DNA, 38 bp, Artificial Sequence
  Synthetic oligonucleotide
gcgccgtcggtatgagcgccccccgcccgtttccttga

SEQ ID NO: 193305 - DNA, 37 bp, Artificial Sequence
  Synthetic oligonucleotide
atgtgcggccccctgctaccgtatcctttcatgttga

SEQ ID NO: 193306 - DNA, 38 bp, Artificial Sequence
  Synthetic oligonucleotide
tccccgcatccgccttacttactcacgccagactttga

SEQ ID NO: 193307 - DNA, 38 bp, Artificial Sequence
  Synthetic oligonucleotide
ggaccccgcacttgtggtgttaccgcccacacctttga

SEQ ID NO: 193308 - DNA, 37 bp, Artificial Sequence
  Synthetic oligonucleotide
accccgagcgccccatcgtcttgcccagctcctttga

SEQ ID NO: 193309 - DNA, 35 bp, Artificial Sequence
  Synthetic oligonucleotide
gagggagggtccgcagatgaacggttgggggaata

SEQ ID NO: 193310 - DNA, 36 bp, Artificial Sequence
  Synthetic oligonucleotide
tgctcagcccagcccccgctccgctttccaggacta

SEQ ID NO: 193311 - DNA, 36 bp, Artificial Sequence
  Synthetic oligonucleotide
gatgtgtccttgtgccttacacagccccctcaccta

SEQ ID NO: 193312 - DNA, 36 bp, Artificial Sequence
  Synthetic oligonucleotide
gtccaacgcccactatctgtttcagccaccccccta

SEQ ID NO: 193313 - DNA, 35 bp, Artificial Sequence
  Synthetic oligonucleotide
gacacccgtcacactgacttcaattatgcccgcta

SEQ ID NO: 193314 - DNA, 36 bp, Artificial Sequence
  Synthetic oligonucleotide
gacgaactacagagtctcttggtccatcctccgcta

SEQ ID NO: 193315 - DNA, 35 bp, Artificial Sequence
  Synthetic oligonucleotide
tacccgccacctcaccgctttatccatagaccgta

SEQ ID NO: 193316 - DNA, 36 bp, Artificial Sequence
  Synthetic oligonucleotide
aaatgcggggacggagaaatgaaatggatgggggta

SEQ ID NO: 193317 - DNA, 36 bp, Artificial Sequence
  Synthetic oligonucleotide
gttgggtcgaccctgccgatcctgttccctccgtta

SEQ ID NO: 193318 - DNA, 36 bp, Artificial Sequence
  Synthetic oligonucleotide
accgacgccttccgaccattgtcttccgctacttta

SEQ ID NO: 193319 - DNA, 36 bp, Artificial Sequence
  Synthetic oligonucleotide
tccgacccggtccgatccatgtgccctatcctttta

SEQ ID NO: 193320 - DNA, 34 bp, Artificial Sequence
  Synthetic oligonucleotide
ttgtcccgccaactactcgtaccaccccgcaaac

SEQ ID NO: 193321 - DNA, 35 bp, Artificial Sequence
  Synthetic oligonucleotide
acgggagggtggtgtgggggcctatttcaatcaac

SEQ ID NO: 193322 - DNA, 35 bp, Artificial Sequence
  Synthetic oligonucleotide
tgcatccccctctctctattagcctcctgtttaac

SEQ ID NO: 193323 - DNA, 35 bp, Artificial Sequence
  Synthetic oligonucleotide
tcgccggaccatcacttatcgccgaccggatacac

SEQ ID NO: 193324 - DNA, 35 bp, Artificial Sequence
  Synthetic oligonucleotide
gatttatcacgccgccatctcttggaaacacccac

SEQ ID NO: 193325 - DNA, 35 bp, Artificial Sequence
  Synthetic oligonucleotide
ttgctatgcataccgctcccgttctcgacacagac

SEQ ID NO: 193326 - DNA, 30 bp, Artificial Sequence
  Synthetic oligonucleotide
tagaccacacgttactaagccacttgaacc

SEQ ID NO: 193327 - DNA, 35 bp, Artificial Sequence
  Synthetic oligonucleotide
tgacgcgctacttcgaccttccgcacaggctaccc

SEQ ID NO: 193328 - DNA, 35 bp, Artificial Sequence
  Synthetic oligonucleotide
ggattcccccgctgtttcgctcgttacctgacccc

SEQ ID NO: 193329 - DNA, 34 bp, Artificial Sequence
  Synthetic oligonucleotide
acactgccacaattaagccagcggttaccccccc

SEQ ID NO: 193330 - DNA, 34 bp, Artificial Sequence
  Synthetic oligonucleotide
gttgcactcagcgattaatcatacctcccccccc

SEQ ID NO: 193331 - DNA, 35 bp, Artificial Sequence
  Synthetic oligonucleotide
attgccctcggcctagtgcgcctcacacgaatccc

SEQ ID NO: 193332 - DNA, 35 bp, Artificial Sequence
  Synthetic oligonucleotide
aatgcccgcctgtcctacccttattcatggatccc

SEQ ID NO: 193333 - DNA, 35 bp, Artificial Sequence
  Synthetic oligonucleotide
gtcgactcagagtgtcttactccaattccgttccc

SEQ ID NO: 193334 - DNA, 35 bp, Artificial Sequence
  Synthetic oligonucleotide
gccccaacagtagtcctgcacgaactatccatgcc

SEQ ID NO: 193335 - DNA, 34 bp, Artificial Sequence
  Synthetic oligonucleotide
atagcacctcccgttcccagtcgactggccctcc

SEQ ID NO: 193336 - DNA, 35 bp, Artificial Sequence
  Synthetic oligonucleotide
gcccccccgttcaccttcgtaacgtactcggctcc

SEQ ID NO: 193337 - DNA, 35 bp, Artificial Sequence
  Synthetic oligonucleotide
gctcccgcgtaactgcccgatactcgtcactctcc

SEQ ID NO: 193338 - DNA, 35 bp, Artificial Sequence
  Synthetic oligonucleotide
tagacggatgtgcgttcgtctcacctgtgctctcc

SEQ ID NO: 193339 - DNA, 35 bp, Artificial Sequence
  Synthetic oligonucleotide
acgatgcactctcctatcggttctggtgcccttcc

SEQ ID NO: 193340 - DNA, 35 bp, Artificial Sequence
  Synthetic oligonucleotide
tgcctcaccacggcattcagtcgacctcccgttcc

SEQ ID NO: 193341 - DNA, 35 bp, Artificial Sequence
  Synthetic oligonucleotide
gatcgcaggtatgcctgtcatttgcttccttttcc

SEQ ID NO: 193342 - DNA, 35 bp, Artificial Sequence
  Synthetic oligonucleotide
tgttccggccatctttttatctgctgtcgttttcc

SEQ ID NO: 193343 - DNA, 35 bp, Artificial Sequence
  Synthetic oligonucleotide
tccacccccgccactccacgcgcacaaccaagagc

SEQ ID NO: 193344 - DNA, 35 bp, Artificial Sequence
  Synthetic oligonucleotide
gttgaccattccccttttcgtttgtgacactccgc

SEQ ID NO: 193345 - DNA, 35 bp, Artificial Sequence
  Synthetic oligonucleotide
gcatgcctctaacatctcgcttattctgaccgcgc

SEQ ID NO: 193346 - DNA, 35 bp, Artificial Sequence
  Synthetic oligonucleotide
gatcgcaccacccgccgtaggccggcttacctcgc

SEQ ID NO: 193347 - DNA, 35 bp, Artificial Sequence
  Synthetic oligonucleotide
aaccgcacgctccaaactttgacactttgtccggc

SEQ ID NO: 193348 - DNA, 35 bp, Artificial Sequence
  Synthetic oligonucleotide
tgacgcctccttcgccgcctcttctcctgccttgc

SEQ ID NO: 193349 - DNA, 35 bp, Artificial Sequence
  Synthetic oligonucleotide
agtcacatcgacttttctacccctagctgctttgc

SEQ ID NO: 193350 - DNA, 35 bp, Artificial Sequence
  Synthetic oligonucleotide
aacggtcatccccccatagttgctggcctacaatc

SEQ ID NO: 193351 - DNA, 35 bp, Artificial Sequence
  Synthetic oligonucleotide
tgtgacccataagcatcgcgtaattgattaccctc

SEQ ID NO: 193352 - DNA, 35 bp, Artificial Sequence
  Synthetic oligonucleotide
tgaacgcggtcccggagcatcacttctcgtccctc

SEQ ID NO: 193353 - DNA, 35 bp, Artificial Sequence
  Synthetic oligonucleotide
tacccgatgcgtgccagcatttacctgatcgcctc

SEQ ID NO: 193354 - DNA, 35 bp, Artificial Sequence
  Synthetic oligonucleotide
gcatgtcaaccctggcattaattggtctatcgctc

SEQ ID NO: 193355 - DNA, 35 bp, Artificial Sequence
  Synthetic oligonucleotide
tgtgggaggggatggagatggtggcgggtgtgctc

SEQ ID NO: 193356 - DNA, 35 bp, Artificial Sequence
  Synthetic oligonucleotide
gcgacggggcctcagttacttaccacatgtctctc

SEQ ID NO: 193357 - DNA, 35 bp, Artificial Sequence
  Synthetic oligonucleotide
tctgttgccccttccagctttctttcgcccgtctc

SEQ ID NO: 193358 - DNA, 35 bp, Artificial Sequence
  Synthetic oligonucleotide
actgagccagtgttccccggtcgtgctttccagtc

SEQ ID NO: 193359 - DNA, 35 bp, Artificial Sequence
  Synthetic oligonucleotide
tatgggtacgcatcaccccttagattctgccattc

SEQ ID NO: 193360 - DNA, 35 bp, Artificial Sequence
  Synthetic oligonucleotide
tcgcaataccatccgtgctttcctgtctattcaag

SEQ ID NO: 193361 - DNA, 35 bp, Artificial Sequence
  Synthetic oligonucleotide
gatgggatggagggggttagcgtgaaggtgggaag

SEQ ID NO: 193362 - DNA, 35 bp, Artificial Sequence
  Synthetic oligonucleotide
gattggggatgcaggagaagagggaacgtagagag

SEQ ID NO: 193363 - DNA, 35 bp, Artificial Sequence
  Synthetic oligonucleotide
tcacccccctatgctggtcccgccttctctaaacg

SEQ ID NO: 193364 - DNA, 35 bp, Artificial Sequence
  Synthetic oligonucleotide
ggtgccgtcctctccgtacccctgccgtgatcccg

SEQ ID NO: 193365 - DNA, 35 bp, Artificial Sequence
  Synthetic oligonucleotide
gcgaacgccactaatctgttgtatcctccatctcg

SEQ ID NO: 193366 - DNA, 35 bp, Artificial Sequence
  Synthetic oligonucleotide
ttcccgcccacatgtcctgtacccggccttggtcg

SEQ ID NO: 193367 - DNA, 35 bp, Artificial Sequence
  Synthetic oligonucleotide
tagactacacagatcactttcttcaccatcattcg

SEQ ID NO: 193368 - DNA, 35 bp, Artificial Sequence
  Synthetic oligonucleotide
ttcgtaccatcgctgcatctccgtaaatcctaagg

SEQ ID NO: 193369 - DNA, 35 bp, Artificial Sequence
  Synthetic oligonucleotide
gccgcccccccttagtttaaagtaaccatgtaagg

SEQ ID NO: 193370 - DNA, 35 bp, Artificial Sequence
  Synthetic oligonucleotide
gtagaggaggggattgatagggggactgaacatgg

SEQ ID NO: 193371 - DNA, 35 bp, Artificial Sequence
  Synthetic oligonucleotide
gactgcactggtatcctccctttctccggttaatg

SEQ ID NO: 193372 - DNA, 35 bp, Artificial Sequence
  Synthetic oligonucleotide
agtcgagggaggggaggggttaatgcaagtgcatg

SEQ ID NO: 193373 - DNA, 35 bp, Artificial Sequence
  Synthetic oligonucleotide
tgagcgacatgtgtggactttccctccctctactg

SEQ ID NO: 193374 - DNA, 35 bp, Artificial Sequence
  Synthetic oligonucleotide
tccacctcaagtgtgctgtcctttttcattacgtg

SEQ ID NO: 193375 - DNA, 35 bp, Artificial Sequence
  Synthetic oligonucleotide
tgactacccggattgcttcgcccactgtaaccttg

SEQ ID NO: 193376 - DNA, 35 bp, Artificial Sequence
  Synthetic oligonucleotide
gcccgtctgggtaccaaatgctctgcccctccttg

SEQ ID NO: 193377 - DNA, 35 bp, Artificial Sequence
  Synthetic oligonucleotide
tgccttgtccagcctctggtttttgttacctcttg

SEQ ID NO: 193378 - DNA, 35 bp, Artificial Sequence
  Synthetic oligonucleotide
acacaccacctaacacgttcgccgttccgctcttg

SEQ ID NO: 193379 - DNA, 35 bp, Artificial Sequence
  Synthetic oligonucleotide
actgactgcctcccgacgctcccccttttttcttg

SEQ ID NO: 193380 - DNA, 35 bp, Artificial Sequence
  Synthetic oligonucleotide
tcccgaacgtcatccctgtgccgtctatcccatat

SEQ ID NO: 193381 - DNA, 35 bp, Artificial Sequence
  Synthetic oligonucleotide
tacccccgttccgacctgctcactgtttttttact

SEQ ID NO: 193382 - DNA, 35 bp, Artificial Sequence
  Synthetic oligonucleotide
tgtcacgattacttggtccgcgctgaactccacct

SEQ ID NO: 193383 - DNA, 35 bp, Artificial Sequence
  Synthetic oligonucleotide
gcatacactcagggctagttcgaccaccgcatcct

SEQ ID NO: 193384 - DNA, 35 bp, Artificial Sequence
  Synthetic oligonucleotide
actcaccgacctggcccttttagcattgcctcgct

SEQ ID NO: 193385 - DNA, 35 bp, Artificial Sequence
  Synthetic oligonucleotide
aagggccacccgttgcgctactttcacacgactct

SEQ ID NO: 193386 - DNA, 35 bp, Artificial Sequence
  Synthetic oligonucleotide
acccgcacgtagggcgtccaccattccgtcgctct

SEQ ID NO: 193387 - DNA, 35 bp, Artificial Sequence
  Synthetic oligonucleotide
tctgtccatccacatccctatcatgatgtgtctct

SEQ ID NO: 193388 - DNA, 35 bp, Artificial Sequence
  Synthetic oligonucleotide
tccgtgtagggcgggggggttacttcgggacacgt

SEQ ID NO: 193389 - DNA, 35 bp, Artificial Sequence
  Synthetic oligonucleotide
gacgcacatgcctcccatctgttgaaatcctctgt

SEQ ID NO: 193390 - DNA, 35 bp, Artificial Sequence
  Synthetic oligonucleotide
acactgcccccgatgctttacctaacccagagtgt

SEQ ID NO: 193391 - DNA, 35 bp, Artificial Sequence
  Synthetic oligonucleotide
ggagccctcatcgcctcttgtcaacccggtcttgt

SEQ ID NO: 193392 - DNA, 35 bp, Artificial Sequence
  Synthetic oligonucleotide
gccgctccaccctccttcctagcgtcttgttgatt

SEQ ID NO: 193393 - DNA, 35 bp, Artificial Sequence
  Synthetic oligonucleotide
taacgcattcacttgcgtttattggtattcccctt

SEQ ID NO: 193394 - DNA, 35 bp, Artificial Sequence
  Synthetic oligonucleotide
atatgcacccgagctttcgttctccttcattcctt

SEQ ID NO: 193395 - DNA, 35 bp, Artificial Sequence
  Synthetic oligonucleotide
aacgtgctggtcccggttgccagctgcccttcctt

SEQ ID NO: 193396 - DNA, 35 bp, Artificial Sequence
  Synthetic oligonucleotide
gtcgattagccgcccgacgtcctactcagtcgctt

SEQ ID NO: 193397 - DNA, 35 bp, Artificial Sequence
  Synthetic oligonucleotide
tgtgcaccgccccttctcccacggactccctgctt

SEQ ID NO: 193398 - DNA, 35 bp, Artificial Sequence
  Synthetic oligonucleotide
tttcacccggccactctttcggacccactaacgtt

SEQ ID NO: 193399 - DNA, 35 bp, Artificial Sequence
  Synthetic oligonucleotide
tctgccaccaaccggatgtgttcttcgccttcgtt

SEQ ID NO: 193400 - DNA, 35 bp, Artificial Sequence
  Synthetic oligonucleotide
tccaccctccccgcctgagtgactttcaactggtt

SEQ ID NO: 193401 - DNA, 35 bp, Artificial Sequence
  Synthetic oligonucleotide
acaccaccagttctaaggctgccgattacgccttt

SEQ ID NO: 193402 - DNA, 35 bp, Artificial Sequence
  Synthetic oligonucleotide
gtagcgcgccgtccacgcatccagcctattctttt

SEQ ID NO: 193403 - DNA, 35 bp, Artificial Sequence
  Synthetic oligonucleotide
aaccgtcgccgcccatgactctccggactacgaaa

SEQ ID NO: 193404 - DNA, 36 bp, Artificial Sequence
  Synthetic oligonucleotide
ggatgctccctggcgtcatcagaaaccaccctccaa

SEQ ID NO: 193405 - DNA, 36 bp, Artificial Sequence
  Synthetic oligonucleotide
gcaagagaataggggtagaaaaggtgaaggtcgcaa

SEQ ID NO: 193406 - DNA, 36 bp, Artificial Sequence
  Synthetic oligonucleotide
aaccaccccaccttaggatagctccagtgctacgaa

SEQ ID NO: 193407 - DNA, 35 bp, Artificial Sequence
  Synthetic oligonucleotide
tgtccaagcgtccccctgcccgatgccgccatgaa

SEQ ID NO: 193408 - DNA, 36 bp, Artificial Sequence
  Synthetic oligonucleotide
atttgccctccagactactctcgttcgcccaggtaa

SEQ ID NO: 193409 - DNA, 35 bp, Artificial Sequence
  Synthetic oligonucleotide
ggactcgggggggggcggagtggacggttggaaca

SEQ ID NO: 193410 - DNA, 36 bp, Artificial Sequence
  Synthetic oligonucleotide
aaacggaagggggacacgaagagcaagagggtaaca

SEQ ID NO: 193411 - DNA, 35 bp, Artificial Sequence
  Synthetic oligonucleotide
agcccacgcacctgttaggattctcgctactcaca

SEQ ID NO: 193412 - DNA, 36 bp, Artificial Sequence
  Synthetic oligonucleotide
gccgaccgatcgctacgtttatcccctcctctcaca

SEQ ID NO: 193413 - DNA, 36 bp, Artificial Sequence
  Synthetic oligonucleotide
gatgcccatcagtcggagctattttacgtcttacca

SEQ ID NO: 193414 - DNA, 36 bp, Artificial Sequence
  Synthetic oligonucleotide
atgccatccttcccggagtggctttatctataccca

SEQ ID NO: 193415 - DNA, 36 bp, Artificial Sequence
  Synthetic oligonucleotide
tgctcaacgccccatctgttcctagtgttggcccca

SEQ ID NO: 193416 - DNA, 36 bp, Artificial Sequence
  Synthetic oligonucleotide
acatccgcttgccctagctggaagccccttgtccca

SEQ ID NO: 193417 - DNA, 36 bp, Artificial Sequence
  Synthetic oligonucleotide
gtgaagaacagtgcgggggggagaaagctgttgcca

SEQ ID NO: 193418 - DNA, 36 bp, Artificial Sequence
  Synthetic oligonucleotide
atcccacccgcgaaagtatactatttccgtcctcca

SEQ ID NO: 193419 - DNA, 36 bp, Artificial Sequence
  Synthetic oligonucleotide
acccagcaactcgttcatcgtttttcgttccttcca

SEQ ID NO: 193420 - DNA, 36 bp, Artificial Sequence
  Synthetic oligonucleotide
tatcacctttcctgcctctacgccctgtttgacgca

SEQ ID NO: 193421 - DNA, 36 bp, Artificial Sequence
  Synthetic oligonucleotide
acaccgcaggggatgggggggggtgttaatggggca

SEQ ID NO: 193422 - DNA, 36 bp, Artificial Sequence
  Synthetic oligonucleotide
agctccacccgccctggtcctcattacctgcctgca

SEQ ID NO: 193423 - DNA, 36 bp, Artificial Sequence
  Synthetic oligonucleotide
atgcaccagcccctccgcagcgattgacccctatca

SEQ ID NO: 193424 - DNA, 35 bp, Artificial Sequence
  Synthetic oligonucleotide
gactccgtcacccagcagaaccgcgccttgtctca

SEQ ID NO: 193425 - DNA, 36 bp, Artificial Sequence
  Synthetic oligonucleotide
taccccgctatcagatcatgaagccccaccccgtca

SEQ ID NO: 193426 - DNA, 37 bp, Artificial Sequence
  Synthetic oligonucleotide
tggggacacaagaggggtggcggtacgggcagtaaga

SEQ ID NO: 193427 - DNA, 37 bp, Artificial Sequence
  Synthetic oligonucleotide
gtgaggaggaggggggaggaggagaactggatacaga

SEQ ID NO: 193428 - DNA, 37 bp, Artificial Sequence
  Synthetic oligonucleotide
gagcctgcacgggaggaggggggggacgcgacccaga

SEQ ID NO: 193429 - DNA, 37 bp, Artificial Sequence
  Synthetic oligonucleotide
actccctccaccgtttaggcacctccccacggggaga

SEQ ID NO: 193430 - DNA, 36 bp, Artificial Sequence
  Synthetic oligonucleotide
aacgacggggggggcaaaggcggtgagaggagtaga

SEQ ID NO: 193431 - DNA, 37 bp, Artificial Sequence
  Synthetic oligonucleotide
gatgaggggaatgggcatgggctgaagacgggggcga

SEQ ID NO: 193432 - DNA, 37 bp, Artificial Sequence
  Synthetic oligonucleotide
gccaaccgcagttggactcctcaccgcctttactcga

SEQ ID NO: 193433 - DNA, 37 bp, Artificial Sequence
  Synthetic oligonucleotide
gtgagcccctcagttcttccgcgccatacaacctcga

SEQ ID NO: 193434 - DNA, 37 bp, Artificial Sequence
  Synthetic oligonucleotide
aacgccccatatcgtaactcgtcatccctcccctcga

SEQ ID NO: 193435 - DNA, 37 bp, Artificial Sequence
  Synthetic oligonucleotide
gcacgtgagtgcgaagttcctttttacctcctctcga

SEQ ID NO: 193436 - DNA, 37 bp, Artificial Sequence
  Synthetic oligonucleotide
gtcctgcgtaacactctcgccatcgcccgtttttcga

SEQ ID NO: 193437 - DNA, 37 bp, Artificial Sequence
  Synthetic oligonucleotide
tagccttcctcatcacgcatacgtttcgccccccgga

SEQ ID NO: 193438 - DNA, 35 bp, Artificial Sequence
  Synthetic oligonucleotide
gtgtacgggcggggctgaaatggtcgggagtggga

SEQ ID NO: 193439 - DNA, 36 bp, Artificial Sequence
  Synthetic oligonucleotide
ggatcatgtcatcgcctatcaaccacaccctctgga

SEQ ID NO: 193440 - DNA, 37 bp, Artificial Sequence
  Synthetic oligonucleotide
tcaagcacatccccgttcgttcttcccgtcacttgga

SEQ ID NO: 193441 - DNA, 34 bp, Artificial Sequence
  Synthetic oligonucleotide
gcggacccatcttgcgccgccaccttaatttgga

SEQ ID NO: 193442 - DNA, 37 bp, Artificial Sequence
  Synthetic oligonucleotide
gtccctgcccggtttatccatcatccatactacatga

SEQ ID NO: 193443 - DNA, 38 bp, Artificial Sequence
  Synthetic oligonucleotide
taccatccctgtcgtgcttactcattacgtctaactga

SEQ ID NO: 193444 - DNA, 38 bp, Artificial Sequence
  Synthetic oligonucleotide
tgatcgacagtcatcacttctggtgtcgcccaccctga

SEQ ID NO: 193445 - DNA, 38 bp, Artificial Sequence
  Synthetic oligonucleotide
gtactatacccgcccatcttcgtctttacgaggcctga

SEQ ID NO: 193446 - DNA, 38 bp, Artificial Sequence
  Synthetic oligonucleotide
tacactggcagtgctgttttctgccattttcatcctga

SEQ ID NO: 193447 - DNA, 38 bp, Artificial Sequence
  Synthetic oligonucleotide
tacgatgcggggggagcaagagggcggggcggtcctga

SEQ ID NO: 193448 - DNA, 37 bp, Artificial Sequence
  Synthetic oligonucleotide
ttagactcccgtggtgttgtgccctttatcccgctga

SEQ ID NO: 193449 - DNA, 37 bp, Artificial Sequence
  Synthetic oligonucleotide
tacgggcgtagggcgggtagggagctaccgtcgctga

SEQ ID NO: 193450 - DNA, 38 bp, Artificial Sequence
  Synthetic oligonucleotide
taacaccgtatcgggtgggagaggtggggtaaatctga

SEQ ID NO: 193451 - DNA, 38 bp, Artificial Sequence
  Synthetic oligonucleotide
actagcgttagccgctccccgggaacctaccgctctga

SEQ ID NO: 193452 - DNA, 38 bp, Artificial Sequence
  Synthetic oligonucleotide
acgcaacgctggagaggcaaggggggaaaggaaagtga

SEQ ID NO: 193453 - DNA, 37 bp, Artificial Sequence
  Synthetic oligonucleotide
tgtgtcgtaacgggctgggatggggcgggatcagtga

SEQ ID NO: 193454 - DNA, 37 bp, Artificial Sequence
  Synthetic oligonucleotide
gagcaagggagagcgaaatgcaatgggaagggcgtga

SEQ ID NO: 193455 - DNA, 38 bp, Artificial Sequence
  Synthetic oligonucleotide
gatccaccccgtccgcgtaacttcaactgcaatcgtga

SEQ ID NO: 193456 - DNA, 37 bp, Artificial Sequence
  Synthetic oligonucleotide
gaggtagactggtggagggtagggggctgaggggtga

SEQ ID NO: 193457 - DNA, 38 bp, Artificial Sequence
  Synthetic oligonucleotide
tgatgggcgagggaactgtaggggggaggtggaattga

SEQ ID NO: 193458 - DNA, 38 bp, Artificial Sequence
  Synthetic oligonucleotide
gccactgcagggtaagtatttgctccccgcctacttga

SEQ ID NO: 193459 - DNA, 38 bp, Artificial Sequence
  Synthetic oligonucleotide
tgcacaccatctgccctccacagcttcgtttgccttga

SEQ ID NO: 193460 - DNA, 36 bp, Artificial Sequence
  Synthetic oligonucleotide
ttaggccggacgtcagagttcccgccgcttccttga

SEQ ID NO: 193461 - DNA, 36 bp, Artificial Sequence
  Synthetic oligonucleotide
gaggatggggcaaagttagggggaaggacctgttga

SEQ ID NO: 193462 - DNA, 37 bp, Artificial Sequence
  Synthetic oligonucleotide
tcagccgccagcctgcccttctgcgctcactctttga

SEQ ID NO: 193463 - DNA, 35 bp, Artificial Sequence
  Synthetic oligonucleotide
tgcaacgcaagcgacacctgcatacaccacgccta

SEQ ID NO: 193464 - DNA, 36 bp, Artificial Sequence
  Synthetic oligonucleotide
aatgtatgcaacgccgttcccgttatctgcttccta

SEQ ID NO: 193465 - DNA, 36 bp, Artificial Sequence
  Synthetic oligonucleotide
gatgggggcacagtagagaggagggatcgtaggcta

SEQ ID NO: 193466 - DNA, 36 bp, Artificial Sequence
  Synthetic oligonucleotide
tcatggcaaggggcggttggttaggaaggcggagta

SEQ ID NO: 193467 - DNA, 36 bp, Artificial Sequence
  Synthetic oligonucleotide
ggacacgattagcagcatgaaaggggggtgggagta

SEQ ID NO: 193468 - DNA, 35 bp, Artificial Sequence
  Synthetic oligonucleotide
atggtgagcgcgccgttcgaccatctgaccttaac

SEQ ID NO: 193469 - DNA, 36 bp, Artificial Sequence
  Synthetic oligonucleotide
agactggtacagtaggtacactctccgttcaaccac

SEQ ID NO: 193470 - DNA, 35 bp, Artificial Sequence
  Synthetic oligonucleotide
accctgcccgccccaggccacaccggtttgcctac

SEQ ID NO: 193471 - DNA, 35 bp, Artificial Sequence
  Synthetic oligonucleotide
gtacccgccgggctattactgacccattttcctac

SEQ ID NO: 193472 - DNA, 35 bp, Artificial Sequence
  Synthetic oligonucleotide
gcatctacatctcgtttcacaaccagctctcgtac

SEQ ID NO: 193473 - DNA, 35 bp, Artificial Sequence
  Synthetic oligonucleotide
gccgatcgccgcccataccacgcaacatggtttac

SEQ ID NO: 193474 - DNA, 35 bp, Artificial Sequence
  Synthetic oligonucleotide
gctcacccatcagccacgtaaaccattcactcacc

SEQ ID NO: 193475 - DNA, 35 bp, Artificial Sequence
  Synthetic oligonucleotide
agacccatccggccggcgttatttactggcatacc

SEQ ID NO: 193476 - DNA, 35 bp, Artificial Sequence
  Synthetic oligonucleotide
gttcagtgtagacgtcttgtccataccatcttacc

SEQ ID NO: 193477 - DNA, 35 bp, Artificial Sequence
  Synthetic oligonucleotide
gtgttcgccttccatgcacgtatttccatcttacc

SEQ ID NO: 193478 - DNA, 35 bp, Artificial Sequence
  Synthetic oligonucleotide
gactacgccctaccactagtgacacgcatccaccc

SEQ ID NO: 193479 - DNA, 35 bp, Artificial Sequence
  Synthetic oligonucleotide
tcaacaccaccatcttgcccacgaggtctgtaccc

SEQ ID NO: 193480 - DNA, 35 bp, Artificial Sequence
  Synthetic oligonucleotide
tacatcgctaaccttctattggaccggccgacccc

SEQ ID NO: 193481 - DNA, 35 bp, Artificial Sequence
  Synthetic oligonucleotide
gaatgtgcgcacacggtttctagttgtcctgtccc

SEQ ID NO: 193482 - DNA, 35 bp, Artificial Sequence
  Synthetic oligonucleotide
accgtccccgctcaattatgcccaggagtaccgcc

SEQ ID NO: 193483 - DNA, 35 bp, Artificial Sequence
  Synthetic oligonucleotide
ttcgcttcctcctgttaaccagatctatcgctgcc

SEQ ID NO: 193484 - DNA, 35 bp, Artificial Sequence
  Synthetic oligonucleotide
tggatcgccactaagttgcctgcttttccgactcc

SEQ ID NO: 193485 - DNA, 35 bp, Artificial Sequence
  Synthetic oligonucleotide
gatccccatatggcactacgaacgggcctgtttcc

SEQ ID NO: 193486 - DNA, 35 bp, Artificial Sequence
  Synthetic oligonucleotide
tacgccgccgcccctggaacgctctcacatttcgc

SEQ ID NO: 193487 - DNA, 35 bp, Artificial Sequence
  Synthetic oligonucleotide
gctcaactcatgccgtcccccgtccgagctactgc

SEQ ID NO: 193488 - DNA, 35 bp, Artificial Sequence
  Synthetic oligonucleotide
atcgcccgacttgcttatcgcctatacctgcctgc

SEQ ID NO: 193489 - DNA, 35 bp, Artificial Sequence
  Synthetic oligonucleotide
gatcggcgccacacgtaccaactgtcgtctcctgc

SEQ ID NO: 193490 - DNA, 35 bp, Artificial Sequence
  Synthetic oligonucleotide
tagtgctgggggggacgggcttgctagggtggtgc

SEQ ID NO: 193491 - DNA, 35 bp, Artificial Sequence
  Synthetic oligonucleotide
gacccatagatcggatatctcgtccctttccttgc

SEQ ID NO: 193492 - DNA, 35 bp, Artificial Sequence
  Synthetic oligonucleotide
tgctaagaccaacgggtctatcaaatctatcaatc

SEQ ID NO: 193493 - DNA, 35 bp, Artificial Sequence
  Synthetic oligonucleotide
tgtcccataccgtcgaacggtcaatcttcttcatc

SEQ ID NO: 193494 - DNA, 35 bp, Artificial Sequence
  Synthetic oligonucleotide
taagccgcacgtagacttcgttcgctccaactatc

SEQ ID NO: 193495 - DNA, 35 bp, Artificial Sequence
  Synthetic oligonucleotide
gtccccgccccgatcggtcgtaccccaggtccctc

SEQ ID NO: 193496 - DNA, 35 bp, Artificial Sequence
  Synthetic oligonucleotide
tgcccactaccatggcttaaattgtacctggcctc

SEQ ID NO: 193497 - DNA, 35 bp, Artificial Sequence
  Synthetic oligonucleotide
ggtgactgcgctcccagtactgtcttaatctcctc

SEQ ID NO: 193498 - DNA, 35 bp, Artificial Sequence
  Synthetic oligonucleotide
gtgcactccatatatcctatttggccgcatctctc

SEQ ID NO: 193499 - DNA, 35 bp, Artificial Sequence
  Synthetic oligonucleotide
accgaaagcgctgatgcactctgctattacttctc

SEQ ID NO: 193500 - DNA, 35 bp, Artificial Sequence
  Synthetic oligonucleotide
attccggctcggagtctatttcctaattccccgtc

SEQ ID NO: 193501 - DNA, 35 bp, Artificial Sequence
  Synthetic oligonucleotide
tactccacgcagctgtatcttcctgaacctttgtc

SEQ ID NO: 193502 - DNA, 35 bp, Artificial Sequence
  Synthetic oligonucleotide
gcatgccacacatccttcgtcactgcagtcccttc

SEQ ID NO: 193503 - DNA, 35 bp, Artificial Sequence
  Synthetic oligonucleotide
gcccacccgtcagctaccggcctataggttccttc

SEQ ID NO: 193504 - DNA, 35 bp, Artificial Sequence
  Synthetic oligonucleotide
agcgccgcccccactgacatttcgatagtttcttc

SEQ ID NO: 193505 - DNA, 35 bp, Artificial Sequence
  Synthetic oligonucleotide
gcatcctgactgtttccccgcaattgctctcgttc

SEQ ID NO: 193506 - DNA, 35 bp, Artificial Sequence
  Synthetic oligonucleotide
gatactgcctctacacccacgcccggctatggttc

SEQ ID NO: 193507 - DNA, 35 bp, Artificial Sequence
  Synthetic oligonucleotide
tctggatcgtagcttgccacctcgggccctgtttc

SEQ ID NO: 193508 - DNA, 35 bp, Artificial Sequence
  Synthetic oligonucleotide
atccgaatgaacaggaggggcgaaagtcggaaaag

SEQ ID NO: 193509 - DNA, 35 bp, Artificial Sequence
  Synthetic oligonucleotide
gcatacgaagggggagggctgggacgaaaaagcag

SEQ ID NO: 193510 - DNA, 35 bp, Artificial Sequence
  Synthetic oligonucleotide
gtggagagttaggaggggatgataaataagggcag

SEQ ID NO: 193511 - DNA, 35 bp, Artificial Sequence
  Synthetic oligonucleotide
atccctacgcgactagcatactaccaacatccccg

SEQ ID NO: 193512 - DNA, 35 bp, Artificial Sequence
  Synthetic oligonucleotide
acgtacgccatcccctcatagcctaagttcctccg

SEQ ID NO: 193513 - DNA, 35 bp, Artificial Sequence
  Synthetic oligonucleotide
tgccccctgtacctcatttgtttctcgctccatcg

SEQ ID NO: 193514 - DNA, 36 bp, Artificial Sequence
  Synthetic oligonucleotide
gagggggtgggaggtgagcctaagggctatggacgg

SEQ ID NO: 193515 - DNA, 35 bp, Artificial Sequence
  Synthetic oligonucleotide
ggggggaggcaatcgtgggacgggaaatgtgaggg

SEQ ID NO: 193516 - DNA, 35 bp, Artificial Sequence
  Synthetic oligonucleotide
gcacgagtgggggagggaggggctcagacaggggg

SEQ ID NO: 193517 - DNA, 33 bp, Artificial Sequence
  Synthetic oligonucleotide
gatgcgggtcggaggagagcgggagagcggtgg

SEQ ID NO: 193518 - DNA, 35 bp, Artificial Sequence
  Synthetic oligonucleotide
tctggaaggggagaagagcgtagaagggggcggtg

SEQ ID NO: 193519 - DNA, 35 bp, Artificial Sequence
  Synthetic oligonucleotide
tgaaccgactcagtattattgtgtctccctcgaat

SEQ ID NO: 193520 - DNA, 35 bp, Artificial Sequence
  Synthetic oligonucleotide
tactctcgccccatgcgctttattaactccataat

SEQ ID NO: 193521 - DNA, 35 bp, Artificial Sequence
  Synthetic oligonucleotide
tgtcaacaggggggtaagggttgggagggtccgat

SEQ ID NO: 193522 - DNA, 35 bp, Artificial Sequence
  Synthetic oligonucleotide
tgcacatggaggtgtttgttcgcccacgctccact

SEQ ID NO: 193523 - DNA, 35 bp, Artificial Sequence
  Synthetic oligonucleotide
ggtgccccttctgcatctgtcttccgtcgttacct

SEQ ID NO: 193524 - DNA, 35 bp, Artificial Sequence
  Synthetic oligonucleotide
acgactcatctcgcacagacgcccgacccagccct

SEQ ID NO: 193525 - DNA, 35 bp, Artificial Sequence
  Synthetic oligonucleotide
tcagtgcaacgccctgttttaatcacgtgctccct

SEQ ID NO: 193526 - DNA, 34 bp, Artificial Sequence
  Synthetic oligonucleotide
tcgccatccatctgccagccttgtcctaccgcct

SEQ ID NO: 193527 - DNA, 35 bp, Artificial Sequence
  Synthetic oligonucleotide
gacgagaggggggcagaaggcatcggttatcggct

SEQ ID NO: 193528 - DNA, 35 bp, Artificial Sequence
  Synthetic oligonucleotide
gcaccgatcacacatctgttagttctcttcctgct

SEQ ID NO: 193529 - DNA, 35 bp, Artificial Sequence
  Synthetic oligonucleotide
tcagctccagcactccccgcgttcgaccgtaatct

SEQ ID NO: 193530 - DNA, 35 bp, Artificial Sequence
  Synthetic oligonucleotide
gcccttccacaggtttctgactcgacccttgatct

SEQ ID NO: 193531 - DNA, 35 bp, Artificial Sequence
  Synthetic oligonucleotide
attccgccgccatctgtcctgttcgttgacggagt

SEQ ID NO: 193532 - DNA, 35 bp, Artificial Sequence
  Synthetic oligonucleotide
gcaggagagaacaaggtggatcgggaacgggtcgt

SEQ ID NO: 193533 - DNA, 35 bp, Artificial Sequence
  Synthetic oligonucleotide
gctggtggccacggaactgttttactcctcttatt

SEQ ID NO: 193534 - DNA, 35 bp, Artificial Sequence
  Synthetic oligonucleotide
gccacagtgcctcagatccttaccggtccgccctt

SEQ ID NO: 193535 - DNA, 35 bp, Artificial Sequence
  Synthetic oligonucleotide
gtcacatctactgcacactccccggtcttactctt

SEQ ID NO: 193536 - DNA, 35 bp, Artificial Sequence
  Synthetic oligonucleotide
tacggtgacgcttctgtccgcttcccttcctcgtt

SEQ ID NO: 193537 - DNA, 35 bp, Artificial Sequence
  Synthetic oligonucleotide
attgggaggggcaagtggggcgatgtattggggtt

SEQ ID NO: 193538 - DNA, 35 bp, Artificial Sequence
  Synthetic oligonucleotide
tctctcgacgccgaccgtacactcgactccatgtt

SEQ ID NO: 193539 - DNA, 34 bp, Artificial Sequence
  Synthetic oligonucleotide
tcacgtcgccgtcctgtccacgctctttccgttt

SEQ ID NO: 193540 - DNA, 36 bp, Artificial Sequence
  Synthetic oligonucleotide
ggggcgggaagggggggtacacacggtacctggaaa

SEQ ID NO: 193541 - DNA, 36 bp, Artificial Sequence
  Synthetic oligonucleotide
gtcggggtcctcgcctgtcccatcgtcccagtacaa

SEQ ID NO: 193542 - DNA, 35 bp, Artificial Sequence
  Synthetic oligonucleotide
taccccacgatagtccgacgcgaccctcttttcaa

SEQ ID NO: 193543 - DNA, 36 bp, Artificial Sequence
  Synthetic oligonucleotide
gtgagaaacggtatgggtagacgggggggcactgaa

SEQ ID NO: 193544 - DNA, 36 bp, Artificial Sequence
  Synthetic oligonucleotide
ggaacgcctccacccctgtattgccctttgcctgaa

SEQ ID NO: 193545 - DNA, 35 bp, Artificial Sequence
  Synthetic oligonucleotide
atcacccgcccaagttgctactcaggagctgcaca

SEQ ID NO: 193546 - DNA, 35 bp, Artificial Sequence
  Synthetic oligonucleotide
gccaaaggccatgcgtgacgccgcctctcctgaca

SEQ ID NO: 193547 - DNA, 36 bp, Artificial Sequence
  Synthetic oligonucleotide
tccagctctagtaatccccgcatagtccagccccca

SEQ ID NO: 193548 - DNA, 36 bp, Artificial Sequence
  Synthetic oligonucleotide
acatgtcctatcccgtaagccacgctcccatagcca

SEQ ID NO: 193549 - DNA, 36 bp, Artificial Sequence
  Synthetic oligonucleotide
gtcccaatcaagacctttttgcagtgtcccccgcca

SEQ ID NO: 193550 - DNA, 35 bp, Artificial Sequence
  Synthetic oligonucleotide
tgtcctcccccgtttgtggttcctctcgctacgca

SEQ ID NO: 193551 - DNA, 36 bp, Artificial Sequence
  Synthetic oligonucleotide
gaatgttggaggtgttacagggggaggtaggaggca

SEQ ID NO: 193552 - DNA, 36 bp, Artificial Sequence
  Synthetic oligonucleotide
gaaaagggggaaaagtgatgggaagtgcgaagggca

SEQ ID NO: 193553 - DNA, 36 bp, Artificial Sequence
  Synthetic oligonucleotide
gtgtcaaacgcccgaactgttcacgtcccactctca

SEQ ID NO: 193554 - DNA, 36 bp, Artificial Sequence
  Synthetic oligonucleotide
tcttgctcccctcagacagtcctactaccgacgtca

SEQ ID NO: 193555 - DNA, 36 bp, Artificial Sequence
  Synthetic oligonucleotide
gggtgaagaggcgagagggtgatgaagctcgtcaga

SEQ ID NO: 193556 - DNA, 37 bp, Artificial Sequence
  Synthetic oligonucleotide
ttccacacccgtagtccccttgcacaggtctctgaga

SEQ ID NO: 193557 - DNA, 36 bp, Artificial Sequence
  Synthetic oligonucleotide
aacaagccgcattccctgtttctccagctactacga

SEQ ID NO: 193558 - DNA, 36 bp, Artificial Sequence
  Synthetic oligonucleotide
gtatggacgggaacttgggtgagaagggaggtacga

SEQ ID NO: 193559 - DNA, 37 bp, Artificial Sequence
  Synthetic oligonucleotide
tcacatcgcccggtttgcgtcattattgcatcaccga

SEQ ID NO: 193560 - DNA, 35 bp, Artificial Sequence
  Synthetic oligonucleotide
gagtccagtgcggaaaggaggggtagtgagagcga

SEQ ID NO: 193561 - DNA, 37 bp, Artificial Sequence
  Synthetic oligonucleotide
gccaccatcttctgcttcctgacagtagctctcgcga

SEQ ID NO: 193562 - DNA, 36 bp, Artificial Sequence
  Synthetic oligonucleotide
agttggggcgcgtactacgggcgagggggagggcga

SEQ ID NO: 193563 - DNA, 36 bp, Artificial Sequence
  Synthetic oligonucleotide
tacacacttcggccagatcaccgctgccattctcga

SEQ ID NO: 193564 - DNA, 37 bp, Artificial Sequence
  Synthetic oligonucleotide
gccacaccacctgcatccagcccagcggctctgtcga

SEQ ID NO: 193565 - DNA, 37 bp, Artificial Sequence
  Synthetic oligonucleotide
tctaccccgcctgtccatttaacctgatgtccttcga

SEQ ID NO: 193566 - DNA, 37 bp, Artificial Sequence
  Synthetic oligonucleotide
atcaactcccatcgcgatgacgatgcccctcctagga

SEQ ID NO: 193567 - DNA, 36 bp, Artificial Sequence
  Synthetic oligonucleotide
tgtcctcacacgtgcctcctgttccgaactgtcgga

SEQ ID NO: 193568 - DNA, 37 bp, Artificial Sequence
  Synthetic oligonucleotide
gtggatcagatgaagtgtggtgggtgtaagggaggga

SEQ ID NO: 193569 - DNA, 37 bp, Artificial Sequence
  Synthetic oligonucleotide
gacgtaaagcccacgacgggtagggtaaagggtggga

SEQ ID NO: 193570 - DNA, 37 bp, Artificial Sequence
  Synthetic oligonucleotide
acgtggccgtatggctatcaatctctcctccactgga

SEQ ID NO: 193571 - DNA, 32 bp, Artificial Sequence
  Synthetic oligonucleotide
atagccccacggatctcctcaccgcaattgga

SEQ ID NO: 193572 - DNA, 38 bp, Artificial Sequence
  Synthetic oligonucleotide
taccgtcgacggagggggagggactaagggctgaatga

SEQ ID NO: 193573 - DNA, 35 bp, Artificial Sequence
  Synthetic oligonucleotide
gcccctactccctctttgttcttaacaggccatga

SEQ ID NO: 193574 - DNA, 37 bp, Artificial Sequence
  Synthetic oligonucleotide
tcagctaccgccgcattcgaaccccttgccatcatga

SEQ ID NO: 193575 - DNA, 38 bp, Artificial Sequence
  Synthetic oligonucleotide
tccaaggcaactggtgtacttcctcccctctttcatga

SEQ ID NO: 193576 - DNA, 35 bp, Artificial Sequence
  Synthetic oligonucleotide
tagggaatgggggcggacaagtgggggcgtgatga

SEQ ID NO: 193577 - DNA, 38 bp, Artificial Sequence
  Synthetic oligonucleotide
gtgggagggactagggaggcaatacggggctgctatga

SEQ ID NO: 193578 - DNA, 37 bp, Artificial Sequence
  Synthetic oligonucleotide
gacgaaccggcccagcgacacgtcccatccatcctga

SEQ ID NO: 193579 - DNA, 38 bp, Artificial Sequence
  Synthetic oligonucleotide
acagccccacgcttactgtatttatggctccatcctga

SEQ ID NO: 193580 - DNA, 38 bp, Artificial Sequence
  Synthetic oligonucleotide
gagcctggtcaccacttgataatgcgcgcctctcctga

SEQ ID NO: 193581 - DNA, 38 bp, Artificial Sequence
  Synthetic oligonucleotide
agtggggcgggcgggtggtgacttaaggccaatgctga

SEQ ID NO: 193582 - DNA, 37 bp, Artificial Sequence
  Synthetic oligonucleotide
tgtcccgcccatcctgtactcgcgctctccactctga

SEQ ID NO: 193583 - DNA, 38 bp, Artificial Sequence
  Synthetic oligonucleotide
acactagcggacagctcttcacctccatctaccagtga

SEQ ID NO: 193584 - DNA, 36 bp, Artificial Sequence
  Synthetic oligonucleotide
gagacaaaattgtaggaggaacgggcgatggagtga

SEQ ID NO: 193585 - DNA, 38 bp, Artificial Sequence
  Synthetic oligonucleotide
gagggctagggcagggaagggaagcggagacgtggtga

SEQ ID NO: 193586 - DNA, 37 bp, Artificial Sequence
  Synthetic oligonucleotide
tttctgcccccgctctctatttcacctggtcttgtga

SEQ ID NO: 193587 - DNA, 37 bp, Artificial Sequence
  Synthetic oligonucleotide
atcgactccctctgctggcccacctaggggacattga

SEQ ID NO: 193588 - DNA, 35 bp, Artificial Sequence
  Synthetic oligonucleotide
tatcgcacctacatctttgttgcctctcctattga

SEQ ID NO: 193589 - DNA, 35 bp, Artificial Sequence
  Synthetic oligonucleotide
accctccaccctcctgatcgctatgatagccttga

SEQ ID NO: 193590 - DNA, 38 bp, Artificial Sequence
  Synthetic oligonucleotide
tctgagcggtccctcgatttcatagcctccatccttga

SEQ ID NO: 193591 - DNA, 37 bp, Artificial Sequence
  Synthetic oligonucleotide
gtcccactgctcgtaggttattcgttctcctcgttga

SEQ ID NO: 193592 - DNA, 38 bp, Artificial Sequence
  Synthetic oligonucleotide
atctcaccgccccaatcctgtttaccaccgcgtgttga

SEQ ID NO: 193593 - DNA, 37 bp, Artificial Sequence
  Synthetic oligonucleotide
tgcccgcacagccctcggtccgcatctctacctttga

SEQ ID NO: 193594 - DNA, 36 bp, Artificial Sequence
  Synthetic oligonucleotide
gggaggggtagccgggaggagttaaggggcgagata

SEQ ID NO: 193595 - DNA, 35 bp, Artificial Sequence
  Synthetic oligonucleotide
gtcccatcctgtgtgttgttccttgacccgcgata

SEQ ID NO: 193596 - DNA, 35 bp, Artificial Sequence
  Synthetic oligonucleotide
tataccccgctaatgcctcttatgtcttcgcccta

SEQ ID NO: 193597 - DNA, 35 bp, Artificial Sequence
  Synthetic oligonucleotide
ttgagggacgggcatatgggtggggaatacggcta

SEQ ID NO: 193598 - DNA, 36 bp, Artificial Sequence
  Synthetic oligonucleotide
taacagccccaaaccgcttctgtgtccgtgtctcta

SEQ ID NO: 193599 - DNA, 35 bp, Artificial Sequence
  Synthetic oligonucleotide
tgaacgccctcagatccgcccccgccaacgttcta

SEQ ID NO: 193600 - DNA, 35 bp, Artificial Sequence
  Synthetic oligonucleotide
tatgccgcctagccctccgcctacgtgaaatttta

SEQ ID NO: 193601 - DNA, 35 bp, Artificial Sequence
  Synthetic oligonucleotide
gagacaccgcaacgttgccgtgagggtcctcccac

SEQ ID NO: 193602 - DNA, 35 bp, Artificial Sequence
  Synthetic oligonucleotide
gagacctcagacaccttaagccatcattcctccac

SEQ ID NO: 193603 - DNA, 35 bp, Artificial Sequence
  Synthetic oligonucleotide
tctcccatggccagagtgctaccattttcttccac

SEQ ID NO: 193604 - DNA, 35 bp, Artificial Sequence
  Synthetic oligonucleotide
tgagcgcctgacgtcacgcacccactcgttatcac

SEQ ID NO: 193605 - DNA, 35 bp, Artificial Sequence
  Synthetic oligonucleotide
gcttccgtgcaattgttctatctatggccacctac

SEQ ID NO: 193606 - DNA, 35 bp, Artificial Sequence
  Synthetic oligonucleotide
tcatcacactgtggctgttactcatagatcccacc

SEQ ID NO: 193607 - DNA, 35 bp, Artificial Sequence
  Synthetic oligonucleotide
agcatccttgctcctgctttatggtccgacttacc

SEQ ID NO: 193608 - DNA, 35 bp, Artificial Sequence
  Synthetic oligonucleotide
tcttgaaagccctcacattgctctggtccatcccc

SEQ ID NO: 193609 - DNA, 35 bp, Artificial Sequence
  Synthetic oligonucleotide
ggactgcaaagcgtttcctggacccacctacgccc

SEQ ID NO: 193610 - DNA, 35 bp, Artificial Sequence
  Synthetic oligonucleotide
acactccccgcaatcatcaggacggactatttccc

SEQ ID NO: 193611 - DNA, 35 bp, Artificial Sequence
  Synthetic oligonucleotide
aagacatcagagcagctcagcactcatcccctgcc

SEQ ID NO: 193612 - DNA, 35 bp, Artificial Sequence
  Synthetic oligonucleotide
tccgccgtgattggatttaactcgtacgtccctcc

SEQ ID NO: 193613 - DNA, 35 bp, Artificial Sequence
  Synthetic oligonucleotide
tcatcaactccgcgagaattatcgtgactcgctcc

SEQ ID NO: 193614 - DNA, 35 bp, Artificial Sequence
  Synthetic oligonucleotide
gttagctgccgctcattcccaagtccgttatctcc

SEQ ID NO: 193615 - DNA, 35 bp, Artificial Sequence
  Synthetic oligonucleotide
aagtaccttccgtcggttcagtccagcccttgtcc

SEQ ID NO: 193616 - DNA, 35 bp, Artificial Sequence
  Synthetic oligonucleotide
tattgacgattgactgcactaagcaccccctttcc

SEQ ID NO: 193617 - DNA, 35 bp, Artificial Sequence
  Synthetic oligonucleotide
aagtcttagccctccacctggatcgaccgttttcc

SEQ ID NO: 193618 - DNA, 35 bp, Artificial Sequence
  Synthetic oligonucleotide
tcctcatcactcactatcagtctagacggtcccgc

SEQ ID NO: 193619 - DNA, 35 bp, Artificial Sequence
  Synthetic oligonucleotide
gccacgccccttcctgcgccaggtctactttccgc

SEQ ID NO: 193620 - DNA, 35 bp, Artificial Sequence
  Synthetic oligonucleotide
gatccaccaatttgctgttttgataagcccatcgc

SEQ ID NO: 193621 - DNA, 35 bp, Artificial Sequence
  Synthetic oligonucleotide
atgaacgatcggccgttcgtcatgtacctcctcgc

SEQ ID NO: 193622 - DNA, 35 bp, Artificial Sequence
  Synthetic oligonucleotide
gaggccatccctccttgttccgctcaccctgctgc

SEQ ID NO: 193623 - DNA, 35 bp, Artificial Sequence
  Synthetic oligonucleotide
tcagatcacgacccggccccactcatctttgttgc

SEQ ID NO: 193624 - DNA, 35 bp, Artificial Sequence
  Synthetic oligonucleotide
gtaccagaccctatgtgatgcgtcctccttcaatc

SEQ ID NO: 193625 - DNA, 35 bp, Artificial Sequence
  Synthetic oligonucleotide
gggacacgtgaccgttctcgcccgttccttgaatc

SEQ ID NO: 193626 - DNA, 35 bp, Artificial Sequence
  Synthetic oligonucleotide
gagccgtcacacttagttcgttctctcttgtaatc

SEQ ID NO: 193627 - DNA, 35 bp, Artificial Sequence
  Synthetic oligonucleotide
gccacgcccgtggatgtttactcctgatcccactc

SEQ ID NO: 193628 - DNA, 35 bp, Artificial Sequence
  Synthetic oligonucleotide
tgtacgtggcctcttcacactgtactcgcgccctc

SEQ ID NO: 193629 - DNA, 35 bp, Artificial Sequence
  Synthetic oligonucleotide
gtgtgccgcctaatcgtcctaaacgcgctgtcctc

SEQ ID NO: 193630 - DNA, 35 bp, Artificial Sequence
  Synthetic oligonucleotide
tttatcctgaagtgcaaacagtcctgccccccgtc

SEQ ID NO: 193631 - DNA, 35 bp, Artificial Sequence
  Synthetic oligonucleotide
accccccccgttatcttgtgcccgcctggctcttc

SEQ ID NO: 193632 - DNA, 35 bp, Artificial Sequence
  Synthetic oligonucleotide
tgtgcgctgcctccgcctctttaccatttacgttc

SEQ ID NO: 193633 - DNA, 35 bp, Artificial Sequence
  Synthetic oligonucleotide
tcgcgcctacccgatatcgtacttgctgctggttc

SEQ ID NO: 193634 - DNA, 35 bp, Artificial Sequence
  Synthetic oligonucleotide
gcgaattgcgcggccaatgttctacccccgctttc

SEQ ID NO: 193635 - DNA, 35 bp, Artificial Sequence
  Synthetic oligonucleotide
gccataacgcttgctgcttacccccctttagaacg

SEQ ID NO: 193636 - DNA, 35 bp, Artificial Sequence
  Synthetic oligonucleotide
gcagaggtggtggggtcgggtggggttaactaacg

SEQ ID NO: 193637 - DNA, 35 bp, Artificial Sequence
  Synthetic oligonucleotide
atccgccgacggggtgggcgtcgagggggggtacg

SEQ ID NO: 193638 - DNA, 35 bp, Artificial Sequence
  Synthetic oligonucleotide
tctgaacccccaatatgctaaactgtacgattccg

SEQ ID NO: 193639 - DNA, 35 bp, Artificial Sequence
  Synthetic oligonucleotide
tgcaacccccacgtcgtcctctttgtttcgccgcg

SEQ ID NO: 193640 - DNA, 35 bp, Artificial Sequence
  Synthetic oligonucleotide
aacgcactatccgccagctctgtatcgcttttgcg

SEQ ID NO: 193641 - DNA, 35 bp, Artificial Sequence
  Synthetic oligonucleotide
gcccctcctgccgatcacctctcgctaccagatcg

SEQ ID NO: 193642 - DNA, 35 bp, Artificial Sequence
  Synthetic oligonucleotide
tccaccctccctctttgcgtttgtttccgtaaagg

SEQ ID NO: 193643 - DNA, 35 bp, Artificial Sequence
  Synthetic oligonucleotide
tacgccctactgatcctatacgtccacgcctccgg

SEQ ID NO: 193644 - DNA, 35 bp, Artificial Sequence
  Synthetic oligonucleotide
tgcggacgcgacggggaggcagagtggtagggggg

SEQ ID NO: 193645 - DNA, 35 bp, Artificial Sequence
  Synthetic oligonucleotide
aacactggaagtcgggtggcaaggacttagggggg

SEQ ID NO: 193646 - DNA, 35 bp, Artificial Sequence
  Synthetic oligonucleotide
gtgccgcccaacctgtcctctgtcgattcccatgg

SEQ ID NO: 193647 - DNA, 35 bp, Artificial Sequence
  Synthetic oligonucleotide
gcacgctccacagcccacctagacgtccgcgctat

SEQ ID NO: 193648 - DNA, 35 bp, Artificial Sequence
  Synthetic oligonucleotide
tcctcccccagtcgtcatccctggagtaatcacct

SEQ ID NO: 193649 - DNA, 35 bp, Artificial Sequence
  Synthetic oligonucleotide
gagccccagctgttgcctctgctcgccgtttccct

SEQ ID NO: 193650 - DNA, 35 bp, Artificial Sequence
  Synthetic oligonucleotide
accgaccgacgctcgacctcgccaagttgccctct

SEQ ID NO: 193651 - DNA, 35 bp, Artificial Sequence
  Synthetic oligonucleotide
gcccctggattgtacacgtgcgctcaccatcttct

SEQ ID NO: 193652 - DNA, 35 bp, Artificial Sequence
  Synthetic oligonucleotide
tccaacccgtagggctgttattaatcctatgttct

SEQ ID NO: 193653 - DNA, 35 bp, Artificial Sequence
  Synthetic oligonucleotide
gagctccgctgatagatttttcgtcctcctcccgt

SEQ ID NO: 193654 - DNA, 35 bp, Artificial Sequence
  Synthetic oligonucleotide
gtgcgcccattcgctttgtcagtacgctcatccgt

SEQ ID NO: 193655 - DNA, 35 bp, Artificial Sequence
  Synthetic oligonucleotide
gcaccgaccccgttggcaccccttgacttgatcgt

SEQ ID NO: 193656 - DNA, 35 bp, Artificial Sequence
  Synthetic oligonucleotide
tgatgcatcaatccaatcctacgccgttcccgtgt

SEQ ID NO: 193657 - DNA, 35 bp, Artificial Sequence
  Synthetic oligonucleotide
tacgtccgcccacccagtccgcgttaatacaaatt

SEQ ID NO: 193658 - DNA, 35 bp, Artificial Sequence
  Synthetic oligonucleotide
gataagaggccggagggggtcgggagaagataatt

SEQ ID NO: 193659 - DNA, 35 bp, Artificial Sequence
  Synthetic oligonucleotide
tcatcacccgctgccctaccgctatgctgataatt

SEQ ID NO: 193660 - DNA, 35 bp, Artificial Sequence
  Synthetic oligonucleotide
tctcccaccagtaccatgctatgtcacacgccctt

SEQ ID NO: 193661 - DNA, 35 bp, Artificial Sequence
  Synthetic oligonucleotide
acgctcggtccgtactgatacctccgcttggcctt

SEQ ID NO: 193662 - DNA, 35 bp, Artificial Sequence
  Synthetic oligonucleotide
gcccagacgtccgccctccctcacgccttttcctt

SEQ ID NO: 193663 - DNA, 35 bp, Artificial Sequence
  Synthetic oligonucleotide
tcccaacccgcccccgcttacgctcaggtaagctt

SEQ ID NO: 193664 - DNA, 29 bp, Artificial Sequence
  Synthetic oligonucleotide
gccctccctgagctttcctggtaccattt

SEQ ID NO: 193665 - DNA, 35 bp, Artificial Sequence
  Synthetic oligonucleotide
acaacagtagccgctcacattccataccgcccttt

SEQ ID NO: 193666 - DNA, 35 bp, Artificial Sequence
  Synthetic oligonucleotide
tgtcaacttccgccacaggagtccttgccatcttt

SEQ ID NO: 193667 - DNA, 35 bp, Artificial Sequence
  Synthetic oligonucleotide
gccatgccccacattgtactcccgtcacctacaaa

SEQ ID NO: 193668 - DNA, 35 bp, Artificial Sequence
  Synthetic oligonucleotide
accatgtcgcatcgctacgcacccccgtcttccaa

SEQ ID NO: 193669 - DNA, 36 bp, Artificial Sequence
  Synthetic oligonucleotide
tcacaccatcccactgtcacattcgaccctgatcaa

SEQ ID NO: 193670 - DNA, 36 bp, Artificial Sequence
  Synthetic oligonucleotide
gccgatgcccacccttgttacccccttctatcggaa

SEQ ID NO: 193671 - DNA, 36 bp, Artificial Sequence
  Synthetic oligonucleotide
gactgcccaatgtttataccatcgcccgtccactaa

SEQ ID NO: 193672 - DNA, 36 bp, Artificial Sequence
  Synthetic oligonucleotide
aaacgcgggaaacgggagggcaagtgtgggtgctaa

SEQ ID NO: 193673 - DNA, 36 bp, Artificial Sequence
  Synthetic oligonucleotide
tcctgcaccacctgctatccattttgacgtagcaca

SEQ ID NO: 193674 - DNA, 36 bp, Artificial Sequence
  Synthetic oligonucleotide
gactccatcatatggtgcgataccattcctccgaca

SEQ ID NO: 193675 - DNA, 36 bp, Artificial Sequence
  Synthetic oligonucleotide
acgtgcacccccgtcgccttggcatgccgcaaccca

SEQ ID NO: 193676 - DNA, 36 bp, Artificial Sequence
  Synthetic oligonucleotide
tggtcagtcagtcactgtgtctgtcgctcctcccca

SEQ ID NO: 193677 - DNA, 35 bp, Artificial Sequence
  Synthetic oligonucleotide
acgcaccctcactctgctcccactggctctcgcca

SEQ ID NO: 193678 - DNA, 35 bp, Artificial Sequence
  Synthetic oligonucleotide
gctacagtcatccactctgtccagtcctatctcca

SEQ ID NO: 193679 - DNA, 36 bp, Artificial Sequence
  Synthetic oligonucleotide
gggggaagtgggaagcaagggatcgtattcggggca

SEQ ID NO: 193680 - DNA, 36 bp, Artificial Sequence
  Synthetic oligonucleotide
gcccaacctcgcgtgccccctgcgattcttcatgca

SEQ ID NO: 193681 - DNA, 36 bp, Artificial Sequence
  Synthetic oligonucleotide
tagtcaccgctgcggcaattcacctccttcattgca

SEQ ID NO: 193682 - DNA, 36 bp, Artificial Sequence
  Synthetic oligonucleotide
gtacgcccttgcttgcctcggctcccccgtttctca

SEQ ID NO: 193683 - DNA, 37 bp, Artificial Sequence
  Synthetic oligonucleotide
tccgtgccctcatgtggtccatttccttcctccaaga

SEQ ID NO: 193684 - DNA, 37 bp, Artificial Sequence
  Synthetic oligonucleotide
gcctacgacacacccttctgcgccaaccatgcctaga

SEQ ID NO: 193685 - DNA, 37 bp, Artificial Sequence
  Synthetic oligonucleotide
acactcacctccaccgtgatactaacatccgcttaga

SEQ ID NO: 193686 - DNA, 37 bp, Artificial Sequence
  Synthetic oligonucleotide
gacaccccacatgagcttatgggcactatcctgacga

SEQ ID NO: 193687 - DNA, 37 bp, Artificial Sequence
  Synthetic oligonucleotide
tgcatctcgccgttcattcccgcctctaccgaaccga

SEQ ID NO: 193688 - DNA, 37 bp, Artificial Sequence
  Synthetic oligonucleotide
aacccatccccactggccagtacacgtcgtggcccga

SEQ ID NO: 193689 - DNA, 37 bp, Artificial Sequence
  Synthetic oligonucleotide
attccacatcgttgtggctctcgtttcatccctccga

SEQ ID NO: 193690 - DNA, 37 bp, Artificial Sequence
  Synthetic oligonucleotide
tgtgtccgtaactggttacgcttcctcgatacctcga

SEQ ID NO: 193691 - DNA, 38 bp, Artificial Sequence
  Synthetic oligonucleotide
tgtgagcgccactttgtcctgtttgccttaaccctcga

SEQ ID NO: 193692 - DNA, 37 bp, Artificial Sequence
  Synthetic oligonucleotide
gagcaggagagcaggtggtgtaggaagggtggaagga

SEQ ID NO: 193693 - DNA, 37 bp, Artificial Sequence
  Synthetic oligonucleotide
tactacgccgatcgttctcacgccacttgcacacgga

SEQ ID NO: 193694 - DNA, 35 bp, Artificial Sequence
  Synthetic oligonucleotide
atgccgcagttcctcgttccccttcagcccccgga

SEQ ID NO: 193695 - DNA, 37 bp, Artificial Sequence
  Synthetic oligonucleotide
tgtgggggggcgggaggcgtagggtaagtctgccgga

SEQ ID NO: 193696 - DNA, 37 bp, Artificial Sequence
  Synthetic oligonucleotide
ggtcaagttgctgctgccccactcgcccgtttccgga

SEQ ID NO: 193697 - DNA, 37 bp, Artificial Sequence
  Synthetic oligonucleotide
gtgtgaggggaatgggtaagagcacgtagaggcggga

SEQ ID NO: 193698 - DNA, 37 bp, Artificial Sequence
  Synthetic oligonucleotide
gtgcattggaacagtgggaacggaagggcggtatgga

SEQ ID NO: 193699 - DNA, 38 bp, Artificial Sequence
  Synthetic oligonucleotide
tgcacccactaccacccacatcacgatcagtcttatga

SEQ ID NO: 193700 - DNA, 38 bp, Artificial Sequence
  Synthetic oligonucleotide
atccaccgctctatgtggcaacctccgagctaccctga

SEQ ID NO: 193701 - DNA, 37 bp, Artificial Sequence
  Synthetic oligonucleotide
tccgacctcatccattgctgacctgtgatgcccctga

SEQ ID NO: 193702 - DNA, 37 bp, Artificial Sequence
  Synthetic oligonucleotide
actgcccccctccgtgttgtaatgccacccgccctga

SEQ ID NO: 193703 - DNA, 38 bp, Artificial Sequence
  Synthetic oligonucleotide
atcggtcactgtccgtctcatccgccctatcatcctga

SEQ ID NO: 193704 - DNA, 36 bp, Artificial Sequence
  Synthetic oligonucleotide
gtcaccccgctcacttgcttcgactcctgttcctga

SEQ ID NO: 193705 - DNA, 37 bp, Artificial Sequence
  Synthetic oligonucleotide
tgatccccacatccgctttggcactcaacctaggtga

SEQ ID NO: 193706 - DNA, 38 bp, Artificial Sequence
  Synthetic oligonucleotide
gagagccgtaggctggataaacgggaggagaagggtga

SEQ ID NO: 193707 - DNA, 37 bp, Artificial Sequence
  Synthetic oligonucleotide
ttgcccccccggtcctactcaccatatatattggtga

SEQ ID NO: 193708 - DNA, 38 bp, Artificial Sequence
  Synthetic oligonucleotide
gcctcccgtcgcttgcacggtggacacccctcccttga

SEQ ID NO: 193709 - DNA, 37 bp, Artificial Sequence
  Synthetic oligonucleotide
tgccactagttcaacgtagttctctcgccatccttga

SEQ ID NO: 193710 - DNA, 38 bp, Artificial Sequence
  Synthetic oligonucleotide
tcacctgctccgatcccctacagcggcaccaacgttga

SEQ ID NO: 193711 - DNA, 37 bp, Artificial Sequence
  Synthetic oligonucleotide
gcaccgcacgtatccttgggtccttcccgtttgttga

SEQ ID NO: 193712 - DNA, 35 bp, Artificial Sequence
  Synthetic oligonucleotide
gtggccgcccccagtctcgtccgacgtccccaata

SEQ ID NO: 193713 - DNA, 35 bp, Artificial Sequence
  Synthetic oligonucleotide
tacgccacctctctcgctgtgcatgctcattccta

SEQ ID NO: 193714 - DNA, 35 bp, Artificial Sequence
  Synthetic oligonucleotide
tacccgtggccctctcgaggttctattttccgcta

SEQ ID NO: 193715 - DNA, 27 bp, Artificial Sequence
  Synthetic oligonucleotide
tgactgcccgacccccctctgcatcta

SEQ ID NO: 193716 - DNA, 35 bp, Artificial Sequence
  Synthetic oligonucleotide
gcccccggtccttccttgattccaccttgccggta

SEQ ID NO: 193717 - DNA, 36 bp, Artificial Sequence
  Synthetic oligonucleotide
acatccagagaaggggagggtaggaggactggtgta

SEQ ID NO: 193718 - DNA, 35 bp, Artificial Sequence
  Synthetic oligonucleotide
gtcccaggcgcacgtgtttcccctcctccgcctta

SEQ ID NO: 193719 - DNA, 36 bp, Artificial Sequence
  Synthetic oligonucleotide
tcacgtcacgaagtcttttgccactcccatttgtta

SEQ ID NO: 193720 - DNA, 36 bp, Artificial Sequence
  Synthetic oligonucleotide
acttgcccctcccgtatgctcgctattactcgttta

SEQ ID NO: 193721 - DNA, 35 bp, Artificial Sequence
  Synthetic oligonucleotide
gcatctgtcagcccgttccgttatctcgcgcgcac

SEQ ID NO: 193722 - DNA, 35 bp, Artificial Sequence
  Synthetic oligonucleotide
gacactcccccagtgcgctatccctgcttgcctac

SEQ ID NO: 193723 - DNA, 35 bp, Artificial Sequence
  Synthetic oligonucleotide
gaccccctcgctccgtttgcccacgtaccccgtac

SEQ ID NO: 193724 - DNA, 35 bp, Artificial Sequence
  Synthetic oligonucleotide
tagtctcacgttgcgtgcccgttatacccattccc

SEQ ID NO: 193725 - DNA, 35 bp, Artificial Sequence
  Synthetic oligonucleotide
accgtgctgtccttagccccgtactcggatttccc

SEQ ID NO: 193726 - DNA, 35 bp, Artificial Sequence
  Synthetic oligonucleotide
gtcgctcggctcccttgttatgcctgttccacgcc

SEQ ID NO: 193727 - DNA, 35 bp, Artificial Sequence
  Synthetic oligonucleotide
ctagacgtccgtctagtcatccgctccctttcgcc

SEQ ID NO: 193728 - DNA, 35 bp, Artificial Sequence
  Synthetic oligonucleotide
tgtccccgaacccatactgctataatgccaatgcc

SEQ ID NO: 193729 - DNA, 34 bp, Artificial Sequence
  Synthetic oligonucleotide
ttagcccccctcaaatggttttatttcaccctcc

SEQ ID NO: 193730 - DNA, 35 bp, Artificial Sequence
  Synthetic oligonucleotide
ttcgtgacctaacgttttgtccgtgttccctgtcc

SEQ ID NO: 193731 - DNA, 35 bp, Artificial Sequence
  Synthetic oligonucleotide
gtcccacatcttcgtgtctatttgcttgatcttcc

SEQ ID NO: 193732 - DNA, 35 bp, Artificial Sequence
  Synthetic oligonucleotide
gcttaggcggcactcattactggcacccgttttcc

SEQ ID NO: 193733 - DNA, 35 bp, Artificial Sequence
  Synthetic oligonucleotide
tctcgtcctctgatcccttgcctcttagttccagc

SEQ ID NO: 193734 - DNA, 35 bp, Artificial Sequence
  Synthetic oligonucleotide
gagcccgcatttgtatgcgcgtccctccctgccgc

SEQ ID NO: 193735 - DNA, 35 bp, Artificial Sequence
  Synthetic oligonucleotide
ggtgctggacgccccatctatatatccactttcgc

SEQ ID NO: 193736 - DNA, 35 bp, Artificial Sequence
  Synthetic oligonucleotide
tttgcctcctgtagtttccttgccccgcccacggc

SEQ ID NO: 193737 - DNA, 32 bp, Artificial Sequence
  Synthetic oligonucleotide
gcccccccgccgacacctattgtcatcatggc

SEQ ID NO: 193738 - DNA, 35 bp, Artificial Sequence
  Synthetic oligonucleotide
agagccccctctgcttttgttccgtctgctccatc

SEQ ID NO: 193739 - DNA, 35 bp, Artificial Sequence
  Synthetic oligonucleotide
tagcccctttctgctctgtagctcgaccaagcctc

SEQ ID NO: 193740 - DNA, 35 bp, Artificial Sequence
  Synthetic oligonucleotide
gagccaatggcgggcgacacgggggaggggcagtc

SEQ ID NO: 193741 - DNA, 35 bp, Artificial Sequence
  Synthetic oligonucleotide
gcgctccacccacctggctgttagttgacatagtc

SEQ ID NO: 193742 - DNA, 35 bp, Artificial Sequence
  Synthetic oligonucleotide
ggatcacgtcctgtcatcacgttccctgcttcgtc

SEQ ID NO: 193743 - DNA, 35 bp, Artificial Sequence
  Synthetic oligonucleotide
atatgggacgaaggggggtcagagcagggtgggtc

SEQ ID NO: 193744 - DNA, 35 bp, Artificial Sequence
  Synthetic oligonucleotide
gtacttcactgcgtttacgcaccatcacccttgtc

SEQ ID NO: 193745 - DNA, 35 bp, Artificial Sequence
  Synthetic oligonucleotide
attccacccacacccgagtcatatcagaaccattc

SEQ ID NO: 193746 - DNA, 35 bp, Artificial Sequence
  Synthetic oligonucleotide
gaacaagtgggggaaaacaggacacgggtaaaaag

SEQ ID NO: 193747 - DNA, 35 bp, Artificial Sequence
  Synthetic oligonucleotide
actaacgccatcgctgctcccccagttgtgccccg

SEQ ID NO: 193748 - DNA, 35 bp, Artificial Sequence
  Synthetic oligonucleotide
gtcacccttttgaagacctccttgcgacatccccg

SEQ ID NO: 193749 - DNA, 35 bp, Artificial Sequence
  Synthetic oligonucleotide
gccccatcccccagctggtatttcgcaacccgccg

SEQ ID NO: 193750 - DNA, 35 bp, Artificial Sequence
  Synthetic oligonucleotide
ggggggggccgggctagtttttgtagatatgggcg

SEQ ID NO: 193751 - DNA, 35 bp, Artificial Sequence
  Synthetic oligonucleotide
tgagctaggcgagcggacggggcggtgggggtgcg

SEQ ID NO: 193752 - DNA, 35 bp, Artificial Sequence
  Synthetic oligonucleotide
gaacacagggccaagggagaacaacggaaacaagg

SEQ ID NO: 193753 - DNA, 35 bp, Artificial Sequence
  Synthetic oligonucleotide
gatcactggggggaatgggttagggagggaagggg

SEQ ID NO: 193754 - DNA, 35 bp, Artificial Sequence
  Synthetic oligonucleotide
tgtgtcagctccagagtgggagggcaatggggggg

SEQ ID NO: 193755 - DNA, 35 bp, Artificial Sequence
  Synthetic oligonucleotide
ttgcgacttagtaagggtagggaggggtgagtggg

SEQ ID NO: 193756 - DNA, 35 bp, Artificial Sequence
  Synthetic oligonucleotide
tccatccccgtccgcctcggcaccgttggatcatg

SEQ ID NO: 193757 - DNA, 35 bp, Artificial Sequence
  Synthetic oligonucleotide
tgatgccctatcgcaggtctgaagcgctttccctg

SEQ ID NO: 193758 - DNA, 34 bp, Artificial Sequence
  Synthetic oligonucleotide
tctgggccacactgtctttcccaccatccgcctg

SEQ ID NO: 193759 - DNA, 35 bp, Artificial Sequence
  Synthetic oligonucleotide
gacacgcatccaccttccccgacattgcggccgtg

SEQ ID NO: 193760 - DNA, 35 bp, Artificial Sequence
  Synthetic oligonucleotide
aactcgcatcatagtagttgtcacccccatccgtg

SEQ ID NO: 193761 - DNA, 35 bp, Artificial Sequence
  Synthetic oligonucleotide
agctgccctcactcccacgttcgccgccattcttg

SEQ ID NO: 193762 - DNA, 35 bp, Artificial Sequence
  Synthetic oligonucleotide
agtgtgcgccaaccatcgaccgtccccccgtgaat

SEQ ID NO: 193763 - DNA, 35 bp, Artificial Sequence
  Synthetic oligonucleotide
taccacagtcacccgcgctctacagtcctgctact

SEQ ID NO: 193764 - DNA, 35 bp, Artificial Sequence
  Synthetic oligonucleotide
atcgatgccgtagtatcccgtccatctgacaccct

SEQ ID NO: 193765 - DNA, 35 bp, Artificial Sequence
  Synthetic oligonucleotide
gtgagcccatcgtgccttctccacttgtgtaccct

SEQ ID NO: 193766 - DNA, 35 bp, Artificial Sequence
  Synthetic oligonucleotide
ttcgcacgcctgagcgtaaaatctaaccctgccct

SEQ ID NO: 193767 - DNA, 35 bp, Artificial Sequence
  Synthetic oligonucleotide
gtgaccggacccgctgcctagtaggttgattccct

SEQ ID NO: 193768 - DNA, 35 bp, Artificial Sequence
  Synthetic oligonucleotide
atgcgtgtccgttcttccttaccctttgccttcct

SEQ ID NO: 193769 - DNA, 35 bp, Artificial Sequence
  Synthetic oligonucleotide
aatggggcaatgggtcggggggggatgagtaagct

SEQ ID NO: 193770 - DNA, 35 bp, Artificial Sequence
  Synthetic oligonucleotide
tcacgggcgtgggagggagctgctttgggtgggct

SEQ ID NO: 193771 - DNA, 35 bp, Artificial Sequence
  Synthetic oligonucleotide
tacgacattcgcccagtttgacttgcccttcatct

SEQ ID NO: 193772 - DNA, 35 bp, Artificial Sequence
  Synthetic oligonucleotide
gagcgcctcgaccctctgagcccgtccaactatct

SEQ ID NO: 193773 - DNA, 35 bp, Artificial Sequence
  Synthetic oligonucleotide
gaacgacagaacgatcatctttagaaccgccctct

SEQ ID NO: 193774 - DNA, 35 bp, Artificial Sequence
  Synthetic oligonucleotide
acaactcacccgcctgaaacgatgctctcatacgt

SEQ ID NO: 193775 - DNA, 35 bp, Artificial Sequence
  Synthetic oligonucleotide
accaaggcgcaggatgtcccccgacccttcttcgt

SEQ ID NO: 193776 - DNA, 35 bp, Artificial Sequence
  Synthetic oligonucleotide
tatcaccctgtctccggcctatataccgttccggt

SEQ ID NO: 193777 - DNA, 35 bp, Artificial Sequence
  Synthetic oligonucleotide
tcccatccaaccgccgttgccttcctgacatctgt

SEQ ID NO: 193778 - DNA, 35 bp, Artificial Sequence
  Synthetic oligonucleotide
agcactccgcctggtctagccattcatgttcaatt

SEQ ID NO: 193779 - DNA, 33 bp, Artificial Sequence
  Synthetic oligonucleotide
gcttgcatcccgctgttccgtcctacctgaatt

SEQ ID NO: 193780 - DNA, 35 bp, Artificial Sequence
  Synthetic oligonucleotide
gtgggaaaggaggaggggcgtatcagctaagactt

SEQ ID NO: 193781 - DNA, 35 bp, Artificial Sequence
  Synthetic oligonucleotide
tagcatcctgcatctgccacctaggcctatacctt

SEQ ID NO: 193782 - DNA, 35 bp, Artificial Sequence
  Synthetic oligonucleotide
agctcagcgtactcgtaccctgcctcctcgtcctt

SEQ ID NO: 193783 - DNA, 35 bp, Artificial Sequence
  Synthetic oligonucleotide
accacgacccgtcacggcaagtccccactttcctt

SEQ ID NO: 193784 - DNA, 26 bp, Artificial Sequence
  Synthetic oligonucleotide
ttgccatgccgcccccttctattctt

SEQ ID NO: 193785 - DNA, 35 bp, Artificial Sequence
  Synthetic oligonucleotide
gggacgatcgcccatcgtatgtcctcgcccccttt

SEQ ID NO: 193786 - DNA, 36 bp, Artificial Sequence
  Synthetic oligonucleotide
gatggcgtggagggaagcaaacacggggataaaaaa

SEQ ID NO: 193787 - DNA, 36 bp, Artificial Sequence
  Synthetic oligonucleotide
tgacgggggagaggggggggtgggagtagggtgcaa

SEQ ID NO: 193788 - DNA, 35 bp, Artificial Sequence
  Synthetic oligonucleotide
atgcactcgcaacgtagttttccgtaccccccaca

SEQ ID NO: 193789 - DNA, 36 bp, Artificial Sequence
  Synthetic oligonucleotide
ggaggggatgctaggggcacagggggggtcatgaca

SEQ ID NO: 193790 - DNA, 36 bp, Artificial Sequence
  Synthetic oligonucleotide
gatgccccccctcctatacgcttactgtgtcataca

SEQ ID NO: 193791 - DNA, 36 bp, Artificial Sequence
  Synthetic oligonucleotide
aagtcccagccactgttatctgcaatctagccccca

SEQ ID NO: 193792 - DNA, 35 bp, Artificial Sequence
  Synthetic oligonucleotide
gtgggcccccagagctttatactacacttacgcca

SEQ ID NO: 193793 - DNA, 36 bp, Artificial Sequence
  Synthetic oligonucleotide
actgccgcagtgcttttagacgttacactgaggcca

SEQ ID NO: 193794 - DNA, 36 bp, Artificial Sequence
  Synthetic oligonucleotide
accaccgcatttggaattcctgctctcttccggcca

SEQ ID NO: 193795 - DNA, 36 bp, Artificial Sequence
  Synthetic oligonucleotide
gtgtcgcctcacgcctcttagataccatcttggcca

SEQ ID NO: 193796 - DNA, 36 bp, Artificial Sequence
  Synthetic oligonucleotide
tccaacgtcacggggatttttacccgaccacctcca

SEQ ID NO: 193797 - DNA, 36 bp, Artificial Sequence
  Synthetic oligonucleotide
tgacaacattccgtgttgccctccttagtatttcca

SEQ ID NO: 193798 - DNA, 36 bp, Artificial Sequence
  Synthetic oligonucleotide
agaacatggggagaatatgatagaacggggggagca

SEQ ID NO: 193799 - DNA, 36 bp, Artificial Sequence
  Synthetic oligonucleotide
gtactggtacgtccaatcctggttaactcccccgca

SEQ ID NO: 193800 - DNA, 36 bp, Artificial Sequence
  Synthetic oligonucleotide
atcgaactgcgccgtccccactattcccggtccgca

SEQ ID NO: 193801 - DNA, 35 bp, Artificial Sequence
  Synthetic oligonucleotide
tcttgttcgccgcaggtcccatctactcgttcgca

SEQ ID NO: 193802 - DNA, 36 bp, Artificial Sequence
  Synthetic oligonucleotide
acatccgcacatgcgtacttcttccttcactatgca

SEQ ID NO: 193803 - DNA, 31 bp, Artificial Sequence
  Synthetic oligonucleotide
ttcacaccccgccaaagtatccgtgccatca

SEQ ID NO: 193804 - DNA, 36 bp, Artificial Sequence
  Synthetic oligonucleotide
tcccgactcgcaccctgcctggcttccgatccatca

SEQ ID NO: 193805 - DNA, 36 bp, Artificial Sequence
  Synthetic oligonucleotide
tccaatcctcggtcatctgttgcctgtcacctatca

SEQ ID NO: 193806 - DNA, 36 bp, Artificial Sequence
  Synthetic oligonucleotide
tgtgatgccctccccgttacgaacatgccgaactca

SEQ ID NO: 193807 - DNA, 35 bp, Artificial Sequence
  Synthetic oligonucleotide
gatgcatagcgcccagcgttccaccaactgcctca

SEQ ID NO: 193808 - DNA, 36 bp, Artificial Sequence
  Synthetic oligonucleotide
gtcgatcgcgcgccgacctccataaattctgcctca

SEQ ID NO: 193809 - DNA, 36 bp, Artificial Sequence
  Synthetic oligonucleotide
gttgtgctgtattcgctcctgtccccgtcctggtca

SEQ ID NO: 193810 - DNA, 35 bp, Artificial Sequence
  Synthetic oligonucleotide
gtggtgctcgtttctgctgctcatgtacccgttca

SEQ ID NO: 193811 - DNA, 37 bp, Artificial Sequence
  Synthetic oligonucleotide
agttcacgcacattccagcccccgcctattttggaga

SEQ ID NO: 193812 - DNA, 37 bp, Artificial Sequence
  Synthetic oligonucleotide
aacagtgggtgtggagtgtgaggaggggggatgacga

SEQ ID NO: 193813 - DNA, 37 bp, Artificial Sequence
  Synthetic oligonucleotide
aaggacgccccctctatgtagtccgctctccacccga

SEQ ID NO: 193814 - DNA, 36 bp, Artificial Sequence
  Synthetic oligonucleotide
agatgcgcttgcccttgttcttattctgacccccga

SEQ ID NO: 193815 - DNA, 37 bp, Artificial Sequence
  Synthetic oligonucleotide
gtgtccgtagtctctgtctccatgcgccccctgccga

SEQ ID NO: 193816 - DNA, 35 bp, Artificial Sequence
  Synthetic oligonucleotide
tacagcgaacatacgcttagttgccccacctccga

SEQ ID NO: 193817 - DNA, 36 bp, Artificial Sequence
  Synthetic oligonucleotide
atgagcacctatcttgcgagtacctgacctctccga

SEQ ID NO: 193818 - DNA, 37 bp, Artificial Sequence
  Synthetic oligonucleotide
tggagggggcgggagggttagttctgcggcagatcga

SEQ ID NO: 193819 - DNA, 35 bp, Artificial Sequence
  Synthetic oligonucleotide
ttgtccctctatactgtctcctgtcaatccctcga

SEQ ID NO: 193820 - DNA, 35 bp, Artificial Sequence
  Synthetic oligonucleotide
aagccgggctacctatatgggttgggagggctcga

SEQ ID NO: 193821 - DNA, 37 bp, Artificial Sequence
  Synthetic oligonucleotide
gcatagacgcgcccttctgtcagaatcaccctctcga

SEQ ID NO: 193822 - DNA, 37 bp, Artificial Sequence
  Synthetic oligonucleotide
tctcccacccgtatgtattcagctctgcttctgtcga

SEQ ID NO: 193823 - DNA, 38 bp, Artificial Sequence
  Synthetic oligonucleotide
tggggaggtgtagaggtatgggcgggggagcgtgtcga

SEQ ID NO: 193824 - DNA, 37 bp, Artificial Sequence
  Synthetic oligonucleotide
aggacgggggaaattgtttgtggacggaggggaagga

SEQ ID NO: 193825 - DNA, 36 bp, Artificial Sequence
  Synthetic oligonucleotide
gcccacccgcacggtctcattctttcctccatagga

SEQ ID NO: 193826 - DNA, 37 bp, Artificial Sequence
  Synthetic oligonucleotide
aacgatgaaggatggaggggcaaaaagtggggccgga

SEQ ID NO: 193827 - DNA, 37 bp, Artificial Sequence
  Synthetic oligonucleotide
taggtgggcggtgggggaaaggatctgggggtccgga

SEQ ID NO: 193828 - DNA, 37 bp, Artificial Sequence
  Synthetic oligonucleotide
tgtgggatgtggaggggtgcaggagaagtggagcgga

SEQ ID NO: 193829 - DNA, 36 bp, Artificial Sequence
  Synthetic oligonucleotide
gccggggctactctcgggtcgggtcccaaccgggga

SEQ ID NO: 193830 - DNA, 37 bp, Artificial Sequence
  Synthetic oligonucleotide
acaagaacaggtgtcaaaggggtggaaaaagggggga

SEQ ID NO: 193831 - DNA, 37 bp, Artificial Sequence
  Synthetic oligonucleotide
ttcgccgccccgccgtgttctactacccacaattgga

SEQ ID NO: 193832 - DNA, 37 bp, Artificial Sequence
  Synthetic oligonucleotide
atggggcgagagcgggggaggaaagtggattattgga

SEQ ID NO: 193833 - DNA, 37 bp, Artificial Sequence
  Synthetic oligonucleotide
tagggtgcagatgggaggggggggtaacttctaatga

SEQ ID NO: 193834 - DNA, 37 bp, Artificial Sequence
  Synthetic oligonucleotide
gacgcgtcaaagggggaaggcaaggaggtgaggatga

SEQ ID NO: 193835 - DNA, 38 bp, Artificial Sequence
  Synthetic oligonucleotide
tccctgcccacgacggtacacgccccctcactctatga

SEQ ID NO: 193836 - DNA, 37 bp, Artificial Sequence
  Synthetic oligonucleotide
gcaggccacacaatctgacttgacacatcctccctga

SEQ ID NO: 193837 - DNA, 38 bp, Artificial Sequence
  Synthetic oligonucleotide
ttgagtagcgcaaatctgccgcctacccttcatcctga

SEQ ID NO: 193838 - DNA, 38 bp, Artificial Sequence
  Synthetic oligonucleotide
tatgagcgcccgcatcttacgctcacttgtcctcctga

SEQ ID NO: 193839 - DNA, 37 bp, Artificial Sequence
  Synthetic oligonucleotide
tcctagctcatgtcatcaccacccccccgaccgctga

SEQ ID NO: 193840 - DNA, 37 bp, Artificial Sequence
  Synthetic oligonucleotide
gcatcccaatgttatgctagccctcctgttccgctga

SEQ ID NO: 193841 - DNA, 36 bp, Artificial Sequence
  Synthetic oligonucleotide
gccacccatccctctcaatcccccaagggtctctga

SEQ ID NO: 193842 - DNA, 37 bp, Artificial Sequence
  Synthetic oligonucleotide
tgcctgaccctgctacctcgtcacagtcctagcgtga

SEQ ID NO: 193843 - DNA, 38 bp, Artificial Sequence
  Synthetic oligonucleotide
acccgactccatatcgctttaccgacctgtcttggtga

SEQ ID NO: 193844 - DNA, 38 bp, Artificial Sequence
  Synthetic oligonucleotide
tatggcccactcgcacctgtacttgactccccctgtga

SEQ ID NO: 193845 - DNA, 38 bp, Artificial Sequence
  Synthetic oligonucleotide
gtcaatggacagggacgttaagggggggcaatgtgtga

SEQ ID NO: 193846 - DNA, 37 bp, Artificial Sequence
  Synthetic oligonucleotide
tctcgccctgctcattgactcgcaatcccttccttga

SEQ ID NO: 193847 - DNA, 38 bp, Artificial Sequence
  Synthetic oligonucleotide
tatgcgcttgccctcccctcttttgccacgtcgcttga

SEQ ID NO: 193848 - DNA, 38 bp, Artificial Sequence
  Synthetic oligonucleotide
gacatggaggcggaggaaggggggcgcgaacaagttga

SEQ ID NO: 193849 - DNA, 38 bp, Artificial Sequence
  Synthetic oligonucleotide
gcacggacgaagaggtacggggaacggcgaagggttga

SEQ ID NO: 193850 - DNA, 35 bp, Artificial Sequence
  Synthetic oligonucleotide
tcacgaagcgttttcgccattcctcgtcgcccata

SEQ ID NO: 193851 - DNA, 35 bp, Artificial Sequence
  Synthetic oligonucleotide
gtccatcccctcgtattgtttacttgttatgtata

SEQ ID NO: 193852 - DNA, 34 bp, Artificial Sequence
  Synthetic oligonucleotide
taacgcccgccacttcggtctttggtgtacccta

SEQ ID NO: 193853 - DNA, 36 bp, Artificial Sequence
  Synthetic oligonucleotide
atgtcaatcccccccctgaagtgtcgccaggcccta

SEQ ID NO: 193854 - DNA, 36 bp, Artificial Sequence
  Synthetic oligonucleotide
agctgctcgccaactggttacacttcctcccgccta

SEQ ID NO: 193855 - DNA, 35 bp, Artificial Sequence
  Synthetic oligonucleotide
gaggggggggtgatgatggagggaaggaataagta

SEQ ID NO: 193856 - DNA, 35 bp, Artificial Sequence
  Synthetic oligonucleotide
gacctgctccgcccctgttagtttcgaacatagta

SEQ ID NO: 193857 - DNA, 35 bp, Artificial Sequence
  Synthetic oligonucleotide
aggggagggcaagggcgggatgtttggtatgggta

SEQ ID NO: 193858 - DNA, 36 bp, Artificial Sequence
  Synthetic oligonucleotide
attccgcacacccctgtgcctatgacgcttactgta

SEQ ID NO: 193859 - DNA, 35 bp, Artificial Sequence
  Synthetic oligonucleotide
tccatgagccgaccattctgtcctgtagcacctta

SEQ ID NO: 193860 - DNA, 35 bp, Artificial Sequence
  Synthetic oligonucleotide
gccccccgcgtgatcgtttccaccgtttgccctta

SEQ ID NO: 193861 - DNA, 35 bp, Artificial Sequence
  Synthetic oligonucleotide
gatgcgccctccagccttgagttcgttaacggtta

SEQ ID NO: 193862 - DNA, 36 bp, Artificial Sequence
  Synthetic oligonucleotide
tcaacgcccctactgagcttccgtacggtactttta

SEQ ID NO: 193863 - DNA, 35 bp, Artificial Sequence
  Synthetic oligonucleotide
gcgagagagaaggggggaatgagtatgaagagaac

SEQ ID NO: 193864 - DNA, 35 bp, Artificial Sequence
  Synthetic oligonucleotide
gtccagcgcatgttcgctttaccttcggttcccac

SEQ ID NO: 193865 - DNA, 35 bp, Artificial Sequence
  Synthetic oligonucleotide
tcccaggcactgtagtgatcgcctctgccccaccc

SEQ ID NO: 193866 - DNA, 35 bp, Artificial Sequence
  Synthetic oligonucleotide
gcgcggagcgatcgcggacgtacccatcatcaccc

SEQ ID NO: 193867 - DNA, 35 bp, Artificial Sequence
  Synthetic oligonucleotide
atacagccagctgccccgtcctggtgattgcgccc

SEQ ID NO: 193868 - DNA, 35 bp, Artificial Sequence
  Synthetic oligonucleotide
tcacagccactactgctcgccgtactttattgccc

SEQ ID NO: 193869 - DNA, 35 bp, Artificial Sequence
  Synthetic oligonucleotide
agtcaaccgggcgccgtttaatcttgctctgtccc

SEQ ID NO: 193870 - DNA, 35 bp, Artificial Sequence
  Synthetic oligonucleotide
atcagtcccccaccagaagcctcgttcatacagcc

SEQ ID NO: 193871 - DNA, 35 bp, Artificial Sequence
  Synthetic oligonucleotide
gtagagattgtgtatcctgtccccctaccatcgcc

SEQ ID NO: 193872 - DNA, 35 bp, Artificial Sequence
  Synthetic oligonucleotide
gccccgccccagtgtgttctgtcatcgtaccatcc

SEQ ID NO: 193873 - DNA, 35 bp, Artificial Sequence
  Synthetic oligonucleotide
gtgaatacgtcggttccgcaataacacatccatcc

SEQ ID NO: 193874 - DNA, 35 bp, Artificial Sequence
  Synthetic oligonucleotide
tcaaaaccggctcctatgctgcaaaggttccatcc

SEQ ID NO: 193875 - DNA, 35 bp, Artificial Sequence
  Synthetic oligonucleotide
atgtccctccagtgtgtagttaacttgcccgatcc

SEQ ID NO: 193876 - DNA, 35 bp, Artificial Sequence
  Synthetic oligonucleotide
tatcgctaccatggcatccgctccagtttttatcc

SEQ ID NO: 193877 - DNA, 35 bp, Artificial Sequence
  Synthetic oligonucleotide
ggaaccatcaggatcgctcttagcgcttcacctcc

SEQ ID NO: 193878 - DNA, 35 bp, Artificial Sequence
  Synthetic oligonucleotide
gtccgttagccaacgttctacacctgctgacctcc

SEQ ID NO: 193879 - DNA, 35 bp, Artificial Sequence
  Synthetic oligonucleotide
taatgctcccgatctgctgcgttccccctgagtcc

SEQ ID NO: 193880 - DNA, 35 bp, Artificial Sequence
  Synthetic oligonucleotide
aacacctgtcagcattttttaacaatactccttcc

SEQ ID NO: 193881 - DNA, 35 bp, Artificial Sequence
  Synthetic oligonucleotide
gcgaggagccgccctcgttgggtttttcgctttcc

SEQ ID NO: 193882 - DNA, 36 bp, Artificial Sequence
  Synthetic oligonucleotide
aacagggggaaggggggtcgagggtgatcatacagc

SEQ ID NO: 193883 - DNA, 35 bp, Artificial Sequence
  Synthetic oligonucleotide
acatcgctatcatgatctatgtactgcccgcccgc

SEQ ID NO: 193884 - DNA, 35 bp, Artificial Sequence
  Synthetic oligonucleotide
gtccctgcccccgtagaatttgtccttgatagcgc

SEQ ID NO: 193885 - DNA, 35 bp, Artificial Sequence
  Synthetic oligonucleotide
gcctccacccggtgtaccccgccggattttcatgc

SEQ ID NO: 193886 - DNA, 36 bp, Artificial Sequence
  Synthetic oligonucleotide
tgcaagcctgccagactcctgcgttttcctcactgc

SEQ ID NO: 193887 - DNA, 35 bp, Artificial Sequence
  Synthetic oligonucleotide
tcccgccccgaatttgcaccgtactattggactgc

SEQ ID NO: 193888 - DNA, 35 bp, Artificial Sequence
  Synthetic oligonucleotide
tgagtcgtccgactatcatgcccgttcgcactatc

SEQ ID NO: 193889 - DNA, 35 bp, Artificial Sequence
  Synthetic oligonucleotide
tatccaccccgggaattcgaatgactagacacctc

SEQ ID NO: 193890 - DNA, 35 bp, Artificial Sequence
  Synthetic oligonucleotide
tgacattgtagccacgtcacctatttctgcacctc

SEQ ID NO: 193891 - DNA, 35 bp, Artificial Sequence
  Synthetic oligonucleotide
gaaccgaggcatatcgtttactctcctccccattc

SEQ ID NO: 193892 - DNA, 35 bp, Artificial Sequence
  Synthetic oligonucleotide
tgtgacgagccacctcgattcaccttgatccattc

SEQ ID NO: 193893 - DNA, 35 bp, Artificial Sequence
  Synthetic oligonucleotide
tgtgactccgggcccctcgtgcgcttctcctattc

SEQ ID NO: 193894 - DNA, 35 bp, Artificial Sequence
  Synthetic oligonucleotide
acatgcattgtgcaaggtccatcctcattctgttc

SEQ ID NO: 193895 - DNA, 35 bp, Artificial Sequence
  Synthetic oligonucleotide
tacacctttcatgtactttgttagctaccgttttc

SEQ ID NO: 193896 - DNA, 35 bp, Artificial Sequence
  Synthetic oligonucleotide
gaaagaaggtaagggatagtagggagtgggccaag

SEQ ID NO: 193897 - DNA, 34 bp, Artificial Sequence
  Synthetic oligonucleotide
gaagggaaggtgggcggagggaggacggatcgag

SEQ ID NO: 193898 - DNA, 35 bp, Artificial Sequence
  Synthetic oligonucleotide
gacgcgaaataaatagggggcgaggggttagaacg

SEQ ID NO: 193899 - DNA, 35 bp, Artificial Sequence
  Synthetic oligonucleotide
atgatcagggtcctactcaaggtcgtcgccccccg

SEQ ID NO: 193900 - DNA, 35 bp, Artificial Sequence
  Synthetic oligonucleotide
gtagcctcccacgtacctctccgccctgttcagcg

SEQ ID NO: 193901 - DNA, 35 bp, Artificial Sequence
  Synthetic oligonucleotide
gttccaccctccaagttaatattagcctcacctcg

SEQ ID NO: 193902 - DNA, 35 bp, Artificial Sequence
  Synthetic oligonucleotide
tcatgctgccgtgatgtcgcattttcgctccctcg

SEQ ID NO: 193903 - DNA, 35 bp, Artificial Sequence
  Synthetic oligonucleotide
tccatcgcaggttccgcatctccgtttctatgtcg

SEQ ID NO: 193904 - DNA, 35 bp, Artificial Sequence
  Synthetic oligonucleotide
tgatagcactagggaaggacgggttacagggaggg

SEQ ID NO: 193905 - DNA, 35 bp, Artificial Sequence
  Synthetic oligonucleotide
gaggagaagaggacggagggtgtgggaagagcggg

SEQ ID NO: 193906 - DNA, 35 bp, Artificial Sequence
  Synthetic oligonucleotide
tggtacgtcagaaagaggtgggagtggggggtggg

SEQ ID NO: 193907 - DNA, 35 bp, Artificial Sequence
  Synthetic oligonucleotide
agtacgggcgggaggggggataacggtgccagtgg

SEQ ID NO: 193908 - DNA, 35 bp, Artificial Sequence
  Synthetic oligonucleotide
gccgagccgtctgcgtccgtcatacaccccccttg

SEQ ID NO: 193909 - DNA, 35 bp, Artificial Sequence
  Synthetic oligonucleotide
tggaattgccagcgctgctctccgccacaatccat

SEQ ID NO: 193910 - DNA, 35 bp, Artificial Sequence
  Synthetic oligonucleotide
ttgatgtgccctcgccgaatgcgctaaccgctcat

SEQ ID NO: 193911 - DNA, 35 bp, Artificial Sequence
  Synthetic oligonucleotide
accatactgccccgtcgcccctttgtcgatgatat

SEQ ID NO: 193912 - DNA, 35 bp, Artificial Sequence
  Synthetic oligonucleotide
agcacgtctagccgttagtccattggtttccccct

SEQ ID NO: 193913 - DNA, 35 bp, Artificial Sequence
  Synthetic oligonucleotide
atgacctgtcataactctttattgttgacccctct

SEQ ID NO: 193914 - DNA, 35 bp, Artificial Sequence
  Synthetic oligonucleotide
gcccctgagtcagactttctctccgtgctctgtct

SEQ ID NO: 193915 - DNA, 35 bp, Artificial Sequence
  Synthetic oligonucleotide
atccgccccccagacctcgtcttaagaacgattct

SEQ ID NO: 193916 - DNA, 35 bp, Artificial Sequence
  Synthetic oligonucleotide
tgggtgtgggggagggtgaatcggggcagttctgt

SEQ ID NO: 193917 - DNA, 35 bp, Artificial Sequence
  Synthetic oligonucleotide
gtgcacgcagtatacgtttcgtgtcatccggttgt

SEQ ID NO: 193918 - DNA, 35 bp, Artificial Sequence
  Synthetic oligonucleotide
gccgccccgatcccgcatgcgtagtgttactcctt

SEQ ID NO: 193919 - DNA, 35 bp, Artificial Sequence
  Synthetic oligonucleotide
tcaacgcccctgtcccggtgatccctctccatctt

SEQ ID NO: 193920 - DNA, 35 bp, Artificial Sequence
  Synthetic oligonucleotide
gtactccgctctccgcatatgcttccttgcacgtt

SEQ ID NO: 193921 - DNA, 35 bp, Artificial Sequence
  Synthetic oligonucleotide
gccccacgcattgcttttacctcatccattaggtt

SEQ ID NO: 193922 - DNA, 35 bp, Artificial Sequence
  Synthetic oligonucleotide
gggagggttgcgggtgggtaaaggcatctagtttt

SEQ ID NO: 193923 - DNA, 36 bp, Artificial Sequence
  Synthetic oligonucleotide
tgagccgtagctttgtcttggcccgatacccaccaa

SEQ ID NO: 193924 - DNA, 36 bp, Artificial Sequence
  Synthetic oligonucleotide
tccacccccgctctacccccactgtgtatttgagaa

SEQ ID NO: 193925 - DNA, 35 bp, Artificial Sequence
  Synthetic oligonucleotide
gacttgcgcgacgggtgaggcgggtcgggatagaa

SEQ ID NO: 193926 - DNA, 36 bp, Artificial Sequence
  Synthetic oligonucleotide
gcaccactcgcccgattctttagcacgccttgcgaa

SEQ ID NO: 193927 - DNA, 36 bp, Artificial Sequence
  Synthetic oligonucleotide
gaggaatggaggaatgggataagggtgatggcggaa

SEQ ID NO: 193928 - DNA, 36 bp, Artificial Sequence
  Synthetic oligonucleotide
agtcatcaatacgtcactgcccccggttcgctcaca

SEQ ID NO: 193929 - DNA, 36 bp, Artificial Sequence
  Synthetic oligonucleotide
tacccacccacgtatgtgccttccagaaaattacca

SEQ ID NO: 193930 - DNA, 36 bp, Artificial Sequence
  Synthetic oligonucleotide
gttcgagtgcgtccattttgccagttactcccccca

SEQ ID NO: 193931 - DNA, 36 bp, Artificial Sequence
  Synthetic oligonucleotide
aaatctgcgccgtccccacttctgctccgtgtccca

SEQ ID NO: 193932 - DNA, 35 bp, Artificial Sequence
  Synthetic oligonucleotide
tatccgcgcctcgcaatgcactttgcctcactcca

SEQ ID NO: 193933 - DNA, 36 bp, Artificial Sequence
  Synthetic oligonucleotide
taggactgctcactccgtcacatacgccttcctcca

SEQ ID NO: 193934 - DNA, 36 bp, Artificial Sequence
  Synthetic oligonucleotide
accacaggcccagatcttgattgctcaccactcgca

SEQ ID NO: 193935 - DNA, 35 bp, Artificial Sequence
  Synthetic oligonucleotide
gtactcccgtgttccgttccgccgttttatcatca

SEQ ID NO: 193936 - DNA, 36 bp, Artificial Sequence
  Synthetic oligonucleotide
atctacgatcccatctgcccatcgaccctgttatca

SEQ ID NO: 193937 - DNA, 35 bp, Artificial Sequence
  Synthetic oligonucleotide
tagccggcctccgcaattgtttttacccgtcctca

SEQ ID NO: 193938 - DNA, 36 bp, Artificial Sequence
  Synthetic oligonucleotide
aacaaccacctatggtgtaatgccctttatacttca

SEQ ID NO: 193939 - DNA, 36 bp, Artificial Sequence
  Synthetic oligonucleotide
tagcactccacgttagttttcggccgtatttcttca

SEQ ID NO: 193940 - DNA, 37 bp, Artificial Sequence
  Synthetic oligonucleotide
atggtggggtaacatggaggggggaggtccggaaaga

SEQ ID NO: 193941 - DNA, 37 bp, Artificial Sequence
  Synthetic oligonucleotide
gtgacgataggctgatgggggaagaaggggggcaaga

SEQ ID NO: 193942 - DNA, 37 bp, Artificial Sequence
  Synthetic oligonucleotide
accttgcgacgtgcgttcattgccccatctcttcaga

SEQ ID NO: 193943 - DNA, 37 bp, Artificial Sequence
  Synthetic oligonucleotide
gagacaaaggtagggttgcaaggtgcggtgaaggaga

SEQ ID NO: 193944 - DNA, 37 bp, Artificial Sequence
  Synthetic oligonucleotide
ggtccgccttagcttgtcagtcccactcccctcacga

SEQ ID NO: 193945 - DNA, 37 bp, Artificial Sequence
  Synthetic oligonucleotide
gttgcgggaacagggagggagaaagcgggcctcacga

SEQ ID NO: 193946 - DNA, 37 bp, Artificial Sequence
  Synthetic oligonucleotide
gtgatgctctcatgaccgtcattgccctacctcccga

SEQ ID NO: 193947 - DNA, 37 bp, Artificial Sequence
  Synthetic oligonucleotide
gtactgccccgatgaatgtttcgctttggcctcccga

SEQ ID NO: 193948 - DNA, 35 bp, Artificial Sequence
  Synthetic oligonucleotide
gaggcccgcctgtctagccccatccctacacgcga

SEQ ID NO: 193949 - DNA, 36 bp, Artificial Sequence
  Synthetic oligonucleotide
tgcggggcgggaggggaattatagaacgaggggcga

SEQ ID NO: 193950 - DNA, 37 bp, Artificial Sequence
  Synthetic oligonucleotide
ggttcgaacggggggggggggaaagggtgggcaagga

SEQ ID NO: 193951 - DNA, 37 bp, Artificial Sequence
  Synthetic oligonucleotide
ggtgggggggagggcggagagagccaggagcgcagga

SEQ ID NO: 193952 - DNA, 36 bp, Artificial Sequence
  Synthetic oligonucleotide
tgacctgggaaggaactgaaaaagctggggagagga

SEQ ID NO: 193953 - DNA, 38 bp, Artificial Sequence
  Synthetic oligonucleotide
gcaacgacgcttgtgggagggagggttacggcggagga

SEQ ID NO: 193954 - DNA, 36 bp, Artificial Sequence
  Synthetic oligonucleotide
tggaaagaggcggagtaggaaggatcgtgggtagga

SEQ ID NO: 193955 - DNA, 37 bp, Artificial Sequence
  Synthetic oligonucleotide
acgatctgggcgggggggggatagtaacagtaaggga

SEQ ID NO: 193956 - DNA, 36 bp, Artificial Sequence
  Synthetic oligonucleotide
gtgggtccgcattcgggtgggatatgaggttaggga

SEQ ID NO: 193957 - DNA, 37 bp, Artificial Sequence
  Synthetic oligonucleotide
tagggggggcgggctgatttactgtgacgtgagggga

SEQ ID NO: 193958 - DNA, 37 bp, Artificial Sequence
  Synthetic oligonucleotide
gagccgttggcggacgggagagcgagggaacggggga

SEQ ID NO: 193959 - DNA, 36 bp, Artificial Sequence
  Synthetic oligonucleotide
tcagtgtgcggccggggtgaggggggtgggtctgga

SEQ ID NO: 193960 - DNA, 37 bp, Artificial Sequence
  Synthetic oligonucleotide
tgtgttgcccccttctgtcttcttggcctgtcgtgga

SEQ ID NO: 193961 - DNA, 37 bp, Artificial Sequence
  Synthetic oligonucleotide
agggggcatgggtgggagttagcaaatgggcggtgga

SEQ ID NO: 193962 - DNA, 36 bp, Artificial Sequence
  Synthetic oligonucleotide
tcatacgcccctgagtgcaccacctgtttaattgga

SEQ ID NO: 193963 - DNA, 37 bp, Artificial Sequence
  Synthetic oligonucleotide
gggggggtggcatggggtttatacgtaggggattgga

SEQ ID NO: 193964 - DNA, 37 bp, Artificial Sequence
  Synthetic oligonucleotide
tccacgcactctaggacgcgagtttctatcttttgga

SEQ ID NO: 193965 - DNA, 37 bp, Artificial Sequence
  Synthetic oligonucleotide
gtacccccgactatcgagtatcaacgctccccaatga

SEQ ID NO: 193966 - DNA, 36 bp, Artificial Sequence
  Synthetic oligonucleotide
acagaggtggtggaggaaagagattggggagaatga

SEQ ID NO: 193967 - DNA, 37 bp, Artificial Sequence
  Synthetic oligonucleotide
gtatcctgcccaccctttccggtccgtcatggaatga

SEQ ID NO: 193968 - DNA, 38 bp, Artificial Sequence
  Synthetic oligonucleotide
acactgacccgaattttgatattatcgccactccatga

SEQ ID NO: 193969 - DNA, 38 bp, Artificial Sequence
  Synthetic oligonucleotide
gggtagggaggaggcacaggaaaggaccgcgcggatga

SEQ ID NO: 193970 - DNA, 38 bp, Artificial Sequence
  Synthetic oligonucleotide
acatagaccgaggtagggaagacaggggggggtgatga

SEQ ID NO: 193971 - DNA, 38 bp, Artificial Sequence
  Synthetic oligonucleotide
acacgccctacaatggttacactgacctccctgactga

SEQ ID NO: 193972 - DNA, 37 bp, Artificial Sequence
  Synthetic oligonucleotide
acacaatccgttcgcttgcgattaaactaccacctga

SEQ ID NO: 193973 - DNA, 37 bp, Artificial Sequence
  Synthetic oligonucleotide
tgtctgcccccggaaaattatcgcccgccacccctga

SEQ ID NO: 193974 - DNA, 37 bp, Artificial Sequence
  Synthetic oligonucleotide
tgcaacaccgcccggtgtctactttttccatccctga

SEQ ID NO: 193975 - DNA, 37 bp, Artificial Sequence
  Synthetic oligonucleotide
atagcgcgaccgcgagtccgattcccttccttcctga

SEQ ID NO: 193976 - DNA, 37 bp, Artificial Sequence
  Synthetic oligonucleotide
atgacccgcatctgccctccagccttctgtccgctga

SEQ ID NO: 193977 - DNA, 37 bp, Artificial Sequence
  Synthetic oligonucleotide
taaggtgacgaagaggggtagggtggcggtgtagtga

SEQ ID NO: 193978 - DNA, 37 bp, Artificial Sequence
  Synthetic oligonucleotide
gtcccgcccgccttcctttttatactcgtcgctgtga

SEQ ID NO: 193979 - DNA, 38 bp, Artificial Sequence
  Synthetic oligonucleotide
gggaagtgcgccttcattagcttctgtccgttacttga

SEQ ID NO: 193980 - DNA, 38 bp, Artificial Sequence
  Synthetic oligonucleotide
gcgacccccattgtgcgtttggtcccactcatccttga

SEQ ID NO: 193981 - DNA, 38 bp, Artificial Sequence
  Synthetic oligonucleotide
gagggaggtgagcgagggaggagagacaagatgtttga

SEQ ID NO: 193982 - DNA, 38 bp, Artificial Sequence
  Synthetic oligonucleotide
ggattgtgccacacttagtatttgccccccgtttttga

SEQ ID NO: 193983 - DNA, 35 bp, Artificial Sequence
  Synthetic oligonucleotide
aagagagggcaaggatgaatgaggacggggcgcta

SEQ ID NO: 193984 - DNA, 36 bp, Artificial Sequence
  Synthetic oligonucleotide
gtgatcacctagctgcctttgcccaacatgtctcta

SEQ ID NO: 193985 - DNA, 36 bp, Artificial Sequence
  Synthetic oligonucleotide
gatccgtcacgaatgtgtttcccttgccttcttcta

SEQ ID NO: 193986 - DNA, 36 bp, Artificial Sequence
  Synthetic oligonucleotide
gcagccactccgcacgcctgtatacaccactttcta

SEQ ID NO: 193987 - DNA, 36 bp, Artificial Sequence
  Synthetic oligonucleotide
actcaccgcattctaccgtccctcccggggtgagta

SEQ ID NO: 193988 - DNA, 36 bp, Artificial Sequence
  Synthetic oligonucleotide
gttagggcggagggagggtgtcagggagcagaggta

SEQ ID NO: 193989 - DNA, 36 bp, Artificial Sequence
  Synthetic oligonucleotide
tttccacactcgcacttgctggtcccagtacactta

SEQ ID NO: 193990 - DNA, 35 bp, Artificial Sequence
  Synthetic oligonucleotide
tagtcggacggtgcgaggcggaggggggtacacac

SEQ ID NO: 193991 - DNA, 35 bp, Artificial Sequence
  Synthetic oligonucleotide
ttgccattagcgtccttcgcagtcttgtctcccac

SEQ ID NO: 193992 - DNA, 35 bp, Artificial Sequence
  Synthetic oligonucleotide
gagccgcgcaccagacccacttggcccttctccac

SEQ ID NO: 193993 - DNA, 35 bp, Artificial Sequence
  Synthetic oligonucleotide
tgattgcagagtccgacccgctgttcatctctcac

SEQ ID NO: 193994 - DNA, 35 bp, Artificial Sequence
  Synthetic oligonucleotide
gtgtaacgcagagtcgttctcatctttttatctac

SEQ ID NO: 193995 - DNA, 35 bp, Artificial Sequence
  Synthetic oligonucleotide
tctcctcgccgtaccctctattcgcacgcaagtac

SEQ ID NO: 193996 - DNA, 35 bp, Artificial Sequence
  Synthetic oligonucleotide
tgcgccttgtctttttgccatgctgttgtcccacc

SEQ ID NO: 193997 - DNA, 34 bp, Artificial Sequence
  Synthetic oligonucleotide
gcactgtgtcattgtaaattgtgccgcccccccc

SEQ ID NO: 193998 - DNA, 35 bp, Artificial Sequence
  Synthetic oligonucleotide
ttctcctccgactcctataagctcatcaggccccc

SEQ ID NO: 193999 - DNA, 35 bp, Artificial Sequence
  Synthetic oligonucleotide
acaccgtacgaccgctgcatctcccgcttgggccc

SEQ ID NO: 194000 - DNA, 35 bp, Artificial Sequence
  Synthetic oligonucleotide
tcgctcccctctcgaatgtctccgaccccgctccc

SEQ ID NO: 194001 - DNA, 35 bp, Artificial Sequence
  Synthetic oligonucleotide
acacagttcgcccccgtgtctctccctcatgtccc

SEQ ID NO: 194002 - DNA, 35 bp, Artificial Sequence
  Synthetic oligonucleotide
taatccagcgttcacgcctaaccacacgcgccgcc

SEQ ID NO: 194003 - DNA, 35 bp, Artificial Sequence
  Synthetic oligonucleotide
accctcgcactcgcccatcgagtattgcccctgcc

SEQ ID NO: 194004 - DNA, 35 bp, Artificial Sequence
  Synthetic oligonucleotide
gatgcgaccgccgtaatgtcagcactaatcctgcc

SEQ ID NO: 194005 - DNA, 35 bp, Artificial Sequence
  Synthetic oligonucleotide
tttgcagtacgctaccagtccggacacttgcctcc

SEQ ID NO: 194006 - DNA, 34 bp, Artificial Sequence
  Synthetic oligonucleotide
gtggtcaaacgtatgcatattccctctaccgtcc

SEQ ID NO: 194007 - DNA, 35 bp, Artificial Sequence
  Synthetic oligonucleotide
agcgacttcgccttactgtgtgctatcctctgtcc

SEQ ID NO: 194008 - DNA, 35 bp, Artificial Sequence
  Synthetic oligonucleotide
gactgccagaagaggcaggtcctcgctccacccgc

SEQ ID NO: 194009 - DNA, 31 bp, Artificial Sequence
  Synthetic oligonucleotide
gtgcctctgagcttatcaacctgtagcccgc

SEQ ID NO: 194010 - DNA, 35 bp, Artificial Sequence
  Synthetic oligonucleotide
gaatcaacgttggtcttttgtcatccccgctatgc

SEQ ID NO: 194011 - DNA, 35 bp, Artificial Sequence
  Synthetic oligonucleotide
gcgattcatcgccttactttccggacacctcttgc

SEQ ID NO: 194012 - DNA, 35 bp, Artificial Sequence
  Synthetic oligonucleotide
gaactggggcggggaaaacaagacgggggggaatc

SEQ ID NO: 194013 - DNA, 35 bp, Artificial Sequence
  Synthetic oligonucleotide
acgagcactgccaaggtctatctctgtcatcgatc

SEQ ID NO: 194014 - DNA, 35 bp, Artificial Sequence
  Synthetic oligonucleotide
gattcccgcgcccgtgcttaggcgcttgcactatc

SEQ ID NO: 194015 - DNA, 35 bp, Artificial Sequence
  Synthetic oligonucleotide
tatttctggtccgtgcctcatgctcctggttactc

SEQ ID NO: 194016 - DNA, 35 bp, Artificial Sequence
  Synthetic oligonucleotide
tccctgagtgtcccgactgcgtcttccgtaccctc

SEQ ID NO: 194017 - DNA, 35 bp, Artificial Sequence
  Synthetic oligonucleotide
gcccacgcgatatttgctacctgtgcccgcccttc

SEQ ID NO: 194018 - DNA, 35 bp, Artificial Sequence
  Synthetic oligonucleotide
tttaccatcggtcgttattgcttccctccgccttc

SEQ ID NO: 194019 - DNA, 35 bp, Artificial Sequence
  Synthetic oligonucleotide
ttgttgcagttccccctgcgcgtcaaagctccttc

SEQ ID NO: 194020 - DNA, 35 bp, Artificial Sequence
  Synthetic oligonucleotide
acactgagccgaaggtctcccactcctgaacgttc

SEQ ID NO: 194021 - DNA, 35 bp, Artificial Sequence
  Synthetic oligonucleotide
actccgtccggaccgtattgtcgtctcccctgttc

SEQ ID NO: 194022 - DNA, 35 bp, Artificial Sequence
  Synthetic oligonucleotide
tacacccacgcttagactcatccctggcatgtttc

SEQ ID NO: 194023 - DNA, 35 bp, Artificial Sequence
  Synthetic oligonucleotide
atcgccagaagctccttttcccccgccgctcggag

SEQ ID NO: 194024 - DNA, 35 bp, Artificial Sequence
  Synthetic oligonucleotide
gagagggtgggagggtactcattgctccgggggag

SEQ ID NO: 194025 - DNA, 35 bp, Artificial Sequence
  Synthetic oligonucleotide
ttgtgaggagggttcgagaggggggtgcgaaatag

SEQ ID NO: 194026 - DNA, 35 bp, Artificial Sequence
  Synthetic oligonucleotide
gagtaggagagggcgggtaaggttccgagttatag

SEQ ID NO: 194027 - DNA, 35 bp, Artificial Sequence
  Synthetic oligonucleotide
atcgctgtcagccaacattctgcacgactcctccg

SEQ ID NO: 194028 - DNA, 35 bp, Artificial Sequence
  Synthetic oligonucleotide
ggacatgcctccgcccgtctcccctggcctctccg

SEQ ID NO: 194029 - DNA, 35 bp, Artificial Sequence
  Synthetic oligonucleotide
atgcaggagggattggaggagaatgagcaggtccg

SEQ ID NO: 194030 - DNA, 35 bp, Artificial Sequence
  Synthetic oligonucleotide
accctgcttcccccactgtctctagcgctgattcg

SEQ ID NO: 194031 - DNA, 35 bp, Artificial Sequence
  Synthetic oligonucleotide
gcaatggtgaaggaagtggatctgagggtttgggg

SEQ ID NO: 194032 - DNA, 35 bp, Artificial Sequence
  Synthetic oligonucleotide
gtcccccggcgccactggcttccgcacctaacctg

SEQ ID NO: 194033 - DNA, 35 bp, Artificial Sequence
  Synthetic oligonucleotide
tgtatgccacattttgcacagtcttgctttccctg

SEQ ID NO: 194034 - DNA, 35 bp, Artificial Sequence
  Synthetic oligonucleotide
acccccatgttccagccctgtttagtctccttgtg

SEQ ID NO: 194035 - DNA, 35 bp, Artificial Sequence
  Synthetic oligonucleotide
aacccttaccgtcccgcgatacacgccgataacat

SEQ ID NO: 194036 - DNA, 35 bp, Artificial Sequence
  Synthetic oligonucleotide
gtggccccctccccccgcgagacttgtttgacgat

SEQ ID NO: 194037 - DNA, 35 bp, Artificial Sequence
  Synthetic oligonucleotide
gcactccccgctccgtatcgacccttacctccgat

SEQ ID NO: 194038 - DNA, 35 bp, Artificial Sequence
  Synthetic oligonucleotide
acacgggcggtactctgtaaatgccccttaccact

SEQ ID NO: 194039 - DNA, 35 bp, Artificial Sequence
  Synthetic oligonucleotide
ggactgcctcatccccgcatatttccgtcattact

SEQ ID NO: 194040 - DNA, 35 bp, Artificial Sequence
  Synthetic oligonucleotide
atcgcccaacgtccgttcgacccccacataaccct

SEQ ID NO: 194041 - DNA, 34 bp, Artificial Sequence
  Synthetic oligonucleotide
atccgccactccctctgcttcgtaagactaccct

SEQ ID NO: 194042 - DNA, 35 bp, Artificial Sequence
  Synthetic oligonucleotide
tgcatccctacgcattaattgactatattggccct

SEQ ID NO: 194043 - DNA, 35 bp, Artificial Sequence
  Synthetic oligonucleotide
gtagtcaacctccggctgtcaatccacactgccct

SEQ ID NO: 194044 - DNA, 35 bp, Artificial Sequence
  Synthetic oligonucleotide
gcgatctcgtcgctacttgttgacctctctacgct

SEQ ID NO: 194045 - DNA, 35 bp, Artificial Sequence
  Synthetic oligonucleotide
attgccccgccgactaataatgctcagctcctgct

SEQ ID NO: 194046 - DNA, 35 bp, Artificial Sequence
  Synthetic oligonucleotide
gctggcaatgcggggacgggtgggggggtgtatct

SEQ ID NO: 194047 - DNA, 35 bp, Artificial Sequence
  Synthetic oligonucleotide
acgtacctccaccccctggttatccagagtgctct

SEQ ID NO: 194048 - DNA, 35 bp, Artificial Sequence
  Synthetic oligonucleotide
tacgcgtccgtgtatgcgcgtccgcccccactcgt

SEQ ID NO: 194049 - DNA, 35 bp, Artificial Sequence
  Synthetic oligonucleotide
ggtgcccctcatttgcatttatccttcggtccatt

SEQ ID NO: 194050 - DNA, 35 bp, Artificial Sequence
  Synthetic oligonucleotide
acatgccggacttgtatcgattcccttgccacctt

SEQ ID NO: 194051 - DNA, 35 bp, Artificial Sequence
  Synthetic oligonucleotide
gagccccattgtatctgattccgccgtctgctctt

SEQ ID NO: 194052 - DNA, 35 bp, Artificial Sequence
  Synthetic oligonucleotide
gaatggcggtgcacctgttcctatccccttgtgtt

SEQ ID NO: 194053 - DNA, 35 bp, Artificial Sequence
  Synthetic oligonucleotide
gtcaccacgtcaccatcgcgtagaccttgcccttt

SEQ ID NO: 194054 - DNA, 35 bp, Artificial Sequence
  Synthetic oligonucleotide
gatcccgccctgcccggccatgtgcacacgttttt

SEQ ID NO: 194055 - DNA, 36 bp, Artificial Sequence
  Synthetic oligonucleotide
tcccacctccaccgcaccttagtttgtttatgcaaa

SEQ ID NO: 194056 - DNA, 36 bp, Artificial Sequence
  Synthetic oligonucleotide
gaggcgatggggggagggagcagtggaagcgaagaa

SEQ ID NO: 194057 - DNA, 36 bp, Artificial Sequence
  Synthetic oligonucleotide
ttgccacgccccttgttgctcctgcttgcttcgtaa

SEQ ID NO: 194058 - DNA, 36 bp, Artificial Sequence
  Synthetic oligonucleotide
gcgacgcgggctgcaatcagcacttagtaccaccca

SEQ ID NO: 194059 - DNA, 36 bp, Artificial Sequence
  Synthetic oligonucleotide
gccgagccgccttcaaattcactgatacccacgcca

SEQ ID NO: 194060 - DNA, 35 bp, Artificial Sequence
  Synthetic oligonucleotide
aattgcgcacgtcggttcttctccggtttccgcca

SEQ ID NO: 194061 - DNA, 35 bp, Artificial Sequence
  Synthetic oligonucleotide
tccatcccttcgattgccctctttaccgtgtgcca

SEQ ID NO: 194062 - DNA, 36 bp, Artificial Sequence
  Synthetic oligonucleotide
gattaggggagaacgaggggagcggccgagcgagca

SEQ ID NO: 194063 - DNA, 36 bp, Artificial Sequence
  Synthetic oligonucleotide
tcagacaacctccatgcactgatctacactgccgca

SEQ ID NO: 194064 - DNA, 36 bp, Artificial Sequence
  Synthetic oligonucleotide
gcctgcaccggattggctcgttccgccttactcgca

SEQ ID NO: 194065 - DNA, 36 bp, Artificial Sequence
  Synthetic oligonucleotide
gtgagcgtaaggatgcccccctgccgcccgtttgca

SEQ ID NO: 194066 - DNA, 36 bp, Artificial Sequence
  Synthetic oligonucleotide
atgggcgggagggagagttcttaaaacatggggtca

SEQ ID NO: 194067 - DNA, 35 bp, Artificial Sequence
  Synthetic oligonucleotide
gcgggacgccccataccgcgcattacttctggtca

SEQ ID NO: 194068 - DNA, 36 bp, Artificial Sequence
  Synthetic oligonucleotide
tcctgttccacctcatgtatcgctccctctatgtca

SEQ ID NO: 194069 - DNA, 35 bp, Artificial Sequence
  Synthetic oligonucleotide
gtcacgcgctgttttacctctcgttttgggcttca

SEQ ID NO: 194070 - DNA, 36 bp, Artificial Sequence
  Synthetic oligonucleotide
tgcaacgaccttgcgtatcggccccccctgcgttca

SEQ ID NO: 194071 - DNA, 35 bp, Artificial Sequence
  Synthetic oligonucleotide
acgttatctccaccatgttacctccagcggtttca

SEQ ID NO: 194072 - DNA, 37 bp, Artificial Sequence
  Synthetic oligonucleotide
aacgacccgttcgccctcctgttcctgcatttgaaga

SEQ ID NO: 194073 - DNA, 36 bp, Artificial Sequence
  Synthetic oligonucleotide
tcacccatcctcacgaattatcataccacagtaaga

SEQ ID NO: 194074 - DNA, 35 bp, Artificial Sequence
  Synthetic oligonucleotide
gtgggcgggtgggtatccagggtaggaacgataga

SEQ ID NO: 194075 - DNA, 37 bp, Artificial Sequence
  Synthetic oligonucleotide
actgaggggaggggacgtatagggtactgagggtaga

SEQ ID NO: 194076 - DNA, 35 bp, Artificial Sequence
  Synthetic oligonucleotide
tccatttgacagcccttcttttcgccgccccccga

SEQ ID NO: 194077 - DNA, 37 bp, Artificial Sequence
  Synthetic oligonucleotide
tcagggccgggggggagggtccggaactaagtcccga

SEQ ID NO: 194078 - DNA, 37 bp, Artificial Sequence
  Synthetic oligonucleotide
tgcgcgatacggggagggtaagggcggaggtgcgcga

SEQ ID NO: 194079 - DNA, 36 bp, Artificial Sequence
  Synthetic oligonucleotide
gaatgtgcgggggggtttgagggcgggaatcgtcga

SEQ ID NO: 194080 - DNA, 35 bp, Artificial Sequence
  Synthetic oligonucleotide
tgccactacggatcttacgtaccgcccttattcga

SEQ ID NO: 194081 - DNA, 37 bp, Artificial Sequence
  Synthetic oligonucleotide
gtcaagagaggggtggaatcacgagtaggaaaaagga

SEQ ID NO: 194082 - DNA, 37 bp, Artificial Sequence
  Synthetic oligonucleotide
gcaaggggggagggttaacgcgaaagggagtcaagga

SEQ ID NO: 194083 - DNA, 37 bp, Artificial Sequence
  Synthetic oligonucleotide
tactgcccagcctgataaactccccacccatcgagga

SEQ ID NO: 194084 - DNA, 37 bp, Artificial Sequence
  Synthetic oligonucleotide
tccgcacgatcgttctactcttcgcccgtcactcgga

SEQ ID NO: 194085 - DNA, 37 bp, Artificial Sequence
  Synthetic oligonucleotide
gacgcccctgactccttcatgccgttcctattcggga

SEQ ID NO: 194086 - DNA, 35 bp, Artificial Sequence
  Synthetic oligonucleotide
atggacgcgctaagggcgtctatgggaggggggga

SEQ ID NO: 194087 - DNA, 35 bp, Artificial Sequence
  Synthetic oligonucleotide
gaccgcgtgtcatacattccccccatgcctaatga

SEQ ID NO: 194088 - DNA, 37 bp, Artificial Sequence
  Synthetic oligonucleotide
actcactccgcacattttatatttatagctccactga

SEQ ID NO: 194089 - DNA, 37 bp, Artificial Sequence
  Synthetic oligonucleotide
gtccccattcgcatgttgataacctccctaaccgtga

SEQ ID NO: 194090 - DNA, 38 bp, Artificial Sequence
  Synthetic oligonucleotide
tcaccagggaaggaatgcggaagaagggcgcggcgtga

SEQ ID NO: 194091 - DNA, 37 bp, Artificial Sequence
  Synthetic oligonucleotide
gacccccgtgcctggacgatccactctctactcgtga

SEQ ID NO: 194092 - DNA, 38 bp, Artificial Sequence
  Synthetic oligonucleotide
gcacgcccaggctaacgttccatttcctccctttgtga

SEQ ID NO: 194093 - DNA, 38 bp, Artificial Sequence
  Synthetic oligonucleotide
tgctggccctgctttgtactgtcccctcgcaccattga

SEQ ID NO: 194094 - DNA, 37 bp, Artificial Sequence
  Synthetic oligonucleotide
gtgagcgcccgttttctccatccatgtcttcacttga

SEQ ID NO: 194095 - DNA, 38 bp, Artificial Sequence
  Synthetic oligonucleotide
gagcaaccgtgatgccatacctctctcctgcctgttga

SEQ ID NO: 194096 - DNA, 38 bp, Artificial Sequence
  Synthetic oligonucleotide
agcgagggggcaaagggggggtgagacgcttctgttga

SEQ ID NO: 194097 - DNA, 36 bp, Artificial Sequence
  Synthetic oligonucleotide
gagctctacaacagggcgggaaggggacttgggata

SEQ ID NO: 194098 - DNA, 36 bp, Artificial Sequence
  Synthetic oligonucleotide
gcctgtctcacactgtgctcctcctccttacgccta

SEQ ID NO: 194099 - DNA, 35 bp, Artificial Sequence
  Synthetic oligonucleotide
gtatcaccccactatttttaatgcctccgtatcta

SEQ ID NO: 194100 - DNA, 35 bp, Artificial Sequence
  Synthetic oligonucleotide
ttgaccggaacggtggtgcttccccttgccctcta

SEQ ID NO: 194101 - DNA, 36 bp, Artificial Sequence
  Synthetic oligonucleotide
tacaacccaggcgtcacacggccacacactcctcta

SEQ ID NO: 194102 - DNA, 36 bp, Artificial Sequence
  Synthetic oligonucleotide
ttggaacaccccgcctgctgcttgctccatatagta

SEQ ID NO: 194103 - DNA, 36 bp, Artificial Sequence
  Synthetic oligonucleotide
tgacgccatctttggtacatcctacccgtcctggta

SEQ ID NO: 194104 - DNA, 35 bp, Artificial Sequence
  Synthetic oligonucleotide
tgcccatgctccactacctctgccggagtctctta

SEQ ID NO: 194105 - DNA, 35 bp, Artificial Sequence
  Synthetic oligonucleotide
tagcagtgaatcgtcgttctttcgggcccttctta

SEQ ID NO: 194106 - DNA, 35 bp, Artificial Sequence
  Synthetic oligonucleotide
gtcatggcgtgaccatgacatttacttgatccaac

SEQ ID NO: 194107 - DNA, 35 bp, Artificial Sequence
  Synthetic oligonucleotide
agtggaccctcatgctaagccccctgttttctaac

SEQ ID NO: 194108 - DNA, 35 bp, Artificial Sequence
  Synthetic oligonucleotide
tgccatatcctgtatccctcttgcttgttgcacac

SEQ ID NO: 194109 - DNA, 35 bp, Artificial Sequence
  Synthetic oligonucleotide
tgccatcgtactcctacctctggcgcccctcccac

SEQ ID NO: 194110 - DNA, 35 bp, Artificial Sequence
  Synthetic oligonucleotide
tggtcatcggtctgctcgcgctctgtaacatccac

SEQ ID NO: 194111 - DNA, 35 bp, Artificial Sequence
  Synthetic oligonucleotide
atcgtgccgggccaaagttccatccttaatgctac

SEQ ID NO: 194112 - DNA, 35 bp, Artificial Sequence
  Synthetic oligonucleotide
tacccggccatcacccgccgcccgcttaacggtac

SEQ ID NO: 194113 - DNA, 35 bp, Artificial Sequence
  Synthetic oligonucleotide
gcccagatcgcgctctccagctacccgcttatacc

SEQ ID NO: 194114 - DNA, 35 bp, Artificial Sequence
  Synthetic oligonucleotide
atctgacacatatcgtgtccatgatttgccttacc

SEQ ID NO: 194115 - DNA, 35 bp, Artificial Sequence
  Synthetic oligonucleotide
acgaccttatcacagttctatcggcctggtaaccc

SEQ ID NO: 194116 - DNA, 35 bp, Artificial Sequence
  Synthetic oligonucleotide
tcattcccgtagttcgagtaaatagtcttctcccc

SEQ ID NO: 194117 - DNA, 35 bp, Artificial Sequence
  Synthetic oligonucleotide
actcaatcgcgtcttagcatttactgtacccgccc

SEQ ID NO: 194118 - DNA, 34 bp, Artificial Sequence
  Synthetic oligonucleotide
tccacgctgaatccactcgcccggacatgtgccc

SEQ ID NO: 194119 - DNA, 35 bp, Artificial Sequence
  Synthetic oligonucleotide
agccgagagcctcatcgttcttaggtttctctccc

SEQ ID NO: 194120 - DNA, 35 bp, Artificial Sequence
  Synthetic oligonucleotide
tcagaagggcgggaaatgggagcgatagtagagcc

SEQ ID NO: 194121 - DNA, 35 bp, Artificial Sequence
  Synthetic oligonucleotide
acgtctaccgcccctgcctttgttcccaccgtgcc

SEQ ID NO: 194122 - DNA, 35 bp, Artificial Sequence
  Synthetic oligonucleotide
actatcgcactgatcgcgctatctactctccctcc

SEQ ID NO: 194123 - DNA, 35 bp, Artificial Sequence
  Synthetic oligonucleotide
tcaacctccccgtccagggtgttcatattgtctcc

SEQ ID NO: 194124 - DNA, 35 bp, Artificial Sequence
  Synthetic oligonucleotide
tgttcattgcgacctgcccgccactcatagattcc

SEQ ID NO: 194125 - DNA, 35 bp, Artificial Sequence
  Synthetic oligonucleotide
tgaatcacccccgtaatatccagtactgccaatgc

SEQ ID NO: 194126 - DNA, 35 bp, Artificial Sequence
  Synthetic oligonucleotide
agcgaccgtgctacggtattctgtccatctgctgc

SEQ ID NO: 194127 - DNA, 35 bp, Artificial Sequence
  Synthetic oligonucleotide
gacgcccatcttgcttttattgttctcagctgtgc

SEQ ID NO: 194128 - DNA, 35 bp, Artificial Sequence
  Synthetic oligonucleotide
ggacactcttcagcctccttgatactatcgtttgc

SEQ ID NO: 194129 - DNA, 35 bp, Artificial Sequence
  Synthetic oligonucleotide
acgacaccctcccgcttgactcgatcctgcctatc

SEQ ID NO: 194130 - DNA, 35 bp, Artificial Sequence
  Synthetic oligonucleotide
tgccacaaccatacacagtgcaatacccttccctc

SEQ ID NO: 194131 - DNA, 35 bp, Artificial Sequence
  Synthetic oligonucleotide
gacaatcgccgtgggtgtccttttgcctgttgctc

SEQ ID NO: 194132 - DNA, 35 bp, Artificial Sequence
  Synthetic oligonucleotide
tgccgttctagtatcgatcgcggttgttccctctc

SEQ ID NO: 194133 - DNA, 35 bp, Artificial Sequence
  Synthetic oligonucleotide
tagccgtcacagtttcctgcttcataccggtagtc

SEQ ID NO: 194134 - DNA, 35 bp, Artificial Sequence
  Synthetic oligonucleotide
aacagccccagggtggtcttcacttgcccgtcgtc

SEQ ID NO: 194135 - DNA, 35 bp, Artificial Sequence
  Synthetic oligonucleotide
accgaaccaatgtacgttagcctgtcaccctggtc

SEQ ID NO: 194136 - DNA, 35 bp, Artificial Sequence
  Synthetic oligonucleotide
atacgagcaccctatcacgtgtctgcggttccttc

SEQ ID NO: 194137 - DNA, 35 bp, Artificial Sequence
  Synthetic oligonucleotide
gtggggtgttgaggaatggggccgaaaccggggag

SEQ ID NO: 194138 - DNA, 35 bp, Artificial Sequence
  Synthetic oligonucleotide
gcaccgactagcgtttctgcccgcccccttgtgag

SEQ ID NO: 194139 - DNA, 35 bp, Artificial Sequence
  Synthetic oligonucleotide
gccacttctactggacccgttcgctttctccatag

SEQ ID NO: 194140 - DNA, 35 bp, Artificial Sequence
  Synthetic oligonucleotide
tccgcacccactccccgaccgtagtaccatatacg

SEQ ID NO: 194141 - DNA, 35 bp, Artificial Sequence
  Synthetic oligonucleotide
tatacaccatctgccgtgtccaatagtcctctacg

SEQ ID NO: 194142 - DNA, 35 bp, Artificial Sequence
  Synthetic oligonucleotide
taagacaacggcttagcaccctgtttaccaccccg

SEQ ID NO: 194143 - DNA, 35 bp, Artificial Sequence
  Synthetic oligonucleotide
acattcgctccacatcctgccgttcatccactccg

SEQ ID NO: 194144 - DNA, 35 bp, Artificial Sequence
  Synthetic oligonucleotide
gatggtacggggggaaacgtagagccgagaaatcg

SEQ ID NO: 194145 - DNA, 35 bp, Artificial Sequence
  Synthetic oligonucleotide
gctccatcccggtgttatctggcgccacttgctcg

SEQ ID NO: 194146 - DNA, 35 bp, Artificial Sequence
  Synthetic oligonucleotide
ataccccgtcccgcacgtgccgactgccctgcctg

SEQ ID NO: 194147 - DNA, 35 bp, Artificial Sequence
  Synthetic oligonucleotide
ttgaacgtacacatatctatctagctgccatcctg

SEQ ID NO: 194148 - DNA, 35 bp, Artificial Sequence
  Synthetic oligonucleotide
tcgatgtctcccctggtccctattcttggtatctg

SEQ ID NO: 194149 - DNA, 35 bp, Artificial Sequence
  Synthetic oligonucleotide
gatccccccgcacctctaaccagacactgacagtg

SEQ ID NO: 194150 - DNA, 35 bp, Artificial Sequence
  Synthetic oligonucleotide
agaagcccactgcccgctttccagccaatactttg

SEQ ID NO: 194151 - DNA, 35 bp, Artificial Sequence
  Synthetic oligonucleotide
gatctacgccaacccgtggcccaccagaattacat

SEQ ID NO: 194152 - DNA, 35 bp, Artificial Sequence
  Synthetic oligonucleotide
aaccgatcccgtcctgaccctggctaacttcccat

SEQ ID NO: 194153 - DNA, 35 bp, Artificial Sequence
  Synthetic oligonucleotide
taccccttcctggccccgtctctcccgtcggaact

SEQ ID NO: 194154 - DNA, 35 bp, Artificial Sequence
  Synthetic oligonucleotide
tagacgatcacatcagcgtgtttgcgcccagcact

SEQ ID NO: 194155 - DNA, 35 bp, Artificial Sequence
  Synthetic oligonucleotide
agaacaagctcgccttggtgtctctcccccttact

SEQ ID NO: 194156 - DNA, 34 bp, Artificial Sequence
  Synthetic oligonucleotide
aaccctccgacgacatttgcgtcatcctgcccct

SEQ ID NO: 194157 - DNA, 34 bp, Artificial Sequence
  Synthetic oligonucleotide
actcgggaccgcctgtttatcgcccactcgccct

SEQ ID NO: 194158 - DNA, 35 bp, Artificial Sequence
  Synthetic oligonucleotide
tacgcaggtcgcctgtaaacttcccgtacccgcct

SEQ ID NO: 194159 - DNA, 35 bp, Artificial Sequence
  Synthetic oligonucleotide
actcacggagttgtagcataccgtacgcccatcct

SEQ ID NO: 194160 - DNA, 35 bp, Artificial Sequence
  Synthetic oligonucleotide
actcgtcgaccgacacctgtgccccccctcccgct

SEQ ID NO: 194161 - DNA, 35 bp, Artificial Sequence
  Synthetic oligonucleotide
gattcccccttacgttgctacgagccttttaggct

SEQ ID NO: 194162 - DNA, 35 bp, Artificial Sequence
  Synthetic oligonucleotide
tgccacacatcattgcactttcctccgcgctggct

SEQ ID NO: 194163 - DNA, 35 bp, Artificial Sequence
  Synthetic oligonucleotide
tccccactaagccattggtccgcggcccaattgct

SEQ ID NO: 194164 - DNA, 35 bp, Artificial Sequence
  Synthetic oligonucleotide
tgccctagcactttgtgtcctgaatgttgccctct

SEQ ID NO: 194165 - DNA, 35 bp, Artificial Sequence
  Synthetic oligonucleotide
gaagcgcgagtcgatcctgcctaagtaccctctct

SEQ ID NO: 194166 - DNA, 35 bp, Artificial Sequence
  Synthetic oligonucleotide
gtccaccgccgccttagaattgccgctacctgtct

SEQ ID NO: 194167 - DNA, 35 bp, Artificial Sequence
  Synthetic oligonucleotide
tactttgggaggggtgggtaagggtaacgaggagt

SEQ ID NO: 194168 - DNA, 35 bp, Artificial Sequence
  Synthetic oligonucleotide
gtgtgtagcctctcctcctcccattgactggtcgt

SEQ ID NO: 194169 - DNA, 35 bp, Artificial Sequence
  Synthetic oligonucleotide
gtttcgccccatgcctatttggtagcccgccatgt

SEQ ID NO: 194170 - DNA, 34 bp, Artificial Sequence
  Synthetic oligonucleotide
gttattgccccactcgtggtatacgattccctgt

SEQ ID NO: 194171 - DNA, 36 bp, Artificial Sequence
  Synthetic oligonucleotide
tgatatcgaggggcgggcggtgagggcggaacaatt

SEQ ID NO: 194172 - DNA, 35 bp, Artificial Sequence
  Synthetic oligonucleotide
ttgcaaccacgtgctcctgtctgtttcctcccatt

SEQ ID NO: 194173 - DNA, 35 bp, Artificial Sequence
  Synthetic oligonucleotide
gtgtccccccgtttcgctattttttactgcacctt

SEQ ID NO: 194174 - DNA, 35 bp, Artificial Sequence
  Synthetic oligonucleotide
tcacggaggtgatatgctctactgatttcgccctt

SEQ ID NO: 194175 - DNA, 35 bp, Artificial Sequence
  Synthetic oligonucleotide
gcaaagctgctcgccgtttcgcgcttagtttcctt

SEQ ID NO: 194176 - DNA, 35 bp, Artificial Sequence
  Synthetic oligonucleotide
ttactcgcagaggcgcgcccccccttttgccggtt

SEQ ID NO: 194177 - DNA, 35 bp, Artificial Sequence
  Synthetic oligonucleotide
gttgtcgtcgcatctaccggtaccgctatactttt

SEQ ID NO: 194178 - DNA, 35 bp, Artificial Sequence
  Synthetic oligonucleotide
atcacaccggccctttacccttagaactgatccaa

SEQ ID NO: 194179 - DNA, 36 bp, Artificial Sequence
  Synthetic oligonucleotide
gcctctcgcatctgcactgaatacgtctccttccaa

SEQ ID NO: 194180 - DNA, 35 bp, Artificial Sequence
  Synthetic oligonucleotide
tgtggtcgcggcacacgtccgtttccgtccatcaa

SEQ ID NO: 194181 - DNA, 35 bp, Artificial Sequence
  Synthetic oligonucleotide
acatccgtccacccattccgcgcgcttatcatgaa

SEQ ID NO: 194182 - DNA, 36 bp, Artificial Sequence
  Synthetic oligonucleotide
gtaaggactggggacacggtgggggggacagactaa

SEQ ID NO: 194183 - DNA, 36 bp, Artificial Sequence
  Synthetic oligonucleotide
ttgtgatccctgcgcccgcgtttttgcttgccccca

SEQ ID NO: 194184 - DNA, 36 bp, Artificial Sequence
  Synthetic oligonucleotide
tccaacccactgtctttcacacgtctcgatgcccca

SEQ ID NO: 194185 - DNA, 36 bp, Artificial Sequence
  Synthetic oligonucleotide
tcccgcggacgctcctatagtcttgtcacttccgca

SEQ ID NO: 194186 - DNA, 36 bp, Artificial Sequence
  Synthetic oligonucleotide
aacagagcattgatccatccgcccccttcgctggca

SEQ ID NO: 194187 - DNA, 35 bp, Artificial Sequence
  Synthetic oligonucleotide
gcttacccgcttgtatagtcttcatcccccgtgca

SEQ ID NO: 194188 - DNA, 37 bp, Artificial Sequence
  Synthetic oligonucleotide
gagggagaaggcgcgtatggaggttagggggcgaaga

SEQ ID NO: 194189 - DNA, 37 bp, Artificial Sequence
  Synthetic oligonucleotide
tgaggagctcagggacggagaaggaggataggcgaga

SEQ ID NO: 194190 - DNA, 38 bp, Artificial Sequence
  Synthetic oligonucleotide
gccgggggcaaaggggagaatggggggacggagggaga

SEQ ID NO: 194191 - DNA, 37 bp, Artificial Sequence
  Synthetic oligonucleotide
ttggagcgagcaatttagggggagggaagaggggaga

SEQ ID NO: 194192 - DNA, 37 bp, Artificial Sequence
  Synthetic oligonucleotide
ataccccgacgattatgccgttcccttcgccttgaga

SEQ ID NO: 194193 - DNA, 37 bp, Artificial Sequence
  Synthetic oligonucleotide
ggatcctcctccgttcgccatcactccgcttgtacga

SEQ ID NO: 194194 - DNA, 37 bp, Artificial Sequence
  Synthetic oligonucleotide
gacacgatcctttggtacttctcctgccctgttccga

SEQ ID NO: 194195 - DNA, 37 bp, Artificial Sequence
  Synthetic oligonucleotide
gctatgcacccgtgatctttgtctgccaccatctcga

SEQ ID NO: 194196 - DNA, 38 bp, Artificial Sequence
  Synthetic oligonucleotide
attcccacccgaccactctgtatcgctccttataggga

SEQ ID NO: 194197 - DNA, 37 bp, Artificial Sequence
  Synthetic oligonucleotide
gaggggcgcaggcggagtccggagggtggaggatgga

SEQ ID NO: 194198 - DNA, 37 bp, Artificial Sequence
  Synthetic oligonucleotide
gtgaaacacggtcaaatccatccttatcgcccctgga

SEQ ID NO: 194199 - DNA, 37 bp, Artificial Sequence
  Synthetic oligonucleotide
gatgcactccgccacttcgtcccctacgccctctgga

SEQ ID NO: 194200 - DNA, 35 bp, Artificial Sequence
  Synthetic oligonucleotide
gtagtgtgtagtgctgaagaaggggcggtggtgga

SEQ ID NO: 194201 - DNA, 36 bp, Artificial Sequence
  Synthetic oligonucleotide
agggagagacaggggaggttagggcgggctattgga

SEQ ID NO: 194202 - DNA, 38 bp, Artificial Sequence
  Synthetic oligonucleotide
gccacctcgctgatccccttttagtcgtacgaccatga

SEQ ID NO: 194203 - DNA, 35 bp, Artificial Sequence
  Synthetic oligonucleotide
atgttagggccccattgcgtacgtaccatccatga

SEQ ID NO: 194204 - DNA, 35 bp, Artificial Sequence
  Synthetic oligonucleotide
ttccgccttcccccgtcatgcatgtcacctcatga

SEQ ID NO: 194205 - DNA, 36 bp, Artificial Sequence
  Synthetic oligonucleotide
gtgcggtggaagtggcggggagaggggatgggatga

SEQ ID NO: 194206 - DNA, 37 bp, Artificial Sequence
  Synthetic oligonucleotide
gtcgttgtcgccaccatatctctgcccccccgtatga

SEQ ID NO: 194207 - DNA, 38 bp, Artificial Sequence
  Synthetic oligonucleotide
tgcacgatcagtgccgcaaaaagcgcccgcccccctga

SEQ ID NO: 194208 - DNA, 38 bp, Artificial Sequence
  Synthetic oligonucleotide
tgcgtggtcgctgttcgttgctcatatgttccccctga

SEQ ID NO: 194209 - DNA, 35 bp, Artificial Sequence
  Synthetic oligonucleotide
gtacgcccccgactcctgatgatttctcagcctga

SEQ ID NO: 194210 - DNA, 37 bp, Artificial Sequence
  Synthetic oligonucleotide
gaatcgcagtctgccgtatctccttccccactcctga

SEQ ID NO: 194211 - DNA, 37 bp, Artificial Sequence
  Synthetic oligonucleotide
tttgcgccctggagcgtttcttgccatcattcgctga

SEQ ID NO: 194212 - DNA, 37 bp, Artificial Sequence
  Synthetic oligonucleotide
gatccagtcaggagaggtagtgagtgcggaaaagtga

SEQ ID NO: 194213 - DNA, 38 bp, Artificial Sequence
  Synthetic oligonucleotide
gagaggagaacgagaagggaggtagcactggcccgtga

SEQ ID NO: 194214 - DNA, 37 bp, Artificial Sequence
  Synthetic oligonucleotide
atgccgggaagggatgggggctcaaagcaccgggtga

SEQ ID NO: 194215 - DNA, 38 bp, Artificial Sequence
  Synthetic oligonucleotide
aagagacgagggcgatggagacggcaggagggttgtga

SEQ ID NO: 194216 - DNA, 38 bp, Artificial Sequence
  Synthetic oligonucleotide
gccgatggacgaaaaataggggacgggaggacgattga

SEQ ID NO: 194217 - DNA, 38 bp, Artificial Sequence
  Synthetic oligonucleotide
gcaaccgcctgtccagtccgttttaccacctacgttga

SEQ ID NO: 194218 - DNA, 36 bp, Artificial Sequence
  Synthetic oligonucleotide
tccgaacacccccgccattaccgtcatgtagtacta

SEQ ID NO: 194219 - DNA, 36 bp, Artificial Sequence
  Synthetic oligonucleotide
actagcggtggtcgtccatcagcccgttttctccta

SEQ ID NO: 194220 - DNA, 36 bp, Artificial Sequence
  Synthetic oligonucleotide
agcgcccatctagaatgtcactcgccactaccgcta

SEQ ID NO: 194221 - DNA, 35 bp, Artificial Sequence
  Synthetic oligonucleotide
atgccaatctgatctgttcaccattcttccgcgta

SEQ ID NO: 194222 - DNA, 35 bp, Artificial Sequence
  Synthetic oligonucleotide
ggagtacgggcgggaagggaccgaagggattctta

SEQ ID NO: 194223 - DNA, 35 bp, Artificial Sequence
  Synthetic oligonucleotide
tacaccccatgctctgccgactctctaacgcccac

SEQ ID NO: 194224 - DNA, 35 bp, Artificial Sequence
  Synthetic oligonucleotide
tccgaccgtcgtgggaacgtgcgccttccctccac

SEQ ID NO: 194225 - DNA, 35 bp, Artificial Sequence
  Synthetic oligonucleotide
gcctcaccgtgcctaaggtcttttcacactctcac

SEQ ID NO: 194226 - DNA, 35 bp, Artificial Sequence
  Synthetic oligonucleotide
tgctacgccaactctgcacagttcctccgttctac

SEQ ID NO: 194227 - DNA, 35 bp, Artificial Sequence
  Synthetic oligonucleotide
tccacacgcctgcctggtacttatctcgcaccacc

SEQ ID NO: 194228 - DNA, 35 bp, Artificial Sequence
  Synthetic oligonucleotide
tcttcaccttctcattcgtcgcatcagtcaccacc

SEQ ID NO: 194229 - DNA, 35 bp, Artificial Sequence
  Synthetic oligonucleotide
tgcgagccgtactcactacttcccctccgtggacc

SEQ ID NO: 194230 - DNA, 35 bp, Artificial Sequence
  Synthetic oligonucleotide
tccggagccacacctgtggtcaatgccctcctacc

SEQ ID NO: 194231 - DNA, 35 bp, Artificial Sequence
  Synthetic oligonucleotide
gttcgcctaacatgcctatcactagtgctaatccc

SEQ ID NO: 194232 - DNA, 35 bp, Artificial Sequence
  Synthetic oligonucleotide
actgcctacccaaacgggtatattagctccttccc

SEQ ID NO: 194233 - DNA, 35 bp, Artificial Sequence
  Synthetic oligonucleotide
tcacactccgtctagtctcgcgctgcgaagcctcc

SEQ ID NO: 194234 - DNA, 35 bp, Artificial Sequence
  Synthetic oligonucleotide
ttggagcccgccgcttccttgtcatcctcctgtcc

SEQ ID NO: 194235 - DNA, 35 bp, Artificial Sequence
  Synthetic oligonucleotide
gccgtgcgctccaggctctcgcttcaagcatttcc

SEQ ID NO: 194236 - DNA, 36 bp, Artificial Sequence
  Synthetic oligonucleotide
gcatcccaattgtccacgtgctaccgcctcgcacgc

SEQ ID NO: 194237 - DNA, 35 bp, Artificial Sequence
  Synthetic oligonucleotide
ttcccccccctttatgtgtttttcctcgcctacgc

SEQ ID NO: 194238 - DNA, 35 bp, Artificial Sequence
  Synthetic oligonucleotide
taccacctccgattcgaccctgcggtttccctcgc

SEQ ID NO: 194239 - DNA, 35 bp, Artificial Sequence
  Synthetic oligonucleotide
ttagccgtagccgcccttagtccagtcctacgtgc

SEQ ID NO: 194240 - DNA, 35 bp, Artificial Sequence
  Synthetic oligonucleotide
gcacccacgcttgctgacaccctgaacttttgtgc

SEQ ID NO: 194241 - DNA, 35 bp, Artificial Sequence
  Synthetic oligonucleotide
gagggcgtcgatctccccttagtcttgttccttgc

SEQ ID NO: 194242 - DNA, 35 bp, Artificial Sequence
  Synthetic oligonucleotide
gcccgccccgcccgtctttcacccgttactcttgc

SEQ ID NO: 194243 - DNA, 34 bp, Artificial Sequence
  Synthetic oligonucleotide
gcatcctcggtcgttggccacaccgatttccatc

SEQ ID NO: 194244 - DNA, 35 bp, Artificial Sequence
  Synthetic oligonucleotide
gtcagaacgccaggccgtccgccccccataaactc

SEQ ID NO: 194245 - DNA, 35 bp, Artificial Sequence
  Synthetic oligonucleotide
aaccgtaagcatcactaggtctgtcatttgccctc

SEQ ID NO: 194246 - DNA, 35 bp, Artificial Sequence
  Synthetic oligonucleotide
gtcaagcgttacatggtcgcgcacactcatccctc

SEQ ID NO: 194247 - DNA, 35 bp, Artificial Sequence
  Synthetic oligonucleotide
acgcgggctcttcgtagttgctgcttgtatccctc

SEQ ID NO: 194248 - DNA, 35 bp, Artificial Sequence
  Synthetic oligonucleotide
tctcactccgcatttttgaacaggttacactcctc

SEQ ID NO: 194249 - DNA, 35 bp, Artificial Sequence
  Synthetic oligonucleotide
tgttgatattccgccacatgtgaccatcccccgtc

SEQ ID NO: 194250 - DNA, 35 bp, Artificial Sequence
  Synthetic oligonucleotide
ggacatccttccgcagcccacgcctcactgccgtc

SEQ ID NO: 194251 - DNA, 35 bp, Artificial Sequence
  Synthetic oligonucleotide
tgcgcaccaccttgggaacacccgcatcattcgtc

SEQ ID NO: 194252 - DNA, 35 bp, Artificial Sequence
  Synthetic oligonucleotide
tctcaccccccatgctattcctgtcggacagggtc

SEQ ID NO: 194253 - DNA, 35 bp, Artificial Sequence
  Synthetic oligonucleotide
acatagatgtgggaccgggcgggggggaaaatgtc

SEQ ID NO: 194254 - DNA, 35 bp, Artificial Sequence
  Synthetic oligonucleotide
gacgactactcgagccttccatcgacgcaaacttc

SEQ ID NO: 194255 - DNA, 35 bp, Artificial Sequence
  Synthetic oligonucleotide
actgtcctccgccctgatcgtccctaatcggcttc

SEQ ID NO: 194256 - DNA, 35 bp, Artificial Sequence
  Synthetic oligonucleotide
aaggagggtcagtaccgcaccgtctgctcgctttc

SEQ ID NO: 194257 - DNA, 35 bp, Artificial Sequence
  Synthetic oligonucleotide
gcagttcgccattcctgttttcctggttaattttc

SEQ ID NO: 194258 - DNA, 35 bp, Artificial Sequence
  Synthetic oligonucleotide
ttgaggcgggggaggggggcgatgaaaagcagcag

SEQ ID NO: 194259 - DNA, 35 bp, Artificial Sequence
  Synthetic oligonucleotide
gagaggacggaggtttttgcgggggtaagacgtag

SEQ ID NO: 194260 - DNA, 35 bp, Artificial Sequence
  Synthetic oligonucleotide
gatgggaaacggggggtaactgagcgtaagtgacg

SEQ ID NO: 194261 - DNA, 35 bp, Artificial Sequence
  Synthetic oligonucleotide
accacatgccagccctgatctacccgcctcacccg

SEQ ID NO: 194262 - DNA, 35 bp, Artificial Sequence
  Synthetic oligonucleotide
aacgccaacccctgcctgtagactttttatgcgcg

SEQ ID NO: 194263 - DNA, 35 bp, Artificial Sequence
  Synthetic oligonucleotide
gcccctacggtcaaccgggttattatcttctctcg

SEQ ID NO: 194264 - DNA, 35 bp, Artificial Sequence
  Synthetic oligonucleotide
gcccatgtcacattgcatcttccctctctgtctcg

SEQ ID NO: 194265 - DNA, 35 bp, Artificial Sequence
  Synthetic oligonucleotide
ttacggacaccatgctctactccccccaccgacgg

SEQ ID NO: 194266 - DNA, 35 bp, Artificial Sequence
  Synthetic oligonucleotide
gcgctagcatcaacgctctaggctcccccatccgg

SEQ ID NO: 194267 - DNA, 35 bp, Artificial Sequence
  Synthetic oligonucleotide
ggagagacccggtggctaaagaggggaaaggaggg

SEQ ID NO: 194268 - DNA, 35 bp, Artificial Sequence
  Synthetic oligonucleotide
agtgttgtcgggaatgggagggagcaaggatcggg

SEQ ID NO: 194269 - DNA, 35 bp, Artificial Sequence
  Synthetic oligonucleotide
tctatccaccggaaaatgtttcgtatccttccctg

SEQ ID NO: 194270 - DNA, 35 bp, Artificial Sequence
  Synthetic oligonucleotide
acttgccgcccggatgcgccaatctcgccctcctg

SEQ ID NO: 194271 - DNA, 35 bp, Artificial Sequence
  Synthetic oligonucleotide
ttgacgccatcagttcctatccgcctctccgggtg

SEQ ID NO: 194272 - DNA, 35 bp, Artificial Sequence
  Synthetic oligonucleotide
gagagggtgggggtgataggttccaggggcgattg

SEQ ID NO: 194273 - DNA, 35 bp, Artificial Sequence
  Synthetic oligonucleotide
acgactcttgacgtgcacctgttccccgatttcat

SEQ ID NO: 194274 - DNA, 35 bp, Artificial Sequence
  Synthetic oligonucleotide
ttggggtgcaaaaatagggaagaagggtccgtgat

SEQ ID NO: 194275 - DNA, 35 bp, Artificial Sequence
  Synthetic oligonucleotide
gtactatcacgccctgggagcttctaagcttacct

SEQ ID NO: 194276 - DNA, 35 bp, Artificial Sequence
  Synthetic oligonucleotide
ttgacctaagcctggacctccccttgtcgagccct

SEQ ID NO: 194277 - DNA, 35 bp, Artificial Sequence
  Synthetic oligonucleotide
actaccgcctgtcttaccgtcttcccttgggatct

SEQ ID NO: 194278 - DNA, 35 bp, Artificial Sequence
  Synthetic oligonucleotide
acgactccatccatagtttccaggaaaggtcctct

SEQ ID NO: 194279 - DNA, 35 bp, Artificial Sequence
  Synthetic oligonucleotide
agttaggtgccccgacgtgcttcatcctgctctct

SEQ ID NO: 194280 - DNA, 35 bp, Artificial Sequence
  Synthetic oligonucleotide
tcaccctccccactgtcgcgcccgtccctgcgagt

SEQ ID NO: 194281 - DNA, 35 bp, Artificial Sequence
  Synthetic oligonucleotide
tgcccgcatggtttctgcgcttatagttccccggt

SEQ ID NO: 194282 - DNA, 35 bp, Artificial Sequence
  Synthetic oligonucleotide
acccgcctaccgccacaccgcgttttcttctcatt

SEQ ID NO: 194283 - DNA, 35 bp, Artificial Sequence
  Synthetic oligonucleotide
gatgaacggcagacttgatcactcccgccttcatt

SEQ ID NO: 194284 - DNA, 35 bp, Artificial Sequence
  Synthetic oligonucleotide
gtcaggcccaatgccgggttctacttatctacctt

SEQ ID NO: 194285 - DNA, 35 bp, Artificial Sequence
  Synthetic oligonucleotide
accgccctcaccaacataggctttaattgtcgctt

SEQ ID NO: 194286 - DNA, 36 bp, Artificial Sequence
  Synthetic oligonucleotide
gatcccaccacctctatggccccactttcgtagaaa

SEQ ID NO: 194287 - DNA, 36 bp, Artificial Sequence
  Synthetic oligonucleotide
gttcgtagcccccattcaattagccacccttgtaaa

SEQ ID NO: 194288 - DNA, 36 bp, Artificial Sequence
  Synthetic oligonucleotide
aagaggatagagcgggaggtcgagaacgcaggtcaa

SEQ ID NO: 194289 - DNA, 36 bp, Artificial Sequence
  Synthetic oligonucleotide
gacgggggggccgtcggggtgggagagaattgtcaa

SEQ ID NO: 194290 - DNA, 36 bp, Artificial Sequence
  Synthetic oligonucleotide
acgtgtccaagggggggatagggtgagagtggcgaa

SEQ ID NO: 194291 - DNA, 35 bp, Artificial Sequence
  Synthetic oligonucleotide
ttacgtacaccattgccgtccacagtctcttcgaa

SEQ ID NO: 194292 - DNA, 36 bp, Artificial Sequence
  Synthetic oligonucleotide
gaaacgcagggagggggactggcgcggtaaacgtaa

SEQ ID NO: 194293 - DNA, 35 bp, Artificial Sequence
  Synthetic oligonucleotide
gtctacccccccgttgtgatctggtcccctattaa

SEQ ID NO: 194294 - DNA, 35 bp, Artificial Sequence
  Synthetic oligonucleotide
ggagaacgggaaagttacaaggaggagggggcaca

SEQ ID NO: 194295 - DNA, 35 bp, Artificial Sequence
  Synthetic oligonucleotide
actcccctcctccgtgttcttccacgctgtgcaca

SEQ ID NO: 194296 - DNA, 33 bp, Artificial Sequence
  Synthetic oligonucleotide
tgatgtacgccccgctgtctctttcaccataca

SEQ ID NO: 194297 - DNA, 36 bp, Artificial Sequence
  Synthetic oligonucleotide
attcaaccgccatccgactcgccatcctgtgcacca

SEQ ID NO: 194298 - DNA, 36 bp, Artificial Sequence
  Synthetic oligonucleotide
gtgtcaccttcatcttgtttttcgccgtccggacca

SEQ ID NO: 194299 - DNA, 35 bp, Artificial Sequence
  Synthetic oligonucleotide
atgggggggagaatgtggaaggggctaggggacca

SEQ ID NO: 194300 - DNA, 35 bp, Artificial Sequence
  Synthetic oligonucleotide
accctcagaccactcttgacgtctaccacatccca

SEQ ID NO: 194301 - DNA, 36 bp, Artificial Sequence
  Synthetic oligonucleotide
gcgaagctttcccctgctacatggttccttgtccca

SEQ ID NO: 194302 - DNA, 35 bp, Artificial Sequence
  Synthetic oligonucleotide
gatccgcctgactgctactatcttactctccagca

SEQ ID NO: 194303 - DNA, 35 bp, Artificial Sequence
  Synthetic oligonucleotide
gcgcgagcaaagaagggaaggatcgtaggggagca

SEQ ID NO: 194304 - DNA, 35 bp, Artificial Sequence
  Synthetic oligonucleotide
gagggggagggaggacatggcattaggaaagggca

SEQ ID NO: 194305 - DNA, 35 bp, Artificial Sequence
  Synthetic oligonucleotide
tatctccgcctcgaatccaccagacaccgattgca

SEQ ID NO: 194306 - DNA, 36 bp, Artificial Sequence
  Synthetic oligonucleotide
tctgtgccctcatagtttttcgatcctttcccatca

SEQ ID NO: 194307 - DNA, 36 bp, Artificial Sequence
  Synthetic oligonucleotide
acgctcgccctccactgttacatgaccaccgcctca

SEQ ID NO: 194308 - DNA, 35 bp, Artificial Sequence
  Synthetic oligonucleotide
tgccgagggaggcgggggctaaaacaggaaaaaga

SEQ ID NO: 194309 - DNA, 35 bp, Artificial Sequence
  Synthetic oligonucleotide
ttgcacctcacctctccgtaagtttctgttctaga

SEQ ID NO: 194310 - DNA, 35 bp, Artificial Sequence
  Synthetic oligonucleotide
tcccccccccataatgtactgtggctctcctccga

SEQ ID NO: 194311 - DNA, 37 bp, Artificial Sequence
  Synthetic oligonucleotide
tgtcgcccgtgctacaatttgcttccctccgttccga

SEQ ID NO: 194312 - DNA, 37 bp, Artificial Sequence
  Synthetic oligonucleotide
aggtggggaggggatggggaggacttcaatctagcga

SEQ ID NO: 194313 - DNA, 37 bp, Artificial Sequence
  Synthetic oligonucleotide
taggggggaggcctgaagaaggaagaggtaagcgcga

SEQ ID NO: 194314 - DNA, 37 bp, Artificial Sequence
  Synthetic oligonucleotide
gaccaggcacggacaagggaaggaggcacacaggcga

SEQ ID NO: 194315 - DNA, 36 bp, Artificial Sequence
  Synthetic oligonucleotide
tcactccatcgcccatctccatctgccacacgtcga

SEQ ID NO: 194316 - DNA, 37 bp, Artificial Sequence
  Synthetic oligonucleotide
atcgcgcatggactcttccccctcgccctgacttcga

SEQ ID NO: 194317 - DNA, 37 bp, Artificial Sequence
  Synthetic oligonucleotide
agtagacagagcaggggggatgaggcggctggttcga

SEQ ID NO: 194318 - DNA, 37 bp, Artificial Sequence
  Synthetic oligonucleotide
gggtgcgaacaagggaggcgggtaatgggtcaacgga

SEQ ID NO: 194319 - DNA, 35 bp, Artificial Sequence
  Synthetic oligonucleotide
ttgaatggctaggggggaggggactaggggtcgga

SEQ ID NO: 194320 - DNA, 37 bp, Artificial Sequence
  Synthetic oligonucleotide
aacgaagggagaagggagtggtggatcaccgcaggga

SEQ ID NO: 194321 - DNA, 37 bp, Artificial Sequence
  Synthetic oligonucleotide
acccggaggggacagtatggggacggtagattaggga

SEQ ID NO: 194322 - DNA, 36 bp, Artificial Sequence
  Synthetic oligonucleotide
gaacgcaaccgcaacaaggggaagtacggaagggga

SEQ ID NO: 194323 - DNA, 37 bp, Artificial Sequence
  Synthetic oligonucleotide
atgcggagcagaggagagaagttgcgcgcagatggga

SEQ ID NO: 194324 - DNA, 35 bp, Artificial Sequence
  Synthetic oligonucleotide
tcaccacctcaataccactgtctgcacaccctgga

SEQ ID NO: 194325 - DNA, 37 bp, Artificial Sequence
  Synthetic oligonucleotide
acgcaaccgtcgacctccgccactctctatatttgga

SEQ ID NO: 194326 - DNA, 35 bp, Artificial Sequence
  Synthetic oligonucleotide
gccctcccgctatgcttttacactgctatcaatga

SEQ ID NO: 194327 - DNA, 38 bp, Artificial Sequence
  Synthetic oligonucleotide
atggacaactgcagtgtgtcgccccgcccctcgaatga

SEQ ID NO: 194328 - DNA, 38 bp, Artificial Sequence
  Synthetic oligonucleotide
gacaccaccctctgtacgtacactgactttttccatga

SEQ ID NO: 194329 - DNA, 38 bp, Artificial Sequence
  Synthetic oligonucleotide
tgccaccatcatacgcgaacccttccgacagtacctga

SEQ ID NO: 194330 - DNA, 37 bp, Artificial Sequence
  Synthetic oligonucleotide
tgaccctcgttccttgataatggcccctccatcctga

SEQ ID NO: 194331 - DNA, 37 bp, Artificial Sequence
  Synthetic oligonucleotide
ggagcaacaggtcatctctcgacccccgccttcctga

SEQ ID NO: 194332 - DNA, 38 bp, Artificial Sequence
  Synthetic oligonucleotide
gccacactgctgcccgtatctttatcacctctacgtga

SEQ ID NO: 194333 - DNA, 38 bp, Artificial Sequence
  Synthetic oligonucleotide
gacaggggaaggagggctagtagcattcaacgtggtga

SEQ ID NO: 194334 - DNA, 38 bp, Artificial Sequence
  Synthetic oligonucleotide
ttggggtgtccgccctgcattctacgccttgaccttga

SEQ ID NO: 194335 - DNA, 38 bp, Artificial Sequence
  Synthetic oligonucleotide
gtgcccgcactatcttatcattgtccgctcctgcttga

SEQ ID NO: 194336 - DNA, 37 bp, Artificial Sequence
  Synthetic oligonucleotide
tgacgcccgatcccattgacttgctcccgtttcttga

SEQ ID NO: 194337 - DNA, 38 bp, Artificial Sequence
  Synthetic oligonucleotide
gcctccgccccgttttacagttccgcatctacagttga

SEQ ID NO: 194338 - DNA, 38 bp, Artificial Sequence
  Synthetic oligonucleotide
tagctacgcccatccgccttcctctacgcttgcgttga

SEQ ID NO: 194339 - DNA, 38 bp, Artificial Sequence
  Synthetic oligonucleotide
tgtgtgcactatcagcttgccttacttccctctgttga

SEQ ID NO: 194340 - DNA, 37 bp, Artificial Sequence
  Synthetic oligonucleotide
gccctctcaaagcgtctgcgcgccccatccttgttga

SEQ ID NO: 194341 - DNA, 36 bp, Artificial Sequence
  Synthetic oligonucleotide
gtcatcctcgacctgtcttcctccgggatccacata

SEQ ID NO: 194342 - DNA, 36 bp, Artificial Sequence
  Synthetic oligonucleotide
tatgcactatcgtcccccgttcactatctgcacata

SEQ ID NO: 194343 - DNA, 35 bp, Artificial Sequence
  Synthetic oligonucleotide
accaatcccgctccctgccccgtttcacggtgata

SEQ ID NO: 194344 - DNA, 35 bp, Artificial Sequence
  Synthetic oligonucleotide
tgtcgaccctgagccgccttactcgccgttctata

SEQ ID NO: 194345 - DNA, 36 bp, Artificial Sequence
  Synthetic oligonucleotide
attcccacccgtgactctgcttcatcgagacagcta

SEQ ID NO: 194346 - DNA, 35 bp, Artificial Sequence
  Synthetic oligonucleotide
aagaggggggtgggaaggcgagacaccaggcggta

SEQ ID NO: 194347 - DNA, 36 bp, Artificial Sequence
  Synthetic oligonucleotide
gtctgccaccccccgtgcgcatcagtgccgcctgta

SEQ ID NO: 194348 - DNA, 36 bp, Artificial Sequence
  Synthetic oligonucleotide
accccccgcaagctgagtgaaacgaaattgccctta

SEQ ID NO: 194349 - DNA, 36 bp, Artificial Sequence
  Synthetic oligonucleotide
tcgcaacccgatgcctcctcttacacatgggtctta

SEQ ID NO: 194350 - DNA, 35 bp, Artificial Sequence
  Synthetic oligonucleotide
tcattcacgcttctcattttcacaagtccagccac

SEQ ID NO: 194351 - DNA, 35 bp, Artificial Sequence
  Synthetic oligonucleotide
acccatgcagccacctcgtgtcaccttcctgccac

SEQ ID NO: 194352 - DNA, 35 bp, Artificial Sequence
  Synthetic oligonucleotide
tccatcctccgccagttacacccgtgcgtttccac

SEQ ID NO: 194353 - DNA, 35 bp, Artificial Sequence
  Synthetic oligonucleotide
gccttgcccaactgtattctccgatagctacgcac

SEQ ID NO: 194354 - DNA, 35 bp, Artificial Sequence
  Synthetic oligonucleotide
aacccagccgtagccctccccgtatcgaccgggac

SEQ ID NO: 194355 - DNA, 35 bp, Artificial Sequence
  Synthetic oligonucleotide
tacccctccgatcgctcgcccttgatccggcatac

SEQ ID NO: 194356 - DNA, 35 bp, Artificial Sequence
  Synthetic oligonucleotide
ggaccccaccattgttcatccgctcatatctttac

SEQ ID NO: 194357 - DNA, 35 bp, Artificial Sequence
  Synthetic oligonucleotide
gacttgccccctgcctctctatgctgccggtttac

SEQ ID NO: 194358 - DNA, 35 bp, Artificial Sequence
  Synthetic oligonucleotide
tgccagacgaaatcgattctccactgccttacacc

SEQ ID NO: 194359 - DNA, 35 bp, Artificial Sequence
  Synthetic oligonucleotide
tgagtccgtacactcgtcgtcaacaacacgctccc

SEQ ID NO: 194360 - DNA, 35 bp, Artificial Sequence
  Synthetic oligonucleotide
ttcagctcatggtccgtccagtaattctcctcgcc

SEQ ID NO: 194361 - DNA, 35 bp, Artificial Sequence
  Synthetic oligonucleotide
gctacaacttcggtacgtgatccatctagccctcc

SEQ ID NO: 194362 - DNA, 35 bp, Artificial Sequence
  Synthetic oligonucleotide
acccggaacgtctagcgcttctaggttctatctcc

SEQ ID NO: 194363 - DNA, 35 bp, Artificial Sequence
  Synthetic oligonucleotide
gccaaacgccctgacgttttttcactccttggtcc

SEQ ID NO: 194364 - DNA, 35 bp, Artificial Sequence
  Synthetic oligonucleotide
tgtacggtgatatggcgtacaactatctttattcc

SEQ ID NO: 194365 - DNA, 35 bp, Artificial Sequence
  Synthetic oligonucleotide
accgcatccgcgtataccgtggctgcctaacttcc

SEQ ID NO: 194366 - DNA, 35 bp, Artificial Sequence
  Synthetic oligonucleotide
acgccgaccaaagcatgatgtgaggtccgccttcc

SEQ ID NO: 194367 - DNA, 35 bp, Artificial Sequence
  Synthetic oligonucleotide
acgctgccaccgcttgaaatcgcctggatccttcc

SEQ ID NO: 194368 - DNA, 34 bp, Artificial Sequence
  Synthetic oligonucleotide
gaaccccccccctctttctgcctgccgctatagc

SEQ ID NO: 194369 - DNA, 36 bp, Artificial Sequence
  Synthetic oligonucleotide
gagggtgggtgaacaggggggtacacgtctgagggc

SEQ ID NO: 194370 - DNA, 35 bp, Artificial Sequence
  Synthetic oligonucleotide
tccggtgcgtgcttcttctacactgctcccatggc

SEQ ID NO: 194371 - DNA, 35 bp, Artificial Sequence
  Synthetic oligonucleotide
atcctacgcccacggtttgattactccctactggc

SEQ ID NO: 194372 - DNA, 35 bp, Artificial Sequence
  Synthetic oligonucleotide
gccccccgtttgcctgtcgtctctttcggtcctgc

SEQ ID NO: 194373 - DNA, 35 bp, Artificial Sequence
  Synthetic oligonucleotide
ttgcctcccgacccatctgcctcattgaacagtgc

SEQ ID NO: 194374 - DNA, 35 bp, Artificial Sequence
  Synthetic oligonucleotide
tgaaccggaccgtgtgggccgttcctccctgttgc

SEQ ID NO: 194375 - DNA, 35 bp, Artificial Sequence
  Synthetic oligonucleotide
gttgacctctaggggtaatttagtccctctccatc

SEQ ID NO: 194376 - DNA, 35 bp, Artificial Sequence
  Synthetic oligonucleotide
aaaccgtacctgaacacgccgcattccatccgatc

SEQ ID NO: 194377 - DNA, 35 bp, Artificial Sequence
  Synthetic oligonucleotide
tcacacctgagaggaccgttgcttcattacacctc

SEQ ID NO: 194378 - DNA, 35 bp, Artificial Sequence
  Synthetic oligonucleotide
gggagtcgcaatgaccgaagtccggcacccccctc

SEQ ID NO: 194379 - DNA, 35 bp, Artificial Sequence
  Synthetic oligonucleotide
gccatcggccgctaccatactcccaggttcgcctc

SEQ ID NO: 194380 - DNA, 35 bp, Artificial Sequence
  Synthetic oligonucleotide
gatggagcctttgttccttagtgtccgctatcctc

SEQ ID NO: 194381 - DNA, 35 bp, Artificial Sequence
  Synthetic oligonucleotide
gccacactcctctgccgtactcatccttcacgctc

SEQ ID NO: 194382 - DNA, 35 bp, Artificial Sequence
  Synthetic oligonucleotide
gtatccgctccacagcctctatcaggaccgtgctc

SEQ ID NO: 194383 - DNA, 35 bp, Artificial Sequence
  Synthetic oligonucleotide
ggtgtcgccttctctcttatgcgtccgggattctc

SEQ ID NO: 194384 - DNA, 36 bp, Artificial Sequence
  Synthetic oligonucleotide
tacgcccgagttcagctcgtttaccatccttccgtc

SEQ ID NO: 194385 - DNA, 35 bp, Artificial Sequence
  Synthetic oligonucleotide
gatggtccgtcaatccctcccgtgacactcctgtc

SEQ ID NO: 194386 - DNA, 35 bp, Artificial Sequence
  Synthetic oligonucleotide
accccccctcgcccgctagttgacacttttgtgtc

SEQ ID NO: 194387 - DNA, 35 bp, Artificial Sequence
  Synthetic oligonucleotide
gcccggtggtagggggtaggagataaagttgacag

SEQ ID NO: 194388 - DNA, 35 bp, Artificial Sequence
  Synthetic oligonucleotide
agttggtgtgagggcgtaagaggggaagtcgccag

SEQ ID NO: 194389 - DNA, 35 bp, Artificial Sequence
  Synthetic oligonucleotide
gacgactaggtgaggcgagggagtggagatatcag

SEQ ID NO: 194390 - DNA, 35 bp, Artificial Sequence
  Synthetic oligonucleotide
aaaggatgggggacggtgtcggaaagttagtggag

SEQ ID NO: 194391 - DNA, 35 bp, Artificial Sequence
  Synthetic oligonucleotide
attcactgcgcctcgattgtgactttcccctcccg

SEQ ID NO: 194392 - DNA, 35 bp, Artificial Sequence
  Synthetic oligonucleotide
tcgccaaccgaccttcctttcatcgcctttgctcg

SEQ ID NO: 194393 - DNA, 35 bp, Artificial Sequence
  Synthetic oligonucleotide
aaaatgaggggtgcaggacgggggtgcttggaagg

SEQ ID NO: 194394 - DNA, 35 bp, Artificial Sequence
  Synthetic oligonucleotide
atcggagggaggcgcaggcaggggcatggttgggg

SEQ ID NO: 194395 - DNA, 35 bp, Artificial Sequence
  Synthetic oligonucleotide
gtcgcccccgttcaagcggatatattccttcctgg

SEQ ID NO: 194396 - DNA, 35 bp, Artificial Sequence
  Synthetic oligonucleotide
atcgtgccccacatctgaactagtgctctccgtgg

SEQ ID NO: 194397 - DNA, 35 bp, Artificial Sequence
  Synthetic oligonucleotide
ggtgagtgtgcgggaggggggatgaaaaggtcatg

SEQ ID NO: 194398 - DNA, 35 bp, Artificial Sequence
  Synthetic oligonucleotide
acctccagcccctcatagtcgtaacgtacccactg

SEQ ID NO: 194399 - DNA, 35 bp, Artificial Sequence
  Synthetic oligonucleotide
tgctctgtgcaccatgtaatacactccatcttgtg

SEQ ID NO: 194400 - DNA, 35 bp, Artificial Sequence
  Synthetic oligonucleotide
tcacgactcccgctgcctccgccatcatgatcttg

SEQ ID NO: 194401 - DNA, 35 bp, Artificial Sequence
  Synthetic oligonucleotide
acacaccacctaacatgttcgctgttccgctcttg

SEQ ID NO: 194402 - DNA, 35 bp, Artificial Sequence
  Synthetic oligonucleotide
gtcatcccgccctgtcttcattcatacgcccgttg

SEQ ID NO: 194403 - DNA, 35 bp, Artificial Sequence
  Synthetic oligonucleotide
tatcaccgtgaccctctgtttttgcatttctcaat

SEQ ID NO: 194404 - DNA, 35 bp, Artificial Sequence
  Synthetic oligonucleotide
taagcatcacgtcttcgtctgtccactatcaccat

SEQ ID NO: 194405 - DNA, 35 bp, Artificial Sequence
  Synthetic oligonucleotide
tgcagagatcctatgtcgtctggcccttcctccat

SEQ ID NO: 194406 - DNA, 35 bp, Artificial Sequence
  Synthetic oligonucleotide
gtgggacaatcgggcgaggggggtacagagggtat

SEQ ID NO: 194407 - DNA, 35 bp, Artificial Sequence
  Synthetic oligonucleotide
ttagcgcgaggagggggagatcatgcaggtggtat

SEQ ID NO: 194408 - DNA, 35 bp, Artificial Sequence
  Synthetic oligonucleotide
gatcacgtacagagcccgctgacccctcatacact

SEQ ID NO: 194409 - DNA, 33 bp, Artificial Sequence
  Synthetic oligonucleotide
tgacgcccccccgtatgctcatcaccttcgact

SEQ ID NO: 194410 - DNA, 35 bp, Artificial Sequence
  Synthetic oligonucleotide
tacctgcatccggacgttctttgaatctctaccct

SEQ ID NO: 194411 - DNA, 35 bp, Artificial Sequence
  Synthetic oligonucleotide
agacacctcgcgattttacccaagctctgttccct

SEQ ID NO: 194412 - DNA, 35 bp, Artificial Sequence
  Synthetic oligonucleotide
tcaccaccctgcctgtttgtgtagccacccagcct

SEQ ID NO: 194413 - DNA, 35 bp, Artificial Sequence
  Synthetic oligonucleotide
agaccggaccattacgttaaggcccaccttgtcct

SEQ ID NO: 194414 - DNA, 35 bp, Artificial Sequence
  Synthetic oligonucleotide
gtcgcagtcccaacctgtccacgcaattccgcgct

SEQ ID NO: 194415 - DNA, 35 bp, Artificial Sequence
  Synthetic oligonucleotide
tctcgggagcctacgtagtctcatacccagcctct

SEQ ID NO: 194416 - DNA, 35 bp, Artificial Sequence
  Synthetic oligonucleotide
tcacatatcgcgatatctgtcttcccgggatctct

SEQ ID NO: 194417 - DNA, 35 bp, Artificial Sequence
  Synthetic oligonucleotide
tcgtgcccacctgcaaaggttccagtagcctctct

SEQ ID NO: 194418 - DNA, 35 bp, Artificial Sequence
  Synthetic oligonucleotide
aaacacgcgcgatgattcccttcacctctctctct

SEQ ID NO: 194419 - DNA, 35 bp, Artificial Sequence
  Synthetic oligonucleotide
ttgcccccgtgtcccgtcctagaacggtcttgtct

SEQ ID NO: 194420 - DNA, 35 bp, Artificial Sequence
  Synthetic oligonucleotide
tcgtaccacgccgacggtcttagcctaactgttct

SEQ ID NO: 194421 - DNA, 35 bp, Artificial Sequence
  Synthetic oligonucleotide
atatgccacctcgccgttacgttgttttttgttct

SEQ ID NO: 194422 - DNA, 35 bp, Artificial Sequence
  Synthetic oligonucleotide
gcaccctccccactgtcgcgcccgtccctgctagt

SEQ ID NO: 194423 - DNA, 35 bp, Artificial Sequence
  Synthetic oligonucleotide
ggtgctttccggctcgttgacaccacaccttccgt

SEQ ID NO: 194424 - DNA, 35 bp, Artificial Sequence
  Synthetic oligonucleotide
agtgccagccaacaggaatcgggcggtgggggggt

SEQ ID NO: 194425 - DNA, 35 bp, Artificial Sequence
  Synthetic oligonucleotide
tgaccctccgcccttacgtactttcgaatgcttgt

SEQ ID NO: 194426 - DNA, 35 bp, Artificial Sequence
  Synthetic oligonucleotide
aactcagccccctcgccccgtccccttggagactt

SEQ ID NO: 194427 - DNA, 35 bp, Artificial Sequence
  Synthetic oligonucleotide
gccgtgccccatcgtttattgtcgtaccctttctt

SEQ ID NO: 194428 - DNA, 35 bp, Artificial Sequence
  Synthetic oligonucleotide
aactgccaacgatccagtcgttctcccctgtggtt

SEQ ID NO: 194429 - DNA, 35 bp, Artificial Sequence
  Synthetic oligonucleotide
gagcatgaagaagtgtcttcccgtgttacctgttt

SEQ ID NO: 194430 - DNA, 35 bp, Artificial Sequence
  Synthetic oligonucleotide
tacgcaaaccagctcgttacttccccgggcctttt

SEQ ID NO: 194431 - DNA, 36 bp, Artificial Sequence
  Synthetic oligonucleotide
tttacacctccatctacttctcagacagtacaaaaa

SEQ ID NO: 194432 - DNA, 36 bp, Artificial Sequence
  Synthetic oligonucleotide
actgcccccttgccgcttattgctgaccagaccaaa

SEQ ID NO: 194433 - DNA, 35 bp, Artificial Sequence
  Synthetic oligonucleotide
agtgcggggggagcgaaacggatagaggatgacaa

SEQ ID NO: 194434 - DNA, 36 bp, Artificial Sequence
  Synthetic oligonucleotide
tcccacctgtattgctacttatggcgaccttaccaa

SEQ ID NO: 194435 - DNA, 36 bp, Artificial Sequence
  Synthetic oligonucleotide
attcgagtacaagtgaggagagtggaggaggggcaa

SEQ ID NO: 194436 - DNA, 36 bp, Artificial Sequence
  Synthetic oligonucleotide
acaccgaccccgttcacctgactttagcgacttcaa

SEQ ID NO: 194437 - DNA, 35 bp, Artificial Sequence
  Synthetic oligonucleotide
tctggacccggcacattctcctcttgctatcggaa

SEQ ID NO: 194438 - DNA, 35 bp, Artificial Sequence
  Synthetic oligonucleotide
tgacaagggaaaggggtcggaaaagcaaacttgaa

SEQ ID NO: 194439 - DNA, 35 bp, Artificial Sequence
  Synthetic oligonucleotide
gtgggctgggacgggttcgggagtagtagcttgaa

SEQ ID NO: 194440 - DNA, 36 bp, Artificial Sequence
  Synthetic oligonucleotide
acacctgcgccctcatccttaggtgctcctgttgaa

SEQ ID NO: 194441 - DNA, 36 bp, Artificial Sequence
  Synthetic oligonucleotide
tgacaatgcggctcgcacctgcccaatcctgctaca

SEQ ID NO: 194442 - DNA, 35 bp, Artificial Sequence
  Synthetic oligonucleotide
gtcagggcgggagggcaatcatggaggatcgtaca

SEQ ID NO: 194443 - DNA, 36 bp, Artificial Sequence
  Synthetic oligonucleotide
gtccgaactcaagcggggccttccacacatcttaca

SEQ ID NO: 194444 - DNA, 36 bp, Artificial Sequence
  Synthetic oligonucleotide
tcatccagcctgtaatgcctgtcgacctgcacacca

SEQ ID NO: 194445 - DNA, 36 bp, Artificial Sequence
  Synthetic oligonucleotide
tcagcatgtgccctccgtatacgcacccacttccca

SEQ ID NO: 194446 - DNA, 35 bp, Artificial Sequence
  Synthetic oligonucleotide
tcgatatgcctcactctctcgcgtcctgcacgcca

SEQ ID NO: 194447 - DNA, 36 bp, Artificial Sequence
  Synthetic oligonucleotide
gccgtaacccctatgccctcgcgccggtgcttagca

SEQ ID NO: 194448 - DNA, 36 bp, Artificial Sequence
  Synthetic oligonucleotide
tccactcccgcgcaccttctaagcatttgacatgca

SEQ ID NO: 194449 - DNA, 35 bp, Artificial Sequence
  Synthetic oligonucleotide
gtaccgccaatgtccgtaatccacactctccatca

SEQ ID NO: 194450 - DNA, 35 bp, Artificial Sequence
  Synthetic oligonucleotide
atgccacccccttcgtttggcattgagattcatca

SEQ ID NO: 194451 - DNA, 36 bp, Artificial Sequence
  Synthetic oligonucleotide
accccctccagaccgttccttgtgcctgtcaactca

SEQ ID NO: 194452 - DNA, 35 bp, Artificial Sequence
  Synthetic oligonucleotide
ttgacgaagtccgccctccagcccgtgccacctca

SEQ ID NO: 194453 - DNA, 36 bp, Artificial Sequence
  Synthetic oligonucleotide
tgggagtcgtcaaatgcaccaccgctccacccgtca

SEQ ID NO: 194454 - DNA, 36 bp, Artificial Sequence
  Synthetic oligonucleotide
gaaaggaagagcggggggggtggaactgtgtggtca

SEQ ID NO: 194455 - DNA, 35 bp, Artificial Sequence
  Synthetic oligonucleotide
aaccacagttcgcttggggctactcacctctttca

SEQ ID NO: 194456 - DNA, 35 bp, Artificial Sequence
  Synthetic oligonucleotide
tgcaccagcccctccttactgcgttacccgtttca

SEQ ID NO: 194457 - DNA, 37 bp, Artificial Sequence
  Synthetic oligonucleotide
tcctcaccatcactctgcgttgcaacggactccaaga

SEQ ID NO: 194458 - DNA, 35 bp, Artificial Sequence
  Synthetic oligonucleotide
aagccgtaacgagagggcaaggggaggttggaaga

SEQ ID NO: 194459 - DNA, 36 bp, Artificial Sequence
  Synthetic oligonucleotide
tccaacttcctcaccctgtttagtcgcctcagcaga

SEQ ID NO: 194460 - DNA, 35 bp, Artificial Sequence
  Synthetic oligonucleotide
ttgagggcagggctgggggagggtgtcgacgcaga

SEQ ID NO: 194461 - DNA, 37 bp, Artificial Sequence
  Synthetic oligonucleotide
gactgccctcatcgcacgtcgacatcctatctcacga

SEQ ID NO: 194462 - DNA, 37 bp, Artificial Sequence
  Synthetic oligonucleotide
ggtccagccacccgcatcatcccgcacagtttgacga

SEQ ID NO: 194463 - DNA, 37 bp, Artificial Sequence
  Synthetic oligonucleotide
gcacactaggctatgccagtacgatccatcttcccga

SEQ ID NO: 194464 - DNA, 36 bp, Artificial Sequence
  Synthetic oligonucleotide
tatcaccacctgacacctgctctataaccactccga

SEQ ID NO: 194465 - DNA, 37 bp, Artificial Sequence
  Synthetic oligonucleotide
tgctacatcctcatgcgcctagcctatcatgctccga

SEQ ID NO: 194466 - DNA, 37 bp, Artificial Sequence
  Synthetic oligonucleotide
acacaccattacgccggagctaaatgccactctccga

SEQ ID NO: 194467 - DNA, 36 bp, Artificial Sequence
  Synthetic oligonucleotide
atgccacatccatcgccctctacacagggttatcga

SEQ ID NO: 194468 - DNA, 37 bp, Artificial Sequence
  Synthetic oligonucleotide
gccgtagccgtgcatggcgtcctgtcccaatcctcga

SEQ ID NO: 194469 - DNA, 37 bp, Artificial Sequence
  Synthetic oligonucleotide
aatgctgcacgaggccttctatcttctgtcatctcga

SEQ ID NO: 194470 - DNA, 37 bp, Artificial Sequence
  Synthetic oligonucleotide
tgcacgccgcgagtccttttagtacacccaccttcga

SEQ ID NO: 194471 - DNA, 36 bp, Artificial Sequence
  Synthetic oligonucleotide
acatcgacaccgtttcttctccgccgtggccttcga

SEQ ID NO: 194472 - DNA, 35 bp, Artificial Sequence
  Synthetic oligonucleotide
ttcttgctccaccctctgcgtttcatatcgttcga

SEQ ID NO: 194473 - DNA, 37 bp, Artificial Sequence
  Synthetic oligonucleotide
acgccaatccgcccttacgttaacttcccatgttcga

SEQ ID NO: 194474 - DNA, 35 bp, Artificial Sequence
  Synthetic oligonucleotide
tcgacacccatctgcgacgctcctcgccatttcga

SEQ ID NO: 194475 - DNA, 36 bp, Artificial Sequence
  Synthetic oligonucleotide
tgctgtaataagcagggactgggagggctgggagga

SEQ ID NO: 194476 - DNA, 37 bp, Artificial Sequence
  Synthetic oligonucleotide
gggagggcgaagggggggaaccatgattggggacgga

SEQ ID NO: 194477 - DNA, 37 bp, Artificial Sequence
  Synthetic oligonucleotide
agcgagagggggaggtaagcgttcgaagagggccgga

SEQ ID NO: 194478 - DNA, 36 bp, Artificial Sequence
  Synthetic oligonucleotide
tgcctaccccacctgtcaaacgaccgtaaactcgga

SEQ ID NO: 194479 - DNA, 36 bp, Artificial Sequence
  Synthetic oligonucleotide
ggggtgggcgcatgcaataatatagtgaaagaggga

SEQ ID NO: 194480 - DNA, 37 bp, Artificial Sequence
  Synthetic oligonucleotide
gcaaggggacgaaaaaaaggtggctcggtgataggga

SEQ ID NO: 194481 - DNA, 37 bp, Artificial Sequence
  Synthetic oligonucleotide
acatggtgtggggataatgggagcaagggaatcggga

SEQ ID NO: 194482 - DNA, 37 bp, Artificial Sequence
  Synthetic oligonucleotide
tacgagggggaggctggaaaggtccggagtcggggga

SEQ ID NO: 194483 - DNA, 35 bp, Artificial Sequence
  Synthetic oligonucleotide
gagagggacggctaggagggtccgcaatgggggga

SEQ ID NO: 194484 - DNA, 37 bp, Artificial Sequence
  Synthetic oligonucleotide
gagtggggggaaagggtaaggtcgagctcgctgggga

SEQ ID NO: 194485 - DNA, 37 bp, Artificial Sequence
  Synthetic oligonucleotide
acgcataggaggagagtcaagggggcgttaaaatgga

SEQ ID NO: 194486 - DNA, 37 bp, Artificial Sequence
  Synthetic oligonucleotide
taagagggaagggttacggatagaacggctgggtgga

SEQ ID NO: 194487 - DNA, 38 bp, Artificial Sequence
  Synthetic oligonucleotide
agacaagcagggtgggaagcaagggagggagcaaatga

SEQ ID NO: 194488 - DNA, 38 bp, Artificial Sequence
  Synthetic oligonucleotide
tacgccgtccacatgcccatcacccgtccacttcatga

SEQ ID NO: 194489 - DNA, 37 bp, Artificial Sequence
  Synthetic oligonucleotide
ttgagggtcgggggaaggacgagcgaagcgaggatga

SEQ ID NO: 194490 - DNA, 35 bp, Artificial Sequence
  Synthetic oligonucleotide
aagaggggggcaagactggtggttaggggatatga

SEQ ID NO: 194491 - DNA, 38 bp, Artificial Sequence
  Synthetic oligonucleotide
gccggaggtaggagggcgggaggggactacacttatga

SEQ ID NO: 194492 - DNA, 38 bp, Artificial Sequence
  Synthetic oligonucleotide
agtgggagggcaaggtgcgcaagggggggtttaactga

SEQ ID NO: 194493 - DNA, 38 bp, Artificial Sequence
  Synthetic oligonucleotide
gtctcgggggggaggtgggggtgacggtgtaggactga

SEQ ID NO: 194494 - DNA, 38 bp, Artificial Sequence
  Synthetic oligonucleotide
gcaccccgctctgctccgatcgcaatcttgttacctga

SEQ ID NO: 194495 - DNA, 37 bp, Artificial Sequence
  Synthetic oligonucleotide
tgggacgggatgggtgggacggaaaaatcaaccctga

SEQ ID NO: 194496 - DNA, 38 bp, Artificial Sequence
  Synthetic oligonucleotide
tcagcgcctgtcgtagacaacgctccctcttctcctga

SEQ ID NO: 194497 - DNA, 37 bp, Artificial Sequence
  Synthetic oligonucleotide
ttcgatcctccctccagctatgtatcctcgtggctga

SEQ ID NO: 194498 - DNA, 38 bp, Artificial Sequence
  Synthetic oligonucleotide
ataccccgtcgcccgcctttcccgtgtcagcaaagtga

SEQ ID NO: 194499 - DNA, 36 bp, Artificial Sequence
  Synthetic oligonucleotide
ggggtgggcgcatgccataatatagtgaaagagtga

SEQ ID NO: 194500 - DNA, 38 bp, Artificial Sequence
  Synthetic oligonucleotide
aagccacagggaggagggtggaaggggtaacgccgtga

SEQ ID NO: 194501 - DNA, 37 bp, Artificial Sequence
  Synthetic oligonucleotide
gacggaagggcggagggaatctgggaacggtaggtga

SEQ ID NO: 194502 - DNA, 38 bp, Artificial Sequence
  Synthetic oligonucleotide
tagtgcataggttagggtgtcatagagggtcggggtga

SEQ ID NO: 194503 - DNA, 37 bp, Artificial Sequence
  Synthetic oligonucleotide
aactgagccgggagggggggagactcgaagttggtga

SEQ ID NO: 194504 - DNA, 38 bp, Artificial Sequence
  Synthetic oligonucleotide
ggggtgggtgggataggtgggaatgtgatgtcatgtga

SEQ ID NO: 194505 - DNA, 38 bp, Artificial Sequence
  Synthetic oligonucleotide
atcgccctgccccgctttaataaccgcacttcttgtga

SEQ ID NO: 194506 - DNA, 36 bp, Artificial Sequence
  Synthetic oligonucleotide
gatcgacctccgccatctttttcgatcaccatccta

SEQ ID NO: 194507 - DNA, 35 bp, Artificial Sequence
  Synthetic oligonucleotide
gtcatcggtcggctatcctccctgcatttgtccta

SEQ ID NO: 194508 - DNA, 36 bp, Artificial Sequence
  Synthetic oligonucleotide
atcacagtcggtttgcgtatcaacacccctccgcta

SEQ ID NO: 194509 - DNA, 36 bp, Artificial Sequence
  Synthetic oligonucleotide
tgtgtcatcctccgtcgctaccctccacgtatagta

SEQ ID NO: 194510 - DNA, 36 bp, Artificial Sequence
  Synthetic oligonucleotide
aacggaacgcgcaagtgtcgctcatcttctcccgta

SEQ ID NO: 194511 - DNA, 35 bp, Artificial Sequence
  Synthetic oligonucleotide
accccccccatccatgtgtttgttgagaagccgta

SEQ ID NO: 194512 - DNA, 36 bp, Artificial Sequence
  Synthetic oligonucleotide
tgtgttcgcagggaaggagggctgggcgggtatgta

SEQ ID NO: 194513 - DNA, 37 bp, Artificial Sequence
  Synthetic oligonucleotide
gccgacccgccccacgtagcttattctgtcacctgta

SEQ ID NO: 194514 - DNA, 35 bp, Artificial Sequence
  Synthetic oligonucleotide
tgtccatcctgttcgagtctcttgccatcgctgta

SEQ ID NO: 194515 - DNA, 36 bp, Artificial Sequence
  Synthetic oligonucleotide
gagcgttagctgagtcctgtcctcgttcccttctta

SEQ ID NO: 194516 - DNA, 35 bp, Artificial Sequence
  Synthetic oligonucleotide
tggtcgtccacactgatacctggccatccccttta

SEQ ID NO: 194517 - DNA, 35 bp, Artificial Sequence
  Synthetic oligonucleotide
tgccaccgcccggtaaggtcctgctctttcacaac

SEQ ID NO: 194518 - DNA, 35 bp, Artificial Sequence
  Synthetic oligonucleotide
atcaacagcccgctgaccttcctcctcgtcataac

SEQ ID NO: 194519 - DNA, 35 bp, Artificial Sequence
  Synthetic oligonucleotide
gtacccgccactgtccgcctgacaccttctaacac

SEQ ID NO: 194520 - DNA, 35 bp, Artificial Sequence
  Synthetic oligonucleotide
acacacaacgaggcactggcaagggcgagttacac

SEQ ID NO: 194521 - DNA, 35 bp, Artificial Sequence
  Synthetic oligonucleotide
atcatccaccattgacgattcgagtcatttctgac

SEQ ID NO: 194522 - DNA, 35 bp, Artificial Sequence
  Synthetic oligonucleotide
gcgctgacacatgacgttcacccgctaagccttac

SEQ ID NO: 194523 - DNA, 35 bp, Artificial Sequence
  Synthetic oligonucleotide
aggttgcatccactggtcttcactcagcgcccacc

SEQ ID NO: 194524 - DNA, 35 bp, Artificial Sequence
  Synthetic oligonucleotide
acttgccgaattcagagtttccgtcggcttccacc

SEQ ID NO: 194525 - DNA, 35 bp, Artificial Sequence
  Synthetic oligonucleotide
gctccaccatcacaccgttacggtcgacgactacc

SEQ ID NO: 194526 - DNA, 34 bp, Artificial Sequence
  Synthetic oligonucleotide
tcctcaatcgcagttaccgcacttcacgtctacc

SEQ ID NO: 194527 - DNA, 35 bp, Artificial Sequence
  Synthetic oligonucleotide
tcacctatccacccgtcgatcaaggactacccccc

SEQ ID NO: 194528 - DNA, 35 bp, Artificial Sequence
  Synthetic oligonucleotide
gagcggcccgcgcggctgttcatcggtctcctccc

SEQ ID NO: 194529 - DNA, 35 bp, Artificial Sequence
  Synthetic oligonucleotide
tgcctgttccagtattgtccgctccacgtcttccc

SEQ ID NO: 194530 - DNA, 35 bp, Artificial Sequence
  Synthetic oligonucleotide
gatcaagcccccaatgctcccctcgccactgagcc

SEQ ID NO: 194531 - DNA, 35 bp, Artificial Sequence
  Synthetic oligonucleotide
acacatgcgtggctcgttgtacacctccactcgcc

SEQ ID NO: 194532 - DNA, 34 bp, Artificial Sequence
  Synthetic oligonucleotide
tgatacccgccccatgtccctggccatttgtgcc

SEQ ID NO: 194533 - DNA, 35 bp, Artificial Sequence
  Synthetic oligonucleotide
tgcgatcgcccccagtttggtcggcaattttatcc

SEQ ID NO: 194534 - DNA, 35 bp, Artificial Sequence
  Synthetic oligonucleotide
tcaccccccccatcgatatgctgacactgagctcc

SEQ ID NO: 194535 - DNA, 35 bp, Artificial Sequence
  Synthetic oligonucleotide
tccaagcactcgcgtcccgttcgttacctcgctcc

SEQ ID NO: 194536 - DNA, 35 bp, Artificial Sequence
  Synthetic oligonucleotide
gcacgacgcccgtgttttaccaatggctcgcttcc

SEQ ID NO: 194537 - DNA, 35 bp, Artificial Sequence
  Synthetic oligonucleotide
ttgtctctccgccacagcatttctaccttctaggc

SEQ ID NO: 194538 - DNA, 35 bp, Artificial Sequence
  Synthetic oligonucleotide
gacgcgacgggcgttatcgatccacctctcttggc

SEQ ID NO: 194539 - DNA, 35 bp, Artificial Sequence
  Synthetic oligonucleotide
tcattgagccgtcaagaactcctgcatacacctgc

SEQ ID NO: 194540 - DNA, 35 bp, Artificial Sequence
  Synthetic oligonucleotide
tcaccctccgtgctccacttccgttcgcctagtgc

SEQ ID NO: 194541 - DNA, 35 bp, Artificial Sequence
  Synthetic oligonucleotide
atcgactcgcattgaccattacgcgatccccttgc

SEQ ID NO: 194542 - DNA, 35 bp, Artificial Sequence
  Synthetic oligonucleotide
tcaaaccgtactgtaactgctttctgtcgccactc

SEQ ID NO: 194543 - DNA, 35 bp, Artificial Sequence
  Synthetic oligonucleotide
gttacgtctccgcctcgacccggccttacttcctc

SEQ ID NO: 194544 - DNA, 35 bp, Artificial Sequence
  Synthetic oligonucleotide
aggttcatccgcctgttcatccatcactagatctc

SEQ ID NO: 194545 - DNA, 35 bp, Artificial Sequence
  Synthetic oligonucleotide
tcagtaacgttagaacttgaacgctctccactctc

SEQ ID NO: 194546 - DNA, 35 bp, Artificial Sequence
  Synthetic oligonucleotide
tctcacgtgtccgttctgtcgttttggcacctctc

SEQ ID NO: 194547 - DNA, 29 bp, Artificial Sequence
  Synthetic oligonucleotide
ttaccgtctgcaacaatcgccgccgtctc

SEQ ID NO: 194548 - DNA, 35 bp, Artificial Sequence
  Synthetic oligonucleotide
gccggatcctcggtcctgtattccctcttgttctc

SEQ ID NO: 194549 - DNA, 35 bp, Artificial Sequence
  Synthetic oligonucleotide
tcagccgtctattctcatccctgtcacgctgagtc

SEQ ID NO: 194550 - DNA, 35 bp, Artificial Sequence
  Synthetic oligonucleotide
aatcgttggcgccacatgcactttacttcccggtc

SEQ ID NO: 194551 - DNA, 35 bp, Artificial Sequence
  Synthetic oligonucleotide
tgcaccgaccccctaagatcaagttgcgccacttc

SEQ ID NO: 194552 - DNA, 36 bp, Artificial Sequence
  Synthetic oligonucleotide
aatccaggtctgtcccgtttggccgttagcaccttc

SEQ ID NO: 194553 - DNA, 35 bp, Artificial Sequence
  Synthetic oligonucleotide
tcacggccagacttagttcaccgatcccgcccttc

SEQ ID NO: 194554 - DNA, 35 bp, Artificial Sequence
  Synthetic oligonucleotide
tccgttgtcgccacgagcttgtgcgatctgtcttc

SEQ ID NO: 194555 - DNA, 35 bp, Artificial Sequence
  Synthetic oligonucleotide
ggaccccgcaagctgcctccgacactctctcgttc

SEQ ID NO: 194556 - DNA, 36 bp, Artificial Sequence
  Synthetic oligonucleotide
tcaccactcaatagctacatcactgggcgcttgttc

SEQ ID NO: 194557 - DNA, 33 bp, Artificial Sequence
  Synthetic oligonucleotide
tagtccgcacctcaagtaagcgttatccctttc

SEQ ID NO: 194558 - DNA, 36 bp, Artificial Sequence
  Synthetic oligonucleotide
gtcgtcattccccctcgttctgtttatcatacttag

SEQ ID NO: 194559 - DNA, 35 bp, Artificial Sequence
  Synthetic oligonucleotide
gggttgcgggggggttttgcggatggcacatcgcg

SEQ ID NO: 194560 - DNA, 35 bp, Artificial Sequence
  Synthetic oligonucleotide
tgggctccccacatctggccacacgctcgccctcg

SEQ ID NO: 194561 - DNA, 35 bp, Artificial Sequence
  Synthetic oligonucleotide
acagaccggacgtaagcatgagggggggattgtgg

SEQ ID NO: 194562 - DNA, 35 bp, Artificial Sequence
  Synthetic oligonucleotide
gagaaggtgaaaggtggaaggtccagctcaggatg

SEQ ID NO: 194563 - DNA, 35 bp, Artificial Sequence
  Synthetic oligonucleotide
tgcgggtagcgctgacgggcgggtggggagatatg

SEQ ID NO: 194564 - DNA, 35 bp, Artificial Sequence
  Synthetic oligonucleotide
attcgcccgaaccatttgtgattccttcccccctg

SEQ ID NO: 194565 - DNA, 35 bp, Artificial Sequence
  Synthetic oligonucleotide
tctgtggcatattttgcgcgctgaccccccccttg

SEQ ID NO: 194566 - DNA, 35 bp, Artificial Sequence
  Synthetic oligonucleotide
aacccccgaccagttcctagctattaggttccttg

SEQ ID NO: 194567 - DNA, 34 bp, Artificial Sequence
  Synthetic oligonucleotide
acactcgcctagcttactttccgccgatttcttg

SEQ ID NO: 194568 - DNA, 35 bp, Artificial Sequence
  Synthetic oligonucleotide
tgccatggtaaattgcatgctccccccttcctttg

SEQ ID NO: 194569 - DNA, 35 bp, Artificial Sequence
  Synthetic oligonucleotide
tagcgcgaaccgctttgttctctttgacgcgccct

SEQ ID NO: 194570 - DNA, 35 bp, Artificial Sequence
  Synthetic oligonucleotide
gtgcatagtaggtcgcatgagccgtcaccctccct

SEQ ID NO: 194571 - DNA, 35 bp, Artificial Sequence
  Synthetic oligonucleotide
tgacgcggctccatcgtcgtcaccactctcagcct

SEQ ID NO: 194572 - DNA, 35 bp, Artificial Sequence
  Synthetic oligonucleotide
acagagcctcacccctgtaccgcagccccattcct

SEQ ID NO: 194573 - DNA, 35 bp, Artificial Sequence
  Synthetic oligonucleotide
tatcccactccggagcgtttttgcctactgtcgct

SEQ ID NO: 194574 - DNA, 35 bp, Artificial Sequence
  Synthetic oligonucleotide
gccaccacctttcgctgtcaacacgccttcctgct

SEQ ID NO: 194575 - DNA, 35 bp, Artificial Sequence
  Synthetic oligonucleotide
actccccaagacgccagggcctactaccgcactct

SEQ ID NO: 194576 - DNA, 35 bp, Artificial Sequence
  Synthetic oligonucleotide
acataaaccatcgacgcggtctacatagcctctct

SEQ ID NO: 194577 - DNA, 35 bp, Artificial Sequence
  Synthetic oligonucleotide
tagccattcatcgtgtgatctcttcacctgtttct

SEQ ID NO: 194578 - DNA, 35 bp, Artificial Sequence
  Synthetic oligonucleotide
gaaagcacggacggaatagggcgaggttatagcgt

SEQ ID NO: 194579 - DNA, 35 bp, Artificial Sequence
  Synthetic oligonucleotide
accacctacctccgttcacacccgaacctttaggt

SEQ ID NO: 194580 - DNA, 35 bp, Artificial Sequence
  Synthetic oligonucleotide
tgaccccggccttgttatttgccctactacgctgt

SEQ ID NO: 194581 - DNA, 35 bp, Artificial Sequence
  Synthetic oligonucleotide
tctagcccgagcacggctacttagcacatcacctt

SEQ ID NO: 194582 - DNA, 35 bp, Artificial Sequence
  Synthetic oligonucleotide
tagtgtcgtactctgactatacgcctacttccctt

SEQ ID NO: 194583 - DNA, 35 bp, Artificial Sequence
  Synthetic oligonucleotide
acaccacatccgtcattgcaacaccttgaactctt

SEQ ID NO: 194584 - DNA, 35 bp, Artificial Sequence
  Synthetic oligonucleotide
ttccttcaacagtgtgacctgcatctgtgtccgtt

SEQ ID NO: 194585 - DNA, 35 bp, Artificial Sequence
  Synthetic oligonucleotide
gtcccgtccccagagtccccgcgtaagcaacgttt

SEQ ID NO: 194586 - DNA, 36 bp, Artificial Sequence
  Synthetic oligonucleotide
accctgctcagggctagaagggagggtgggtacaaa

SEQ ID NO: 194587 - DNA, 36 bp, Artificial Sequence
  Synthetic oligonucleotide
tacgatgacggaaggaaccaaaagagatgggagaaa

SEQ ID NO: 194588 - DNA, 36 bp, Artificial Sequence
  Synthetic oligonucleotide
gatgaccggaatgagtgagcaggggaggtgcggaaa

SEQ ID NO: 194589 - DNA, 35 bp, Artificial Sequence
  Synthetic oligonucleotide
gtggaggggtgccgcgtgaggagggcagggaagaa

SEQ ID NO: 194590 - DNA, 36 bp, Artificial Sequence
  Synthetic oligonucleotide
tgtcgatcgcccccgtgctcttctttctccgtagaa

SEQ ID NO: 194591 - DNA, 36 bp, Artificial Sequence
  Synthetic oligonucleotide
atctgggtcggggtcgggggggtcgaagggcaggaa

SEQ ID NO: 194592 - DNA, 36 bp, Artificial Sequence
  Synthetic oligonucleotide
tccgtgcctcgctgtacctagcttccccctgactaa

SEQ ID NO: 194593 - DNA, 36 bp, Artificial Sequence
  Synthetic oligonucleotide
actttcgccacatgtcttttcgcctctaaccggtaa

SEQ ID NO: 194594 - DNA, 35 bp, Artificial Sequence
  Synthetic oligonucleotide
tgcaccccatcttggcatcagcgcaaacaccttaa

SEQ ID NO: 194595 - DNA, 36 bp, Artificial Sequence
  Synthetic oligonucleotide
agtgcggggaggagggagtaagcaaatggcacaaca

SEQ ID NO: 194596 - DNA, 36 bp, Artificial Sequence
  Synthetic oligonucleotide
tccgtccccgccctatatgttgctcaattattgaca

SEQ ID NO: 194597 - DNA, 36 bp, Artificial Sequence
  Synthetic oligonucleotide
acccccgctcgcccttagtacgtcgcatatctacca

SEQ ID NO: 194598 - DNA, 36 bp, Artificial Sequence
  Synthetic oligonucleotide
taacccgggtcctcgcttcctctgccgcagtatcca

SEQ ID NO: 194599 - DNA, 36 bp, Artificial Sequence
  Synthetic oligonucleotide
tccatctgcgtaagcagctgttccaccacgaccgca

SEQ ID NO: 194600 - DNA, 36 bp, Artificial Sequence
  Synthetic oligonucleotide
tgcctgacgtcagccagccgtcttcgttccactgca

SEQ ID NO: 194601 - DNA, 35 bp, Artificial Sequence
  Synthetic oligonucleotide
atgacctgtagatccgtgcctctcattccccatca

SEQ ID NO: 194602 - DNA, 36 bp, Artificial Sequence
  Synthetic oligonucleotide
tttgcggagccatttcgtttacacttccgcttctca

SEQ ID NO: 194603 - DNA, 36 bp, Artificial Sequence
  Synthetic oligonucleotide
acatctacacgctcctcgtcgttatctgcattttca

SEQ ID NO: 194604 - DNA, 37 bp, Artificial Sequence
  Synthetic oligonucleotide
tggatcgaccgggggggttgggaagggtgggtcaaga

SEQ ID NO: 194605 - DNA, 36 bp, Artificial Sequence
  Synthetic oligonucleotide
aaaggaaggatagagcgggacgggacgaaacgaaga

SEQ ID NO: 194606 - DNA, 37 bp, Artificial Sequence
  Synthetic oligonucleotide
taccggagaagggtggaagcagcagggcattatcaga

SEQ ID NO: 194607 - DNA, 37 bp, Artificial Sequence
  Synthetic oligonucleotide
tcctcgccccctgcccgtgcctctggaaacttggaga

SEQ ID NO: 194608 - DNA, 36 bp, Artificial Sequence
  Synthetic oligonucleotide
gctcgtccgtccgtcccttgtgctttctgcgcccga

SEQ ID NO: 194609 - DNA, 36 bp, Artificial Sequence
  Synthetic oligonucleotide
agggaaggggggggtgaacgaatgccggggaagcga

SEQ ID NO: 194610 - DNA, 37 bp, Artificial Sequence
  Synthetic oligonucleotide
tgctaccctcccccttcgtattgcaccgcgatcgcga

SEQ ID NO: 194611 - DNA, 36 bp, Artificial Sequence
  Synthetic oligonucleotide
tctgcatccgcctacgaagcttttccgacacctcga

SEQ ID NO: 194612 - DNA, 37 bp, Artificial Sequence
  Synthetic oligonucleotide
atgacatcgcccttgatactttagccctttcgctcga

SEQ ID NO: 194613 - DNA, 35 bp, Artificial Sequence
  Synthetic oligonucleotide
tacgagggaagaacaaaggagtgcaggacaaagga

SEQ ID NO: 194614 - DNA, 37 bp, Artificial Sequence
  Synthetic oligonucleotide
ggggggtgtgggtgggctaaggtggaatggccaagga

SEQ ID NO: 194615 - DNA, 36 bp, Artificial Sequence
  Synthetic oligonucleotide
gcccccccttgcccatttgcagtctcctacacagga

SEQ ID NO: 194616 - DNA, 37 bp, Artificial Sequence
  Synthetic oligonucleotide
tcaagtgcagggaacacggggtggagcagtagacgga

SEQ ID NO: 194617 - DNA, 36 bp, Artificial Sequence
  Synthetic oligonucleotide
tgatagggccagggtaatcatggggggggcgacgga

SEQ ID NO: 194618 - DNA, 37 bp, Artificial Sequence
  Synthetic oligonucleotide
gccacccaccgcctcatgccggacaaacgccctcgga

SEQ ID NO: 194619 - DNA, 36 bp, Artificial Sequence
  Synthetic oligonucleotide
tgcccctgttcacctctcttctcgttgtctttcgga

SEQ ID NO: 194620 - DNA, 37 bp, Artificial Sequence
  Synthetic oligonucleotide
gggaaagggggtgggaaaagaagtagcaactaaggga

SEQ ID NO: 194621 - DNA, 35 bp, Artificial Sequence
  Synthetic oligonucleotide
gcatgcaggagggaaagaaggggatgcgcacggga

SEQ ID NO: 194622 - DNA, 37 bp, Artificial Sequence
  Synthetic oligonucleotide
gacagtgggcgttggggaaacatggggaagatcggga

SEQ ID NO: 194623 - DNA, 37 bp, Artificial Sequence
  Synthetic oligonucleotide
agagcggacggcatggacggggaggcatgatggggga

SEQ ID NO: 194624 - DNA, 37 bp, Artificial Sequence
  Synthetic oligonucleotide
tgagtgagtgggttggggtcgggaggagccggtggga

SEQ ID NO: 194625 - DNA, 37 bp, Artificial Sequence
  Synthetic oligonucleotide
tggggagagaaacatgaaagggggacgggaatatgga

SEQ ID NO: 194626 - DNA, 34 bp, Artificial Sequence
  Synthetic oligonucleotide
acatcccctcgcctgaccctgatatgcaaaatga

SEQ ID NO: 194627 - DNA, 37 bp, Artificial Sequence
  Synthetic oligonucleotide
taactccccccccgcccgtcagatttcatgcacatga

SEQ ID NO: 194628 - DNA, 38 bp, Artificial Sequence
  Synthetic oligonucleotide
aggtagggagggtggggtggacgaggataacgggatga

SEQ ID NO: 194629 - DNA, 37 bp, Artificial Sequence
  Synthetic oligonucleotide
ggggtcgagggggtggtagtgcatgtgcagctgatga

SEQ ID NO: 194630 - DNA, 38 bp, Artificial Sequence
  Synthetic oligonucleotide
gatggaaggtagaggtaggaaagcggagaggctgatga

SEQ ID NO: 194631 - DNA, 38 bp, Artificial Sequence
  Synthetic oligonucleotide
gagaagaacagcggggtagaggggcgtatgcgtactga

SEQ ID NO: 194632 - DNA, 34 bp, Artificial Sequence
  Synthetic oligonucleotide
acatctcgccctcctacttactgatttggcctga

SEQ ID NO: 194633 - DNA, 38 bp, Artificial Sequence
  Synthetic oligonucleotide
atgcggaggagaggatgaggagtgtggtctgcgtctga

SEQ ID NO: 194634 - DNA, 38 bp, Artificial Sequence
  Synthetic oligonucleotide
tgggaagggaaggggacgacgaagggacggtgttctga

SEQ ID NO: 194635 - DNA, 38 bp, Artificial Sequence
  Synthetic oligonucleotide
gagacaagggagggtaacaaagcgcagaagaggcgtga

SEQ ID NO: 194636 - DNA, 37 bp, Artificial Sequence
  Synthetic oligonucleotide
atgccagccaccgattttactagtcttttgctcgtga

SEQ ID NO: 194637 - DNA, 38 bp, Artificial Sequence
  Synthetic oligonucleotide
acacgcgctcaattgcgccgttccgttcttcctggtga

SEQ ID NO: 194638 - DNA, 38 bp, Artificial Sequence
  Synthetic oligonucleotide
atgcaagacaaggcgggaattgtgaggcggggtggtga

SEQ ID NO: 194639 - DNA, 36 bp, Artificial Sequence
  Synthetic oligonucleotide
tgaacgcttgagagagaaggaggggagcgattgtga

SEQ ID NO: 194640 - DNA, 38 bp, Artificial Sequence
  Synthetic oligonucleotide
tccagccagcaacgccctttgttctatccacgtcttga

SEQ ID NO: 194641 - DNA, 35 bp, Artificial Sequence
  Synthetic oligonucleotide
tcatctcggccttggattctgctttctccgcccta

SEQ ID NO: 194642 - DNA, 36 bp, Artificial Sequence
  Synthetic oligonucleotide
acaacacgggcccctgtgtttttcacacttttgcta

SEQ ID NO: 194643 - DNA, 36 bp, Artificial Sequence
  Synthetic oligonucleotide
gtacatcctccctgtttctgtgcgcccttagttcta

SEQ ID NO: 194644 - DNA, 35 bp, Artificial Sequence
  Synthetic oligonucleotide
gtcgtgggagaggcgatatggggggcgggtatgta

SEQ ID NO: 194645 - DNA, 35 bp, Artificial Sequence
  Synthetic oligonucleotide
acgcctacacttgcatctgcctgcccgttacatta

SEQ ID NO: 194646 - DNA, 35 bp, Artificial Sequence
  Synthetic oligonucleotide
ggacaccattggatagtcttaacccccggccctta

SEQ ID NO: 194647 - DNA, 36 bp, Artificial Sequence
  Synthetic oligonucleotide
tgtccacatccatgcgcataatccaccctgccctta

SEQ ID NO: 194648 - DNA, 37 bp, Artificial Sequence
  Synthetic oligonucleotide
attccgtgcagacgatgtcagtccagcccccccttta

SEQ ID NO: 194649 - DNA, 35 bp, Artificial Sequence
  Synthetic oligonucleotide
gacgcactgcctccttacacttcatactgcttaac

SEQ ID NO: 194650 - DNA, 35 bp, Artificial Sequence
  Synthetic oligonucleotide
gtctccgcccaatagtccagcacttccgtttgcac

SEQ ID NO: 194651 - DNA, 35 bp, Artificial Sequence
  Synthetic oligonucleotide
tcgcacctgcattcctgcttttagcacagtttgac

SEQ ID NO: 194652 - DNA, 35 bp, Artificial Sequence
  Synthetic oligonucleotide
aaacactgcttgcatgagcttaattaacccgctac

SEQ ID NO: 194653 - DNA, 34 bp, Artificial Sequence
  Synthetic oligonucleotide
tccgatgccgccccagttggcaatccattaaacc

SEQ ID NO: 194654 - DNA, 35 bp, Artificial Sequence
  Synthetic oligonucleotide
tgccattccagtactttttcgtctagctttccacc

SEQ ID NO: 194655 - DNA, 35 bp, Artificial Sequence
  Synthetic oligonucleotide
acctcagagaccatctgcgtcccaggatcatcccc

SEQ ID NO: 194656 - DNA, 35 bp, Artificial Sequence
  Synthetic oligonucleotide
ttagtgacgatctgcaatcctgtacacacctcccc

SEQ ID NO: 194657 - DNA, 35 bp, Artificial Sequence
  Synthetic oligonucleotide
agccgtcactgctaacccccgtgcttgctctcccc

SEQ ID NO: 194658 - DNA, 35 bp, Artificial Sequence
  Synthetic oligonucleotide
tcatgtccgtcgtgccccgcgtatttcgcatgccc

SEQ ID NO: 194659 - DNA, 35 bp, Artificial Sequence
  Synthetic oligonucleotide
gtgctatcctgtgatcgattggtccgtcctctccc

SEQ ID NO: 194660 - DNA, 35 bp, Artificial Sequence
  Synthetic oligonucleotide
gtgggctactgcagggcgtccacttgtccgttccc

SEQ ID NO: 194661 - DNA, 35 bp, Artificial Sequence
  Synthetic oligonucleotide
ttcacccccacgaagttctcattgtttgccgtgcc

SEQ ID NO: 194662 - DNA, 35 bp, Artificial Sequence
  Synthetic oligonucleotide
tatgcgtgagcgttggtccgtacgccctcattgcc

SEQ ID NO: 194663 - DNA, 35 bp, Artificial Sequence
  Synthetic oligonucleotide
atgcttgccattcgcgcactgggaccgatccatcc

SEQ ID NO: 194664 - DNA, 35 bp, Artificial Sequence
  Synthetic oligonucleotide
tacagtccgagtctattcatgtccacgctttatcc

SEQ ID NO: 194665 - DNA, 35 bp, Artificial Sequence
  Synthetic oligonucleotide
gaggccccgcactatctcaggcgccactccgctcc

SEQ ID NO: 194666 - DNA, 35 bp, Artificial Sequence
  Synthetic oligonucleotide
gggactaactgcccgatctctcgacgaactgctcc

SEQ ID NO: 194667 - DNA, 35 bp, Artificial Sequence
  Synthetic oligonucleotide
atggacgagctaactgctggctgaaccctgtctcc

SEQ ID NO: 194668 - DNA, 35 bp, Artificial Sequence
  Synthetic oligonucleotide
tcccattcgctccaggacgtttctccgggccttcc

SEQ ID NO: 194669 - DNA, 35 bp, Artificial Sequence
  Synthetic oligonucleotide
tgatagtcgctcatcgacgaaccctctcccgttcc

SEQ ID NO: 194670 - DNA, 35 bp, Artificial Sequence
  Synthetic oligonucleotide
gtaccgtgctcccatctatatggcctcccattagc

SEQ ID NO: 194671 - DNA, 35 bp, Artificial Sequence
  Synthetic oligonucleotide
gtcgacataatgtgtctcgcccctcacaccctatc

SEQ ID NO: 194672 - DNA, 35 bp, Artificial Sequence
  Synthetic oligonucleotide
gccggtccacccctctcgatctgtaagccccactc

SEQ ID NO: 194673 - DNA, 34 bp, Artificial Sequence
  Synthetic oligonucleotide
gtatcggtgagcgtaccgactttcgttctacctc

SEQ ID NO: 194674 - DNA, 35 bp, Artificial Sequence
  Synthetic oligonucleotide
ttggcgttctatggcttccctgggtccctttgctc

SEQ ID NO: 194675 - DNA, 35 bp, Artificial Sequence
  Synthetic oligonucleotide
acgctccacatgtccatacctcggtctgttccttc

SEQ ID NO: 194676 - DNA, 35 bp, Artificial Sequence
  Synthetic oligonucleotide
tctccacgccacaccgcgtaccctaactgcctttc

SEQ ID NO: 194677 - DNA, 35 bp, Artificial Sequence
  Synthetic oligonucleotide
atgactgatccgccgtgtgcgcccgtctgcttttc

SEQ ID NO: 194678 - DNA, 35 bp, Artificial Sequence
  Synthetic oligonucleotide
acagacgtgggttgggggctaaaaggggggtacag

SEQ ID NO: 194679 - DNA, 35 bp, Artificial Sequence
  Synthetic oligonucleotide
ggaggaaggggggcagaagaaaagcatttgtacag

SEQ ID NO: 194680 - DNA, 33 bp, Artificial Sequence
  Synthetic oligonucleotide
aggattagtaaggagggtaggggggaggcggag

SEQ ID NO: 194681 - DNA, 35 bp, Artificial Sequence
  Synthetic oligonucleotide
tgtgcgcaatgctatatcgaacatatctctctccg

SEQ ID NO: 194682 - DNA, 35 bp, Artificial Sequence
  Synthetic oligonucleotide
gaccccgtaacccctcctgcgtcaccagacattcg

SEQ ID NO: 194683 - DNA, 35 bp, Artificial Sequence
  Synthetic oligonucleotide
acaccccctgccgttgcgaacatgtcagttcttgg

SEQ ID NO: 194684 - DNA, 35 bp, Artificial Sequence
  Synthetic oligonucleotide
gccggtcacccattccgcttgtaatctcactcatg

SEQ ID NO: 194685 - DNA, 35 bp, Artificial Sequence
  Synthetic oligonucleotide
gccccgcccccttattcgtattctgtcataccctg

SEQ ID NO: 194686 - DNA, 35 bp, Artificial Sequence
  Synthetic oligonucleotide
accagctgacgcccctgtggcctccttccctcctg

SEQ ID NO: 194687 - DNA, 35 bp, Artificial Sequence
  Synthetic oligonucleotide
ttccgtacccgccccataacatcgttagtactctg

SEQ ID NO: 194688 - DNA, 35 bp, Artificial Sequence
  Synthetic oligonucleotide
ggtcgcccacctgcggaacaatcaatctccttctg

SEQ ID NO: 194689 - DNA, 35 bp, Artificial Sequence
  Synthetic oligonucleotide
gacgcccccgctctgcaatcgacggtcacactttg

SEQ ID NO: 194690 - DNA, 35 bp, Artificial Sequence
  Synthetic oligonucleotide
gcgctgcccctccgagctgccttctcattttatat

SEQ ID NO: 194691 - DNA, 35 bp, Artificial Sequence
  Synthetic oligonucleotide
ttgtgtactcccgtctcacgtgtccttagccctat

SEQ ID NO: 194692 - DNA, 35 bp, Artificial Sequence
  Synthetic oligonucleotide
atcagccccctagcctgtcccatagccgttgccct

SEQ ID NO: 194693 - DNA, 35 bp, Artificial Sequence
  Synthetic oligonucleotide
gaaatcgtagccgtgcgtttatgcctcacatccct

SEQ ID NO: 194694 - DNA, 35 bp, Artificial Sequence
  Synthetic oligonucleotide
acaccaccgccttgtctccaacgatcatggtccct

SEQ ID NO: 194695 - DNA, 35 bp, Artificial Sequence
  Synthetic oligonucleotide
ttgatccttcagtactctgcccccttgctgttcct

SEQ ID NO: 194696 - DNA, 35 bp, Artificial Sequence
  Synthetic oligonucleotide
agccatgccgccccgattactcgccagtctttcct

SEQ ID NO: 194697 - DNA, 35 bp, Artificial Sequence
  Synthetic oligonucleotide
tcctatcgcccctctgactctattcggtatatgct

SEQ ID NO: 194698 - DNA, 35 bp, Artificial Sequence
  Synthetic oligonucleotide
actcaccaccattcgtagtccaagccaccaactct

SEQ ID NO: 194699 - DNA, 35 bp, Artificial Sequence
  Synthetic oligonucleotide
tggatgcgactacgttctccccactgtactcccgt

SEQ ID NO: 194700 - DNA, 35 bp, Artificial Sequence
  Synthetic oligonucleotide
gatacgtgcagttgcgttcgcccttgtctttcggt

SEQ ID NO: 194701 - DNA, 35 bp, Artificial Sequence
  Synthetic oligonucleotide
atagcatcgccgccctgcctcatctctgcctatgt

SEQ ID NO: 194702 - DNA, 35 bp, Artificial Sequence
  Synthetic oligonucleotide
tgcgggaggtgattgtgcggtggggatggtgttgt

SEQ ID NO: 194703 - DNA, 35 bp, Artificial Sequence
  Synthetic oligonucleotide
acatgcatgtgccccacttggattctggttccatt

SEQ ID NO: 194704 - DNA, 35 bp, Artificial Sequence
  Synthetic oligonucleotide
accacccctggctcatctggctcccgcacgccctt

SEQ ID NO: 194705 - DNA, 35 bp, Artificial Sequence
  Synthetic oligonucleotide
tcgtccttcgcaaatgataccacgcccgttccctt

SEQ ID NO: 194706 - DNA, 35 bp, Artificial Sequence
  Synthetic oligonucleotide
gtgtgctgtacgtcttgccccatcctcgccggctt

SEQ ID NO: 194707 - DNA, 35 bp, Artificial Sequence
  Synthetic oligonucleotide
gacaccatccgccctgctcgggaatacccggagtt

SEQ ID NO: 194708 - DNA, 35 bp, Artificial Sequence
  Synthetic oligonucleotide
aagatggcgggcgggattgtggtgggcttgatgtt

SEQ ID NO: 194709 - DNA, 35 bp, Artificial Sequence
  Synthetic oligonucleotide
gtgtcccggtcgacggtcttgatcctgcctttttt

SEQ ID NO: 194710 - DNA, 36 bp, Artificial Sequence
  Synthetic oligonucleotide
gtgttagagggggcggtgaaggtgaggcgcgtagaa

SEQ ID NO: 194711 - DNA, 35 bp, Artificial Sequence
  Synthetic oligonucleotide
tagaccaccagccttccatctctactcgaccataa

SEQ ID NO: 194712 - DNA, 35 bp, Artificial Sequence
  Synthetic oligonucleotide
atgccgtctaccgcatggtcttccgtccttcataa

SEQ ID NO: 194713 - DNA, 36 bp, Artificial Sequence
  Synthetic oligonucleotide
tccacttccctcccatctgttaatacccattgataa

SEQ ID NO: 194714 - DNA, 35 bp, Artificial Sequence
  Synthetic oligonucleotide
ccacattgtccttgcgctccttagtcacttcccca

SEQ ID NO: 194715 - DNA, 36 bp, Artificial Sequence
  Synthetic oligonucleotide
ttcaccccatgcatacggtcctggcgccaaagccca

SEQ ID NO: 194716 - DNA, 36 bp, Artificial Sequence
  Synthetic oligonucleotide
agcccaggactgccagcgttttcctcaccttcgcca

SEQ ID NO: 194717 - DNA, 36 bp, Artificial Sequence
  Synthetic oligonucleotide
tacatacgcgatcgggtaacctttctccatgctcca

SEQ ID NO: 194718 - DNA, 36 bp, Artificial Sequence
  Synthetic oligonucleotide
accccacccagtgatgagcttcatcctccatgtcca

SEQ ID NO: 194719 - DNA, 35 bp, Artificial Sequence
  Synthetic oligonucleotide
taattccagcggcaccaccgttcccttgcttagca

SEQ ID NO: 194720 - DNA, 35 bp, Artificial Sequence
  Synthetic oligonucleotide
acgtcatctccgcagcctacctctcagccccggca

SEQ ID NO: 194721 - DNA, 36 bp, Artificial Sequence
  Synthetic oligonucleotide
gcattccccaatccttattacgatgacacctctgca

SEQ ID NO: 194722 - DNA, 36 bp, Artificial Sequence
  Synthetic oligonucleotide
aagttcaccgccaaaccctgtcgccactgaaaatca

SEQ ID NO: 194723 - DNA, 35 bp, Artificial Sequence
  Synthetic oligonucleotide
tgcctcacgttccggtctatttccccaattgctca

SEQ ID NO: 194724 - DNA, 37 bp, Artificial Sequence
  Synthetic oligonucleotide
tgtggcgggccgggaaggatatacgggttcgggaaga

SEQ ID NO: 194725 - DNA, 37 bp, Artificial Sequence
  Synthetic oligonucleotide
tgttcagagggggtgggtgggacatgtgagggccaga

SEQ ID NO: 194726 - DNA, 38 bp, Artificial Sequence
  Synthetic oligonucleotide
aagacgaaagttggtgggggagtaggggtcaaggtaga

SEQ ID NO: 194727 - DNA, 37 bp, Artificial Sequence
  Synthetic oligonucleotide
agtagtgcagaggaggtgagagcgggagggtattaga

SEQ ID NO: 194728 - DNA, 36 bp, Artificial Sequence
  Synthetic oligonucleotide
gccacccccgctttgagtttttcacacttgtttaga

SEQ ID NO: 194729 - DNA, 36 bp, Artificial Sequence
  Synthetic oligonucleotide
gttggcgagtagggcagggcgggggagaagtaccga

SEQ ID NO: 194730 - DNA, 37 bp, Artificial Sequence
  Synthetic oligonucleotide
tgtacgcctctaggctggtcttatcccgatctcccga

SEQ ID NO: 194731 - DNA, 37 bp, Artificial Sequence
  Synthetic oligonucleotide
gagagaagagggcggagtgttggtaaagggagtgcga

SEQ ID NO: 194732 - DNA, 37 bp, Artificial Sequence
  Synthetic oligonucleotide
gtgtgcaccgctgccacttcgcctttgtaccttgcga

SEQ ID NO: 194733 - DNA, 37 bp, Artificial Sequence
  Synthetic oligonucleotide
gaccgggggggtggggtgagacagctttgaggatcga

SEQ ID NO: 194734 - DNA, 36 bp, Artificial Sequence
  Synthetic oligonucleotide
tgtcgcatccacgccgccgactcctacccgtatcga

SEQ ID NO: 194735 - DNA, 36 bp, Artificial Sequence
  Synthetic oligonucleotide
gtgggggaggctggggggtaggtctagcacgtagga

SEQ ID NO: 194736 - DNA, 37 bp, Artificial Sequence
  Synthetic oligonucleotide
ttgcttactcagcccctcaccaccatccactcgcgga

SEQ ID NO: 194737 - DNA, 37 bp, Artificial Sequence
  Synthetic oligonucleotide
tcgatcgcctctctgccgacctggacctactctcgga

SEQ ID NO: 194738 - DNA, 37 bp, Artificial Sequence
  Synthetic oligonucleotide
acagggtcggaacggcactaggagagggtaggaggga

SEQ ID NO: 194739 - DNA, 37 bp, Artificial Sequence
  Synthetic oligonucleotide
gagtccgcagttggtatgaagatgagggggggaggga

SEQ ID NO: 194740 - DNA, 36 bp, Artificial Sequence
  Synthetic oligonucleotide
atgtgctgaggaaatgggagtggggtcgggccggga

SEQ ID NO: 194741 - DNA, 37 bp, Artificial Sequence
  Synthetic oligonucleotide
gtgtgccacatcctcgcttctattcctttgtccggga

SEQ ID NO: 194742 - DNA, 37 bp, Artificial Sequence
  Synthetic oligonucleotide
cagaacggcaagaaggaacacaaacggaagggcggga

SEQ ID NO: 194743 - DNA, 36 bp, Artificial Sequence
  Synthetic oligonucleotide
gggatggaacggaatgggaaatcaggatgctcggga

SEQ ID NO: 194744 - DNA, 37 bp, Artificial Sequence
  Synthetic oligonucleotide
tggggagtggcggtttccatcctatggcggtggggga

SEQ ID NO: 194745 - DNA, 36 bp, Artificial Sequence
  Synthetic oligonucleotide
gtcacccgctccgctgcgtattacctcacccgtgga

SEQ ID NO: 194746 - DNA, 38 bp, Artificial Sequence
  Synthetic oligonucleotide
gaccacccagagcctactagttcgctcacctccaatga

SEQ ID NO: 194747 - DNA, 38 bp, Artificial Sequence
  Synthetic oligonucleotide
gggaggggggagagcggggatactgtcaggtggaatga

SEQ ID NO: 194748 - DNA, 36 bp, Artificial Sequence
  Synthetic oligonucleotide
ggatcaccaccccgatgattatctgttctcctatga

SEQ ID NO: 194749 - DNA, 38 bp, Artificial Sequence
  Synthetic oligonucleotide
tgagggcggagggaggggggttgatttggacggtatga

SEQ ID NO: 194750 - DNA, 38 bp, Artificial Sequence
  Synthetic oligonucleotide
aatgccggtccaattcgttgatccaccttaccacctga

SEQ ID NO: 194751 - DNA, 38 bp, Artificial Sequence
  Synthetic oligonucleotide
gtgccacgagtaagggaaaagggggcctagggaagtga

SEQ ID NO: 194752 - DNA, 38 bp, Artificial Sequence
  Synthetic oligonucleotide
gccacccatcttgctcacgcgcccttcccttacagtga

SEQ ID NO: 194753 - DNA, 37 bp, Artificial Sequence
  Synthetic oligonucleotide
gtgcttcccgtcctacctctgtcttagcccccagtga

SEQ ID NO: 194754 - DNA, 38 bp, Artificial Sequence
  Synthetic oligonucleotide
gctagtggggaaggggtgggaaaggataacgcccgtga

SEQ ID NO: 194755 - DNA, 36 bp, Artificial Sequence
  Synthetic oligonucleotide
gtccgctgccctttgccttccgcccgactcccgtga

SEQ ID NO: 194756 - DNA, 38 bp, Artificial Sequence
  Synthetic oligonucleotide
gatggagagggtacggaagttgggcggaaagtgggtga

SEQ ID NO: 194757 - DNA, 38 bp, Artificial Sequence
  Synthetic oligonucleotide
tcattccacgcgcctctcctcctatatgtacagtgtga

SEQ ID NO: 194758 - DNA, 36 bp, Artificial Sequence
  Synthetic oligonucleotide
tacggaagggaggatagtgaatgggtgggggtgtga

SEQ ID NO: 194759 - DNA, 38 bp, Artificial Sequence
  Synthetic oligonucleotide
tcaagacaacgctggtggggaacggggcggaggattga

SEQ ID NO: 194760 - DNA, 36 bp, Artificial Sequence
  Synthetic oligonucleotide
atgatccacccccgacgagctaaataagctccttga

SEQ ID NO: 194761 - DNA, 38 bp, Artificial Sequence
  Synthetic oligonucleotide
tattcaccgccagtagcgcatcagttacctcctcttga

SEQ ID NO: 194762 - DNA, 36 bp, Artificial Sequence
  Synthetic oligonucleotide
ttggagagcgggtgggttggtcgaacatgccaaata

SEQ ID NO: 194763 - DNA, 32 bp, Artificial Sequence
  Synthetic oligonucleotide
gaccatacgtccttccatcaaccgacctacta

SEQ ID NO: 194764 - DNA, 36 bp, Artificial Sequence
  Synthetic oligonucleotide
ttgcaccaccctcggttagcgtccctaagtgcccta

SEQ ID NO: 194765 - DNA, 35 bp, Artificial Sequence
  Synthetic oligonucleotide
taggccacctcgcgcgcgtataccccccggatcta

SEQ ID NO: 194766 - DNA, 36 bp, Artificial Sequence
  Synthetic oligonucleotide
atgccacttagctcccttgccgcaactcgtattcta

SEQ ID NO: 194767 - DNA, 35 bp, Artificial Sequence
  Synthetic oligonucleotide
accgcccccgtttttgactatattatcacgttgta

SEQ ID NO: 194768 - DNA, 36 bp, Artificial Sequence
  Synthetic oligonucleotide
atgagcccgccgcccttagcttcaccgactcactta

SEQ ID NO: 194769 - DNA, 36 bp, Artificial Sequence
  Synthetic oligonucleotide
gtactcaccactgctggcttggccctaacactctta

SEQ ID NO: 194770 - DNA, 35 bp, Artificial Sequence
  Synthetic oligonucleotide
gacactctatgcttttatgtagtcttcgcctctta

SEQ ID NO: 194771 - DNA, 36 bp, Artificial Sequence
  Synthetic oligonucleotide
actagtcgccccgttgttgtttaccaccgcttctta

SEQ ID NO: 194772 - DNA, 35 bp, Artificial Sequence
  Synthetic oligonucleotide
ttgtggccactgtacgccggactttaccataccac

SEQ ID NO: 194773 - DNA, 34 bp, Artificial Sequence
  Synthetic oligonucleotide
tagtccacatctttgacgcacatgtcgaccccac

SEQ ID NO: 194774 - DNA, 35 bp, Artificial Sequence
  Synthetic oligonucleotide
gagtcccctctgctgctgtaactgccacgaatcac

SEQ ID NO: 194775 - DNA, 35 bp, Artificial Sequence
  Synthetic oligonucleotide
atgcgccgtaacgcccttgggtactatcctttcac

SEQ ID NO: 194776 - DNA, 35 bp, Artificial Sequence
  Synthetic oligonucleotide
attggtcggacccacctgcactgtaccccattgac

SEQ ID NO: 194777 - DNA, 35 bp, Artificial Sequence
  Synthetic oligonucleotide
gctaagcgcctagtcgtccttgcctcctctaatac

SEQ ID NO: 194778 - DNA, 35 bp, Artificial Sequence
  Synthetic oligonucleotide
tgttatccgcctgtggtgttacacccgcctgctac

SEQ ID NO: 194779 - DNA, 35 bp, Artificial Sequence
  Synthetic oligonucleotide
tattgcccacaccacgttatcgcacgttgtaaacc

SEQ ID NO: 194780 - DNA, 35 bp, Artificial Sequence
  Synthetic oligonucleotide
atcatgtgcaagaagacagcgtcttgccactcacc

SEQ ID NO: 194781 - DNA, 35 bp, Artificial Sequence
  Synthetic oligonucleotide
aacttacacctgggcattcggactcggccttcacc

SEQ ID NO: 194782 - DNA, 35 bp, Artificial Sequence
  Synthetic oligonucleotide
tgagagtgttccgtccattcggctcccgtgcgccc

SEQ ID NO: 194783 - DNA, 35 bp, Artificial Sequence
  Synthetic oligonucleotide
aatgtacccgatcccagcttactctaccagtgccc

SEQ ID NO: 194784 - DNA, 35 bp, Artificial Sequence
  Synthetic oligonucleotide
agagccacctcacttaaccgcaaaggacacctccc

SEQ ID NO: 194785 - DNA, 35 bp, Artificial Sequence
  Synthetic oligonucleotide
tacacacccgcatagcgcccaagcgaatgtctccc

SEQ ID NO: 194786 - DNA, 35 bp, Artificial Sequence
  Synthetic oligonucleotide
gcatgcacctaactgtcatggtctcgtgatttccc

SEQ ID NO: 194787 - DNA, 35 bp, Artificial Sequence
  Synthetic oligonucleotide
tcatcacttctcattggatcgttgagcctctcgcc

SEQ ID NO: 194788 - DNA, 35 bp, Artificial Sequence
  Synthetic oligonucleotide
agcaccggctcatcatccgcatatctttcgtggcc

SEQ ID NO: 194789 - DNA, 35 bp, Artificial Sequence
  Synthetic oligonucleotide
gtggaccggccatccctgattcgtcgtacctatcc

SEQ ID NO: 194790 - DNA, 35 bp, Artificial Sequence
  Synthetic oligonucleotide
tgatgctgaccggcgggctcttaacctcctactcc

SEQ ID NO: 194791 - DNA, 35 bp, Artificial Sequence
  Synthetic oligonucleotide
taggtcataaatctcgccgttgttctatccagtcc

SEQ ID NO: 194792 - DNA, 35 bp, Artificial Sequence
  Synthetic oligonucleotide
actgatgcaggaaaatagttctcgtgcccctgtcc

SEQ ID NO: 194793 - DNA, 35 bp, Artificial Sequence
  Synthetic oligonucleotide
tccgctaccgttccccgtggtctcagtccctgtcc

SEQ ID NO: 194794 - DNA, 35 bp, Artificial Sequence
  Synthetic oligonucleotide
atccagactgcctactaggtcccgctcatacttcc

SEQ ID NO: 194795 - DNA, 35 bp, Artificial Sequence
  Synthetic oligonucleotide
aatccacgcatgagattgccgcctttaacgtttcc

SEQ ID NO: 194796 - DNA, 35 bp, Artificial Sequence
  Synthetic oligonucleotide
aggatggcctgctcgctctttagaacatcgtttcc

SEQ ID NO: 194797 - DNA, 35 bp, Artificial Sequence
  Synthetic oligonucleotide
gatgcagttgcccatttcgtatgttcttgccatgc

SEQ ID NO: 194798 - DNA, 35 bp, Artificial Sequence
  Synthetic oligonucleotide
tcccacgagagtggcttctaaacatcccgctttgc

SEQ ID NO: 194799 - DNA, 35 bp, Artificial Sequence
  Synthetic oligonucleotide
gtggacgccgccccgagcctcatcaggttcaactc

SEQ ID NO: 194800 - DNA, 35 bp, Artificial Sequence
  Synthetic oligonucleotide
gttcatacccgtcggacttacatcttccccgactc

SEQ ID NO: 194801 - DNA, 35 bp, Artificial Sequence
  Synthetic oligonucleotide
atcaccgccacctatctgtctcggtccgaatactc

SEQ ID NO: 194802 - DNA, 35 bp, Artificial Sequence
  Synthetic oligonucleotide
tgcatccatggtcatcgctcgtgggagcccccctc

SEQ ID NO: 194803 - DNA, 34 bp, Artificial Sequence
  Synthetic oligonucleotide
tcagaaggttgtcattggtcacgctactcctctc

SEQ ID NO: 194804 - DNA, 35 bp, Artificial Sequence
  Synthetic oligonucleotide
tgcgtccggttctatcttgtgattcatttctggtc

SEQ ID NO: 194805 - DNA, 35 bp, Artificial Sequence
  Synthetic oligonucleotide
tgttccatttcacccgtggtttagcctgtacattc

SEQ ID NO: 194806 - DNA, 35 bp, Artificial Sequence
  Synthetic oligonucleotide
aaccgatttgccgtgcttcctgaacctgttcgttc

SEQ ID NO: 194807 - DNA, 34 bp, Artificial Sequence
  Synthetic oligonucleotide
gactcgatagcacctttgcgtaaaccccctgttc

SEQ ID NO: 194808 - DNA, 35 bp, Artificial Sequence
  Synthetic oligonucleotide
tcgtggcctcgggctcttcgttttgctccctgttc

SEQ ID NO: 194809 - DNA, 35 bp, Artificial Sequence
  Synthetic oligonucleotide
gtcctacccgtgcacagccttcttactgttgtttc

SEQ ID NO: 194810 - DNA, 35 bp, Artificial Sequence
  Synthetic oligonucleotide
tactgtcaccccggtccgtctttttcgtagttttc

SEQ ID NO: 194811 - DNA, 35 bp, Artificial Sequence
  Synthetic oligonucleotide
tagtcagagctgccgttaccgtttccttgccaaag

SEQ ID NO: 194812 - DNA, 35 bp, Artificial Sequence
  Synthetic oligonucleotide
ggagtgaaggatcggaatgggcaaggggtctaaag

SEQ ID NO: 194813 - DNA, 34 bp, Artificial Sequence
  Synthetic oligonucleotide
gtgccctgcccggctcatttccatatagacctag

SEQ ID NO: 194814 - DNA, 35 bp, Artificial Sequence
  Synthetic oligonucleotide
ttgaacggggagggaggaagaggaaattgatgtag

SEQ ID NO: 194815 - DNA, 35 bp, Artificial Sequence
  Synthetic oligonucleotide
ttacgcacctctgcccttttgttttgtatcacacg

SEQ ID NO: 194816 - DNA, 35 bp, Artificial Sequence
  Synthetic oligonucleotide
agaccctgcacgaagtgcttacctcacacgtaccg

SEQ ID NO: 194817 - DNA, 35 bp, Artificial Sequence
  Synthetic oligonucleotide
gtgctgcccgataaactaacttggatccacccccg

SEQ ID NO: 194818 - DNA, 35 bp, Artificial Sequence
  Synthetic oligonucleotide
ttacacgctggccccggtgcatcccccgacttccg

SEQ ID NO: 194819 - DNA, 35 bp, Artificial Sequence
  Synthetic oligonucleotide
tcttgccgccacatgtagctcgcttgtccccttcg

SEQ ID NO: 194820 - DNA, 35 bp, Artificial Sequence
  Synthetic oligonucleotide
tcgaagctcgccgcgctctcatatcacaccctggg

SEQ ID NO: 194821 - DNA, 35 bp, Artificial Sequence
  Synthetic oligonucleotide
acaaccctccgcaccaatggcctaatgattacctg

SEQ ID NO: 194822 - DNA, 36 bp, Artificial Sequence
  Synthetic oligonucleotide
tgaccactgcgtaagttttattgcgttctttccctg

SEQ ID NO: 194823 - DNA, 35 bp, Artificial Sequence
  Synthetic oligonucleotide
gtaagggtcgggggtggagggaatggtgcaccttg

SEQ ID NO: 194824 - DNA, 35 bp, Artificial Sequence
  Synthetic oligonucleotide
tttgtgcgctcattcctctgtcgtttcactctcat

SEQ ID NO: 194825 - DNA, 35 bp, Artificial Sequence
  Synthetic oligonucleotide
ggtccaccgggtgcactgatccagccattccacct

SEQ ID NO: 194826 - DNA, 35 bp, Artificial Sequence
  Synthetic oligonucleotide
gagctggccccttgtcttccgtatctctctggcct

SEQ ID NO: 194827 - DNA, 35 bp, Artificial Sequence
  Synthetic oligonucleotide
acacccttccgtccgacgttgctcccgcttttcct

SEQ ID NO: 194828 - DNA, 35 bp, Artificial Sequence
  Synthetic oligonucleotide
gagccgtcaattgaaccatgccctcccgctacgct

SEQ ID NO: 194829 - DNA, 35 bp, Artificial Sequence
  Synthetic oligonucleotide
ttggcgtgacgaagcctcaaaagtccgttccctct

SEQ ID NO: 194830 - DNA, 35 bp, Artificial Sequence
  Synthetic oligonucleotide
gccgattcgttcacctccgttgttcagcaccttct

SEQ ID NO: 194831 - DNA, 35 bp, Artificial Sequence
  Synthetic oligonucleotide
tacatagccccgtccgctctctgcctttcggccgt

SEQ ID NO: 194832 - DNA, 35 bp, Artificial Sequence
  Synthetic oligonucleotide
ttcaatcgtacgcacgacatcctcacctctctcgt

SEQ ID NO: 194833 - DNA, 35 bp, Artificial Sequence
  Synthetic oligonucleotide
tttgtgggcctcacttccgttttatctttccatgt

SEQ ID NO: 194834 - DNA, 35 bp, Artificial Sequence
  Synthetic oligonucleotide
gtggatagtgtgacggagggagaaggcatcagtgt

SEQ ID NO: 194835 - DNA, 35 bp, Artificial Sequence
  Synthetic oligonucleotide
gattgcacctgaaattatacgaccctccactcctt

SEQ ID NO: 194836 - DNA, 34 bp, Artificial Sequence
  Synthetic oligonucleotide
taaacccacggtcacctcttcatggacccttctt

SEQ ID NO: 194837 - DNA, 35 bp, Artificial Sequence
  Synthetic oligonucleotide
agcgaggtcggttcgccaagcccctcctattcgtt

SEQ ID NO: 194838 - DNA, 35 bp, Artificial Sequence
  Synthetic oligonucleotide
ttgtcacccctcggcctattaattctggacacttt

SEQ ID NO: 194839 - DNA, 35 bp, Artificial Sequence
  Synthetic oligonucleotide
ataactgtcgccacgctgtcctttgcgcaaccttt

SEQ ID NO: 194840 - DNA, 35 bp, Artificial Sequence
  Synthetic oligonucleotide
gacctggtctccacgatgtttctcccgttcccttt

SEQ ID NO: 194841 - DNA, 35 bp, Artificial Sequence
  Synthetic oligonucleotide
atggtccatcgccgcacggaaattatgccatcttt

SEQ ID NO: 194842 - DNA, 35 bp, Artificial Sequence
  Synthetic oligonucleotide
atgcgaccgcccgtaacgctgtcccaccctggttt

SEQ ID NO: 194843 - DNA, 35 bp, Artificial Sequence
  Synthetic oligonucleotide
gggtgggggggaagggatcgccattcaacgtgttt

SEQ ID NO: 194844 - DNA, 35 bp, Artificial Sequence
  Synthetic oligonucleotide
tcacccttccgtgctccacatttatagccaccaaa

SEQ ID NO: 194845 - DNA, 35 bp, Artificial Sequence
  Synthetic oligonucleotide
gcccccctccctgttctaggtagttcgccccccaa

SEQ ID NO: 194846 - DNA, 36 bp, Artificial Sequence
  Synthetic oligonucleotide
gtcactccctctggacttattcagtttacttgccaa

SEQ ID NO: 194847 - DNA, 36 bp, Artificial Sequence
  Synthetic oligonucleotide
gccagacttgccctgatctgctcacctgttcccgaa

SEQ ID NO: 194848 - DNA, 36 bp, Artificial Sequence
  Synthetic oligonucleotide
gccatgtccaactgccctgaacttctatatgctgaa

SEQ ID NO: 194849 - DNA, 35 bp, Artificial Sequence
  Synthetic oligonucleotide
tgctacccgtcctgtccttacagcgtcttcggtaa

SEQ ID NO: 194850 - DNA, 36 bp, Artificial Sequence
  Synthetic oligonucleotide
gccaacgtgcccacggattccgactgcttttctaca

SEQ ID NO: 194851 - DNA, 36 bp, Artificial Sequence
  Synthetic oligonucleotide
atgtccgctgccccccccgcaggtcagtctttacca

SEQ ID NO: 194852 - DNA, 36 bp, Artificial Sequence
  Synthetic oligonucleotide
tcgccattggcagccatctatcctcctcgggtccca

SEQ ID NO: 194853 - DNA, 36 bp, Artificial Sequence
  Synthetic oligonucleotide
tgcgtgacccgcatcctgactctatgactcgtgcca

SEQ ID NO: 194854 - DNA, 35 bp, Artificial Sequence
  Synthetic oligonucleotide
accgcccctccccgagccggcatatggacaacgca

SEQ ID NO: 194855 - DNA, 35 bp, Artificial Sequence
  Synthetic oligonucleotide
tcctcctcctctgtctgagtattgccatctctgca

SEQ ID NO: 194856 - DNA, 36 bp, Artificial Sequence
  Synthetic oligonucleotide
gccacgcagttagttcattgcgtccgtctccttgca

SEQ ID NO: 194857 - DNA, 35 bp, Artificial Sequence
  Synthetic oligonucleotide
tagaccaccgactggtggtgcactattcactatca

SEQ ID NO: 194858 - DNA, 36 bp, Artificial Sequence
  Synthetic oligonucleotide
atcgcctcaatgctaagcgtgccgtcccgctactca

SEQ ID NO: 194859 - DNA, 36 bp, Artificial Sequence
  Synthetic oligonucleotide
gcccccacccgttagtggtccgtcccaatctactca

SEQ ID NO: 194860 - DNA, 36 bp, Artificial Sequence
  Synthetic oligonucleotide
gcgcccccctcctagtcgcgtttagctgttagctca

SEQ ID NO: 194861 - DNA, 36 bp, Artificial Sequence
  Synthetic oligonucleotide
tcagactccgccgaggaaccgacactccgcctctca

SEQ ID NO: 194862 - DNA, 36 bp, Artificial Sequence
  Synthetic oligonucleotide
tggagaacgggtagggggggtctagagggtgtgtca

SEQ ID NO: 194863 - DNA, 36 bp, Artificial Sequence
  Synthetic oligonucleotide
agcacccgtgtagttgcctctgacctttccgcttca

SEQ ID NO: 194864 - DNA, 36 bp, Artificial Sequence
  Synthetic oligonucleotide
actatgccaccgttgacgttcttcctatctggttca

SEQ ID NO: 194865 - DNA, 37 bp, Artificial Sequence
  Synthetic oligonucleotide
gagacggtgggtaatggaggaggggtagggcctaaga

SEQ ID NO: 194866 - DNA, 36 bp, Artificial Sequence
  Synthetic oligonucleotide
ggatgaacggcgagaaggggatgagaggagctaaga

SEQ ID NO: 194867 - DNA, 37 bp, Artificial Sequence
  Synthetic oligonucleotide
actggggctgagggagcgtgtggaagggattgtcaga

SEQ ID NO: 194868 - DNA, 37 bp, Artificial Sequence
  Synthetic oligonucleotide
ggacggggggtgggaggggcaggacagagtcctgaga

SEQ ID NO: 194869 - DNA, 36 bp, Artificial Sequence
  Synthetic oligonucleotide
taccgctcccacctggttatccacacgtcccaccga

SEQ ID NO: 194870 - DNA, 35 bp, Artificial Sequence
  Synthetic oligonucleotide
gaacaggtacacgatctgttcccccttattaccga

SEQ ID NO: 194871 - DNA, 35 bp, Artificial Sequence
  Synthetic oligonucleotide
aacgcgtcctaaccggcattacgtatcctccccga

SEQ ID NO: 194872 - DNA, 37 bp, Artificial Sequence
  Synthetic oligonucleotide
gacatcggccacatctatcgccgaccccgaccgccga

SEQ ID NO: 194873 - DNA, 36 bp, Artificial Sequence
  Synthetic oligonucleotide
acagtgtgtcacgattctcgccctgagctttgccga

SEQ ID NO: 194874 - DNA, 37 bp, Artificial Sequence
  Synthetic oligonucleotide
tcacgtaagatcgggtccatactcgtacctcctccga

SEQ ID NO: 194875 - DNA, 37 bp, Artificial Sequence
  Synthetic oligonucleotide
aacgaagaggaggagcggaagagacgaactccatcga

SEQ ID NO: 194876 - DNA, 37 bp, Artificial Sequence
  Synthetic oligonucleotide
gtgatgtgtaaccaccatccctccctctcaggatcga

SEQ ID NO: 194877 - DNA, 37 bp, Artificial Sequence
  Synthetic oligonucleotide
aattggggcgggggggtgtagggtgatcgctgctcga

SEQ ID NO: 194878 - DNA, 37 bp, Artificial Sequence
  Synthetic oligonucleotide
atccaggtcaggaggggcaaaggagggtgaaaaagga

SEQ ID NO: 194879 - DNA, 35 bp, Artificial Sequence
  Synthetic oligonucleotide
gacgcgcccgactgaccctatcccgcttgcaagga

SEQ ID NO: 194880 - DNA, 37 bp, Artificial Sequence
  Synthetic oligonucleotide
taaggggacacaggggcgagggacggatgacgcggga

SEQ ID NO: 194881 - DNA, 36 bp, Artificial Sequence
  Synthetic oligonucleotide
gggggacagttcggggtagagagttacggggcggga

SEQ ID NO: 194882 - DNA, 37 bp, Artificial Sequence
  Synthetic oligonucleotide
ggaggggcgagatgtcgtgggggtggctcatagggga

SEQ ID NO: 194883 - DNA, 37 bp, Artificial Sequence
  Synthetic oligonucleotide
gtgagacgggagacggcatcaagacggacgaggggga

SEQ ID NO: 194884 - DNA, 38 bp, Artificial Sequence
  Synthetic oligonucleotide
tgagtgcggagggaggggggtggatttggacggtatga

SEQ ID NO: 194885 - DNA, 38 bp, Artificial Sequence
  Synthetic oligonucleotide
tgtcacggcggacccccgtgctaggccttctccactga

SEQ ID NO: 194886 - DNA, 37 bp, Artificial Sequence
  Synthetic oligonucleotide
atgcatgccctggtctaccgccattgttcctcactga

SEQ ID NO: 194887 - DNA, 37 bp, Artificial Sequence
  Synthetic oligonucleotide
gcaccgcctcgttctttaatggcttcattgtacctga

SEQ ID NO: 194888 - DNA, 38 bp, Artificial Sequence
  Synthetic oligonucleotide
tatgccgtcctccatcgcctcacccggtactaccctga

SEQ ID NO: 194889 - DNA, 36 bp, Artificial Sequence
  Synthetic oligonucleotide
tcgagcgctgccctctcgttgcttttctggccctga

SEQ ID NO: 194890 - DNA, 37 bp, Artificial Sequence
  Synthetic oligonucleotide
gcgaaagggggaggccgggggtgaacaatacgtgtga

SEQ ID NO: 194891 - DNA, 36 bp, Artificial Sequence
  Synthetic oligonucleotide
tccccaccggccctctttgcctgctcaactaattga

SEQ ID NO: 194892 - DNA, 38 bp, Artificial Sequence
  Synthetic oligonucleotide
gttgcccgcgctcccatgttaccggtaccacccattga

SEQ ID NO: 194893 - DNA, 37 bp, Artificial Sequence
  Synthetic oligonucleotide
ttgctccacaccgcacataacgcctctgtactcttga

SEQ ID NO: 194894 - DNA, 37 bp, Artificial Sequence
  Synthetic oligonucleotide
gagccgcctcgctcctctctcaagttctcagctttga

SEQ ID NO: 194895 - DNA, 36 bp, Artificial Sequence
  Synthetic oligonucleotide
gcagatgaggcggaatgcggtgggggggacgtgata

SEQ ID NO: 194896 - DNA, 36 bp, Artificial Sequence
  Synthetic oligonucleotide
aacacccgtcgactccgttccaagctccccgtccta

SEQ ID NO: 194897 - DNA, 36 bp, Artificial Sequence
  Synthetic oligonucleotide
actcacccacgccctatgaaatccggtcattcgcta

SEQ ID NO: 194898 - DNA, 36 bp, Artificial Sequence
  Synthetic oligonucleotide
gcatgagggaaggggggaggacaggtggagcgagta

SEQ ID NO: 194899 - DNA, 36 bp, Artificial Sequence
  Synthetic oligonucleotide
ggtctaaggcggacagtggggggaaggagaagcgta

SEQ ID NO: 194900 - DNA, 35 bp, Artificial Sequence
  Synthetic oligonucleotide
gaccgcaatttgatcatatccactcgcccttcgta

SEQ ID NO: 194901 - DNA, 36 bp, Artificial Sequence
  Synthetic oligonucleotide
gtacaaagtgaggggtgcaaggcaggaagaagggta

SEQ ID NO: 194902 - DNA, 36 bp, Artificial Sequence
  Synthetic oligonucleotide
gccgccactagtttcgtcctttcctttcgcttggta

SEQ ID NO: 194903 - DNA, 36 bp, Artificial Sequence
  Synthetic oligonucleotide
tgcactaccccgcagtgtcccacgaacctacatgta

SEQ ID NO: 194904 - DNA, 36 bp, Artificial Sequence
  Synthetic oligonucleotide
ttccggttgcctactcgttcgttcttgtcgccatta

SEQ ID NO: 194905 - DNA, 35 bp, Artificial Sequence
  Synthetic oligonucleotide
tgacaccaggcctcgcacatccacacacgacctta

SEQ ID NO: 194906 - DNA, 34 bp, Artificial Sequence
  Synthetic oligonucleotide
aaggggggggccgggatgggctgcggagccgtta

SEQ ID NO: 194907 - DNA, 35 bp, Artificial Sequence
  Synthetic oligonucleotide
taaccgtggagaggcgggcggggcgataggtaaac

SEQ ID NO: 194908 - DNA, 35 bp, Artificial Sequence
  Synthetic oligonucleotide
tacgcacctagagctcatttcgcctggtcccacac

SEQ ID NO: 194909 - DNA, 35 bp, Artificial Sequence
  Synthetic oligonucleotide
tcccgcctcggctcgctggttttattccaagccac

SEQ ID NO: 194910 - DNA, 35 bp, Artificial Sequence
  Synthetic oligonucleotide
taccgcattcaccggctttggtcttgaacttccac

SEQ ID NO: 194911 - DNA, 35 bp, Artificial Sequence
  Synthetic oligonucleotide
agatcgggtcctgccatcaactccctggtcgctac

SEQ ID NO: 194912 - DNA, 35 bp, Artificial Sequence
  Synthetic oligonucleotide
tgcacgtgttcggcatctgacactcactggccacc

SEQ ID NO: 194913 - DNA, 35 bp, Artificial Sequence
  Synthetic oligonucleotide
gtgtggtcagagtccgctacttagagtgccccccc

SEQ ID NO: 194914 - DNA, 35 bp, Artificial Sequence
  Synthetic oligonucleotide
atgtcacccccgaagtgttgatgtgctgtcatccc

SEQ ID NO: 194915 - DNA, 35 bp, Artificial Sequence
  Synthetic oligonucleotide
tgcatacaggatgtatcgtgcccgttgcccttccc

SEQ ID NO: 194916 - DNA, 35 bp, Artificial Sequence
  Synthetic oligonucleotide
acgcaccccactgtcgcgcctacagacccgcagcc

SEQ ID NO: 194917 - DNA, 35 bp, Artificial Sequence
  Synthetic oligonucleotide
tatatctgtcgcccatcttgatcgattctacatcc

SEQ ID NO: 194918 - DNA, 34 bp, Artificial Sequence
  Synthetic oligonucleotide
gcatcccaatcaatgagtccttgcacaccgatcc

SEQ ID NO: 194919 - DNA, 35 bp, Artificial Sequence
  Synthetic oligonucleotide
tacgccgcccagttggtttccgtcgccacgtctcc

SEQ ID NO: 194920 - DNA, 35 bp, Artificial Sequence
  Synthetic oligonucleotide
agccagagtgagtggttctccttgctctccggtcc

SEQ ID NO: 194921 - DNA, 35 bp, Artificial Sequence
  Synthetic oligonucleotide
tctatggcacggtgatgtcaccattcccctcttcc

SEQ ID NO: 194922 - DNA, 35 bp, Artificial Sequence
  Synthetic oligonucleotide
ttgtcaccccgcctcccaagccagagggcttttcc

SEQ ID NO: 194923 - DNA, 35 bp, Artificial Sequence
  Synthetic oligonucleotide
gcgacatgacctattcaccacccgccgcttgcagc

SEQ ID NO: 194924 - DNA, 35 bp, Artificial Sequence
  Synthetic oligonucleotide
ttgaccccccccaattgtttcttgcgttgtaccgc

SEQ ID NO: 194925 - DNA, 35 bp, Artificial Sequence
  Synthetic oligonucleotide
tacaccttgttcgctttgaagtttgctagatccgc

SEQ ID NO: 194926 - DNA, 35 bp, Artificial Sequence
  Synthetic oligonucleotide
tgaaccgcatcatcgcccgccccatttatgtgcgc

SEQ ID NO: 194927 - DNA, 35 bp, Artificial Sequence
  Synthetic oligonucleotide
gtggacacgggggaaagtggaggaggatcagtcgc

SEQ ID NO: 194928 - DNA, 35 bp, Artificial Sequence
  Synthetic oligonucleotide
acacctgcgtggcaatagcgccattatcctcctgc

SEQ ID NO: 194929 - DNA, 35 bp, Artificial Sequence
  Synthetic oligonucleotide
tacgcctgtctcgattcgcgtcgttatttccactc

SEQ ID NO: 194930 - DNA, 35 bp, Artificial Sequence
  Synthetic oligonucleotide
tagacgtttgccgcctgctgtgcactcactgcctc

SEQ ID NO: 194931 - DNA, 34 bp, Artificial Sequence
  Synthetic oligonucleotide
ggacaatctcatagtgtctttgtccctttctctc

SEQ ID NO: 194932 - DNA, 35 bp, Artificial Sequence
  Synthetic oligonucleotide
tgcgcaccctctgcacccggttcactcccatcgtc

SEQ ID NO: 194933 - DNA, 35 bp, Artificial Sequence
  Synthetic oligonucleotide
gtgggacttctgtcagactctgtcctttcttcgtc

SEQ ID NO: 194934 - DNA, 35 bp, Artificial Sequence
  Synthetic oligonucleotide
aacacgtccactccaacgcctcgacatcctgggtc

SEQ ID NO: 194935 - DNA, 35 bp, Artificial Sequence
  Synthetic oligonucleotide
acagtgtcaaaacgaagccacgcccatcctctgtc

SEQ ID NO: 194936 - DNA, 35 bp, Artificial Sequence
  Synthetic oligonucleotide
accacaccgctgtggtcccatatttaaatacattc

SEQ ID NO: 194937 - DNA, 35 bp, Artificial Sequence
  Synthetic oligonucleotide
aagtgcgtagcaactctgttatcacgctgcccttc

SEQ ID NO: 194938 - DNA, 35 bp, Artificial Sequence
  Synthetic oligonucleotide
gtctctcacctgctattatgccacagccctccttc

SEQ ID NO: 194939 - DNA, 35 bp, Artificial Sequence
  Synthetic oligonucleotide
gaagcccccgtccgctccacgaattgccactgttc

SEQ ID NO: 194940 - DNA, 35 bp, Artificial Sequence
  Synthetic oligonucleotide
atcccaacagccgggagtaccgcgcaatacctttc

SEQ ID NO: 194941 - DNA, 35 bp, Artificial Sequence
  Synthetic oligonucleotide
acagaccggtcaccagccttccttcatgaggtttc

SEQ ID NO: 194942 - DNA, 35 bp, Artificial Sequence
  Synthetic oligonucleotide
acttcgcccgtatttcctgaggcacgtcccttttc

SEQ ID NO: 194943 - DNA, 34 bp, Artificial Sequence
  Synthetic oligonucleotide
gcctcagcctgtttcctccttccacgatcttttc

SEQ ID NO: 194944 - DNA, 35 bp, Artificial Sequence
  Synthetic oligonucleotide
tgcatcccaaccggtagtgcgacccctttcttttc

SEQ ID NO: 194945 - DNA, 35 bp, Artificial Sequence
  Synthetic oligonucleotide
tctgggctggggggggcaagacgggacatccaacg

SEQ ID NO: 194946 - DNA, 35 bp, Artificial Sequence
  Synthetic oligonucleotide
actgacctcgcccccggaattactcgctttacacg

SEQ ID NO: 194947 - DNA, 35 bp, Artificial Sequence
  Synthetic oligonucleotide
acacgtccactacatcacctgcctggtcacttccg

SEQ ID NO: 194948 - DNA, 35 bp, Artificial Sequence
  Synthetic oligonucleotide
gataacacaaggaatgttgaaaagggaggtgggcg

SEQ ID NO: 194949 - DNA, 35 bp, Artificial Sequence
  Synthetic oligonucleotide
atgtggccacatacactacaccaccgtttatttcg

SEQ ID NO: 194950 - DNA, 35 bp, Artificial Sequence
  Synthetic oligonucleotide
atgttgcctaagggggtagaaatggggggaggagg

SEQ ID NO: 194951 - DNA, 35 bp, Artificial Sequence
  Synthetic oligonucleotide
tagcgggggaccaccgggggtcgaaagggaacggg

SEQ ID NO: 194952 - DNA, 35 bp, Artificial Sequence
  Synthetic oligonucleotide
atagcgcaagaaagaagcgaaggagggtaggtggg

SEQ ID NO: 194953 - DNA, 35 bp, Artificial Sequence
  Synthetic oligonucleotide
attgatagggggtgaagtaaagggaagggacactg

SEQ ID NO: 194954 - DNA, 35 bp, Artificial Sequence
  Synthetic oligonucleotide
accgggccgccctctctgttggtcacctcccactg

SEQ ID NO: 194955 - DNA, 35 bp, Artificial Sequence
  Synthetic oligonucleotide
aagctgagcaagctataaaatcccctgtccccctg

SEQ ID NO: 194956 - DNA, 35 bp, Artificial Sequence
  Synthetic oligonucleotide
tagcgtgccccgaaatactcttggtccttgccctg

SEQ ID NO: 194957 - DNA, 35 bp, Artificial Sequence
  Synthetic oligonucleotide
ttgagaccgtcatgatgtttgtcccatggttcctg

SEQ ID NO: 194958 - DNA, 35 bp, Artificial Sequence; identical to SEQ ID NO: 14731
  Synthetic oligonucleotide

SEQ ID NO: 194959 - DNA, 35 bp, Artificial Sequence
  Synthetic oligonucleotide
gttgcgccccctggcctcttttcaaacgctacaat

SEQ ID NO: 194960 - DNA, 35 bp, Artificial Sequence
  Synthetic oligonucleotide
tgccacccactggtaatatactcaacaccacccat

SEQ ID NO: 194961 - DNA, 35 bp, Artificial Sequence
  Synthetic oligonucleotide
atcaaggcgtcaaccgctcattgtccctctttgat

SEQ ID NO: 194962 - DNA, 35 bp, Artificial Sequence
  Synthetic oligonucleotide
gggggacaatcgggctaggggggtacagagggtat

SEQ ID NO: 194963 - DNA, 35 bp, Artificial Sequence
  Synthetic oligonucleotide
gcccccgtcgcacttgctcgccatcgtttcttcct

SEQ ID NO: 194964 - DNA, 35 bp, Artificial Sequence
  Synthetic oligonucleotide
tgcaggggtgaagggcacaaagggatggggaagct

SEQ ID NO: 194965 - DNA, 35 bp, Artificial Sequence
  Synthetic oligonucleotide
gcccgttcctgtcctgtagtatacttgccccatct

SEQ ID NO: 194966 - DNA, 35 bp, Artificial Sequence
  Synthetic oligonucleotide
gacacgccactgcatgctgccgtggttatccctct

SEQ ID NO: 194967 - DNA, 35 bp, Artificial Sequence
  Synthetic oligonucleotide
ttcgccgccgtaacccctgatgcgctgtcttctct

SEQ ID NO: 194968 - DNA, 35 bp, Artificial Sequence
  Synthetic oligonucleotide
gaatcgcgtgccatgcctattggtttcactgttct

SEQ ID NO: 194969 - DNA, 35 bp, Artificial Sequence
  Synthetic oligonucleotide
atgtcctgccgcttacccgatcccgccttcctagt

SEQ ID NO: 194970 - DNA, 35 bp, Artificial Sequence
  Synthetic oligonucleotide
gtcgcgttctgtaccctcgccacatgagtccctgt

SEQ ID NO: 194971 - DNA, 35 bp, Artificial Sequence
  Synthetic oligonucleotide
tagcccaacgctgccttctagaatcaacaccttgt

SEQ ID NO: 194972 - DNA, 35 bp, Artificial Sequence
  Synthetic oligonucleotide
gaacatgcgaaatcctgcttagtcgcgataccctt

SEQ ID NO: 194973 - DNA, 35 bp, Artificial Sequence
  Synthetic oligonucleotide
tgggccatccatctacctgctacgcttgggccctt

SEQ ID NO: 194974 - DNA, 35 bp, Artificial Sequence
  Synthetic oligonucleotide
accatggccaacgcccaccgagccttccgtgtctt

SEQ ID NO: 194975 - DNA, 35 bp, Artificial Sequence
  Synthetic oligonucleotide
atcgcacaccaaatcgaaaccagccttctctcgtt

SEQ ID NO: 194976 - DNA, 35 bp, Artificial Sequence
  Synthetic oligonucleotide
ggagtgcaatggggggcgggttgacaggtagggtt

SEQ ID NO: 194977 - DNA, 35 bp, Artificial Sequence
  Synthetic oligonucleotide
tacacgctctcatctctctcaccgttgtgcccaaa

SEQ ID NO: 194978 - DNA, 36 bp, Artificial Sequence
  Synthetic oligonucleotide
gtcacagcagttgggagctggagcaggggggagcaa

SEQ ID NO: 194979 - DNA, 36 bp, Artificial Sequence
  Synthetic oligonucleotide
tagccatcccctgcatcccgtatattgctatgcgaa

SEQ ID NO: 194980 - DNA, 36 bp, Artificial Sequence
  Synthetic oligonucleotide
taccttccgggggggggtaaaatgctggggagggaa

SEQ ID NO: 194981 - DNA, 36 bp, Artificial Sequence
  Synthetic oligonucleotide
aacgtcgtcccacccgttctaatccgccgtgcaaca

SEQ ID NO: 194982 - DNA, 36 bp, Artificial Sequence
  Synthetic oligonucleotide
ggtggtgtggatggcggggtgggttaaggttagaca

SEQ ID NO: 194983 - DNA, 36 bp, Artificial Sequence
  Synthetic oligonucleotide
agcacggctcatcgcagctgtcacatctacccccca

SEQ ID NO: 194984 - DNA, 35 bp, Artificial Sequence
  Synthetic oligonucleotide
gtctcatacagctcgtcttcctctggctctttcca

SEQ ID NO: 194985 - DNA, 36 bp, Artificial Sequence
  Synthetic oligonucleotide
tgaacccagcccttgccatacggagtttcgtttcca

SEQ ID NO: 194986 - DNA, 36 bp, Artificial Sequence
  Synthetic oligonucleotide
aacgcccgccccctccgccatttagacacgtgagca

SEQ ID NO: 194987 - DNA, 36 bp, Artificial Sequence
  Synthetic oligonucleotide
tgcgcactcctgcatttcgttccttcggggctcgca

SEQ ID NO: 194988 - DNA, 36 bp, Artificial Sequence
  Synthetic oligonucleotide
tgcgcacatctcgtcgtaatgccccaccactgtgca

SEQ ID NO: 194989 - DNA, 36 bp, Artificial Sequence
  Synthetic oligonucleotide
gagtcactcctatctgccttcaccgggtccattgca

SEQ ID NO: 194990 - DNA, 36 bp, Artificial Sequence
  Synthetic oligonucleotide
tatcccgctgggcccctgactttcttatactgctca

SEQ ID NO: 194991 - DNA, 36 bp, Artificial Sequence
  Synthetic oligonucleotide
acctgcgtctccttgtcctgcctggatcacctctca

SEQ ID NO: 194992 - DNA, 35 bp, Artificial Sequence
  Synthetic oligonucleotide
gctcgtccaagtctttttcgcgccatgccacttca

SEQ ID NO: 194993 - DNA, 36 bp, Artificial Sequence
  Synthetic oligonucleotide
gccattgcgtgctttggcctttcgattactttttca

SEQ ID NO: 194994 - DNA, 37 bp, Artificial Sequence
  Synthetic oligonucleotide
gaagtgcaaagtggaaggggggtagtctcatggaaga

SEQ ID NO: 194995 - DNA, 36 bp, Artificial Sequence
  Synthetic oligonucleotide
ggaccatccccgccccttcagatcaggcttagcaga

SEQ ID NO: 194996 - DNA, 36 bp, Artificial Sequence
  Synthetic oligonucleotide
gtcacatgaattgatcgggattgggacggggggaga

SEQ ID NO: 194997 - DNA, 37 bp, Artificial Sequence
  Synthetic oligonucleotide
tggacctgcttgatgcgtgctcacctccatcccccga

SEQ ID NO: 194998 - DNA, 37 bp, Artificial Sequence
  Synthetic oligonucleotide
tccccacccctgcttaagagtactcgtcgctgcccga

SEQ ID NO: 194999 - DNA, 37 bp, Artificial Sequence
  Synthetic oligonucleotide
gtgtgtcgccccattcagtttccagcatcattcccga

SEQ ID NO: 195000 - DNA, 37 bp, Artificial Sequence
  Synthetic oligonucleotide
gagcaagaaggggtccgggaacgaggatggggcgcga

SEQ ID NO: 195001 - DNA, 37 bp, Artificial Sequence
  Synthetic oligonucleotide
gagaagtaaaaaggtacggaggagaggcgaagtagga

SEQ ID NO: 195002 - DNA, 36 bp, Artificial Sequence
  Synthetic oligonucleotide
gtggattaatcggggggggagtaagaccgggtagga

SEQ ID NO: 195003 - DNA, 37 bp, Artificial Sequence
  Synthetic oligonucleotide
ttgcaccaccaccaaacctctatcatcgctgttcgga

SEQ ID NO: 195004 - DNA, 37 bp, Artificial Sequence
  Synthetic oligonucleotide
ggacggggggagttagaaaggggggctgagagaggga

SEQ ID NO: 195005 - DNA, 37 bp, Artificial Sequence
  Synthetic oligonucleotide
gaagggacaggtgtatattaaataaggggggagggga

SEQ ID NO: 195006 - DNA, 37 bp, Artificial Sequence
  Synthetic oligonucleotide
acacgctgagacaggtagagggtgcgtgagaggggga

SEQ ID NO: 195007 - DNA, 37 bp, Artificial Sequence
  Synthetic oligonucleotide
tgccacggggaaccaataaggagggtacgggtgggga

SEQ ID NO: 195008 - DNA, 37 bp, Artificial Sequence
  Synthetic oligonucleotide
ggtaggagaagagggggtgcaaaggtgaggagtggga

SEQ ID NO: 195009 - DNA, 37 bp, Artificial Sequence
  Synthetic oligonucleotide
ttcggacggctcactgccctcttacactcgtcttgga

SEQ ID NO: 195010 - DNA, 37 bp, Artificial Sequence
  Synthetic oligonucleotide
tgaggggcgggggggagaacgggtcagggtaatatga

SEQ ID NO: 195011 - DNA, 38 bp, Artificial Sequence
  Synthetic oligonucleotide
tgacgcacgggggagagtaggaaagggtggctatatga

SEQ ID NO: 195012 - DNA, 38 bp, Artificial Sequence
  Synthetic oligonucleotide
tagcaccgccttactagccttttcgtgccactacctga

SEQ ID NO: 195013 - DNA, 38 bp, Artificial Sequence
  Synthetic oligonucleotide
gttgcacctttacgctcctatacagcctctcttcctga

SEQ ID NO: 195014 - DNA, 34 bp, Artificial Sequence
  Synthetic oligonucleotide
tcctccccttgtgtcgttcactccccctaggtga

SEQ ID NO: 195015 - DNA, 37 bp, Artificial Sequence
  Synthetic oligonucleotide
tcacggtcgaggaggcgtggggggagtaaagcggtga

SEQ ID NO: 195016 - DNA, 38 bp, Artificial Sequence
  Synthetic oligonucleotide
tttgccgtactgcaccttctaattcggtccctcggtga

SEQ ID NO: 195017 - DNA, 38 bp, Artificial Sequence
  Synthetic oligonucleotide
gaagcaagagggggggagacgtgagtgcgggtgtgtga

SEQ ID NO: 195018 - DNA, 36 bp, Artificial Sequence
  Synthetic oligonucleotide
gacacccccacgatcggccctttcctctagagaata

SEQ ID NO: 195019 - DNA, 35 bp, Artificial Sequence
  Synthetic oligonucleotide
atgcaggcctccgttgcccccgcctcgtccacata

SEQ ID NO: 195020 - DNA, 35 bp, Artificial Sequence
  Synthetic oligonucleotide
atgccgaacgttgccgccctacagaactctccata

SEQ ID NO: 195021 - DNA, 35 bp, Artificial Sequence
  Synthetic oligonucleotide
tactcgcgaccatccctctccgcataattgtcata

SEQ ID NO: 195022 - DNA, 36 bp, Artificial Sequence
  Synthetic oligonucleotide
gcctgccacattcgcactcgctaaccgtatcctata

SEQ ID NO: 195023 - DNA, 36 bp, Artificial Sequence
  Synthetic oligonucleotide
gggtaccatgccacagtcattatcccacgacctcta

SEQ ID NO: 195024 - DNA, 35 bp, Artificial Sequence
  Synthetic oligonucleotide
aacactgcctcgctttgatccaccttccctgtaac

SEQ ID NO: 195025 - DNA, 35 bp, Artificial Sequence
  Synthetic oligonucleotide
ttgtcactcgtcccaccggcctatttttgctgtac

SEQ ID NO: 195026 - DNA, 35 bp, Artificial Sequence
  Synthetic oligonucleotide
tcgtgcttcaaccctcctgtcgtattgccccttac

SEQ ID NO: 195027 - DNA, 35 bp, Artificial Sequence
  Synthetic oligonucleotide
ggacgcccaactgatcgcgcctgctcctcccttac

SEQ ID NO: 195028 - DNA, 35 bp, Artificial Sequence
  Synthetic oligonucleotide
gccacatgttctcgacttgatcctgcactgcttac

SEQ ID NO: 195029 - DNA, 35 bp, Artificial Sequence
  Synthetic oligonucleotide
taaccccattccgccgtttcataccgtagggaacc

SEQ ID NO: 195030 - DNA, 35 bp, Artificial Sequence
  Synthetic oligonucleotide
actgtaccgtcccccttgcccgtcattgttccacc

SEQ ID NO: 195031 - DNA, 35 bp, Artificial Sequence
  Synthetic oligonucleotide
gtcctccacctgtagctcagggcccacgctacccc

SEQ ID NO: 195032 - DNA, 35 bp, Artificial Sequence
  Synthetic oligonucleotide
tgggccgattggtctctccgccacgactccgcccc

SEQ ID NO: 195033 - DNA, 34 bp, Artificial Sequence
  Synthetic oligonucleotide
gacgcggttgtcgcacctttcacaatcttaagcc

SEQ ID NO: 195034 - DNA, 35 bp, Artificial Sequence
  Synthetic oligonucleotide
atcacgcgccacctgattcagcctccgtcctagcc

SEQ ID NO: 195035 - DNA, 35 bp, Artificial Sequence
  Synthetic oligonucleotide
gattcgccatgcaccgtttagtcgctggatcctcc

SEQ ID NO: 195036 - DNA, 35 bp, Artificial Sequence
  Synthetic oligonucleotide
tccgccgcggctcccgaagccccattatgtcgtcc

SEQ ID NO: 195037 - DNA, 35 bp, Artificial Sequence
  Synthetic oligonucleotide
ggacccacggccccatgtttttggcctccaattcc

SEQ ID NO: 195038 - DNA, 35 bp, Artificial Sequence
  Synthetic oligonucleotide
tgtgaacgtcaggatcatccttcttcccttattcc

SEQ ID NO: 195039 - DNA, 35 bp, Artificial Sequence
  Synthetic oligonucleotide
gccatacgcactatcgtaattacctccacagaagc

SEQ ID NO: 195040 - DNA, 35 bp, Artificial Sequence
  Synthetic oligonucleotide
gcaatcacccggggctaggatagggagggatgggc

SEQ ID NO: 195041 - DNA, 35 bp, Artificial Sequence
  Synthetic oligonucleotide
gtcccctacccaggagtgtaaaacccgccatctgc

SEQ ID NO: 195042 - DNA, 35 bp, Artificial Sequence
  Synthetic oligonucleotide
atgcaacccatttcgcgccttgccatgttctctgc

SEQ ID NO: 195043 - DNA, 35 bp, Artificial Sequence
  Synthetic oligonucleotide
atcgctactgcccaacatcctggagcccacgaatc

SEQ ID NO: 195044 - DNA, 34 bp, Artificial Sequence
  Synthetic oligonucleotide
gccggtctccgcaacgagaagttgccgttccatc

SEQ ID NO: 195045 - DNA, 35 bp, Artificial Sequence
  Synthetic oligonucleotide
gcactgccaccatgacgcctagatcgcgctttatc

SEQ ID NO: 195046 - DNA, 35 bp, Artificial Sequence
  Synthetic oligonucleotide
agcccatgcctccattattctcggttacctgactc

SEQ ID NO: 195047 - DNA, 35 bp, Artificial Sequence
  Synthetic oligonucleotide
tgactccccctccgatgtctgtctttcacccgctc

SEQ ID NO: 195048 - DNA, 35 bp, Artificial Sequence
  Synthetic oligonucleotide
gtcatcccaggctttcttcttgtccaggacaagtc

SEQ ID NO: 195049 - DNA, 35 bp, Artificial Sequence
  Synthetic oligonucleotide
gcgaacgttttttgtaaccgccctccccgattgtc

SEQ ID NO: 195050 - DNA, 35 bp, Artificial Sequence
  Synthetic oligonucleotide
tgcccttgcctccactttctcgtgataccgttgtc

SEQ ID NO: 195051 - DNA, 35 bp, Artificial Sequence
  Synthetic oligonucleotide
gcgggatgggacggggggggagtgaggaatacaag

SEQ ID NO: 195052 - DNA, 35 bp, Artificial Sequence
  Synthetic oligonucleotide
gtgagcaatggggggagggcacttgatgggatgag

SEQ ID NO: 195053 - DNA, 35 bp, Artificial Sequence
  Synthetic oligonucleotide
gcctgtcctgcactttccagctcgtttcgctaacg

SEQ ID NO: 195054 - DNA, 35 bp, Artificial Sequence
  Synthetic oligonucleotide
tcccaccgccccatctttgcatatgcactgccacg

SEQ ID NO: 195055 - DNA, 35 bp, Artificial Sequence
  Synthetic oligonucleotide
accagcccatccatttcatttagccatagcggacg

SEQ ID NO: 195056 - DNA, 35 bp, Artificial Sequence
  Synthetic oligonucleotide
attcgccgctcctaggctctttaacttatccttcg

SEQ ID NO: 195057 - DNA, 35 bp, Artificial Sequence
  Synthetic oligonucleotide
acctcgttacgccagcccgttttctcccccgttcg

SEQ ID NO: 195058 - DNA, 35 bp, Artificial Sequence
  Synthetic oligonucleotide
gccccacgccaccgtttccccttcaccacctgggg

SEQ ID NO: 195059 - DNA, 35 bp, Artificial Sequence
  Synthetic oligonucleotide
gggagggtcgggaggggctgtatagctagactggg

SEQ ID NO: 195060 - DNA, 35 bp, Artificial Sequence
  Synthetic oligonucleotide
gtcgacacccctgctatcaccccatcctagaactg

SEQ ID NO: 195061 - DNA, 35 bp, Artificial Sequence
  Synthetic oligonucleotide
gaagcacgttgcgtgcttgatctctactccccctg

SEQ ID NO: 195062 - DNA, 35 bp, Artificial Sequence
  Synthetic oligonucleotide
gtgggccgaccgccgcttagcatattacacccttg

SEQ ID NO: 195063 - DNA, 35 bp, Artificial Sequence
  Synthetic oligonucleotide
tctgcgccccctcggtcttctcgcaaagaattttg

SEQ ID NO: 195064 - DNA, 35 bp, Artificial Sequence
  Synthetic oligonucleotide
ttgcctttcccatgctctatgttgacccccgcaat

SEQ ID NO: 195065 - DNA, 35 bp, Artificial Sequence
  Synthetic oligonucleotide
gccaacagcggtcacctgaatctctgccgccccat

SEQ ID NO: 195066 - DNA, 35 bp, Artificial Sequence
  Synthetic oligonucleotide
tatcctgtcccgccaatgtcccggctcctagaact

SEQ ID NO: 195067 - DNA, 35 bp, Artificial Sequence
  Synthetic oligonucleotide
acgaggccccatctgagccccctgttctatgacct

SEQ ID NO: 195068 - DNA, 35 bp, Artificial Sequence
  Synthetic oligonucleotide
ttcagtctccccagctttgcatctcttcggtacct

SEQ ID NO: 195069 - DNA, 35 bp, Artificial Sequence
  Synthetic oligonucleotide
gactgccgacgtccgtctccgtgcccttcgtgcct

SEQ ID NO: 195070 - DNA, 35 bp, Artificial Sequence
  Synthetic oligonucleotide
tagtgctaggtcacctgccgccactgcgtcctcct

SEQ ID NO: 195071 - DNA, 35 bp, Artificial Sequence
  Synthetic oligonucleotide
gtttggagggcgtttcagccgggtccatccttcct

SEQ ID NO: 195072 - DNA, 35 bp, Artificial Sequence
  Synthetic oligonucleotide
tgaccaactgctctcttcccactctcactgatgct

SEQ ID NO: 195073 - DNA, 35 bp, Artificial Sequence
  Synthetic oligonucleotide
gtaccatcaaacggtatatgctctcccgaaccagt

SEQ ID NO: 195074 - DNA, 35 bp, Artificial Sequence
  Synthetic oligonucleotide
acccgccgccctcagggagcaattagccccttcgt

SEQ ID NO: 195075 - DNA, 34 bp, Artificial Sequence
  Synthetic oligonucleotide
gtccacgccgccgcatataacacgtctctccggt

SEQ ID NO: 195076 - DNA, 35 bp, Artificial Sequence
  Synthetic oligonucleotide
gccacccccgggattccggaccgatctacactggt

SEQ ID NO: 195077 - DNA, 35 bp, Artificial Sequence
  Synthetic oligonucleotide
gcccatctatcgtgcgccccctggtgctatccatt

SEQ ID NO: 195078 - DNA, 35 bp, Artificial Sequence
  Synthetic oligonucleotide
tacgtcactcatctgttttcgctgccccgtttatt

SEQ ID NO: 195079 - DNA, 35 bp, Artificial Sequence
  Synthetic oligonucleotide
gtcatgtcgctgtccctgtcccggtggctatactt

SEQ ID NO: 195080 - DNA, 35 bp, Artificial Sequence
  Synthetic oligonucleotide
acacgttgcgtttctcacactcgtctattgtcctt

SEQ ID NO: 195081 - DNA, 26 bp, Artificial Sequence
  Synthetic oligonucleotide
ttgccatgcctcccccttcgattctt

SEQ ID NO: 195082 - DNA, 35 bp, Artificial Sequence
  Synthetic oligonucleotide
gcaacgatggtcccgtgctaattcctggtctcgtt

SEQ ID NO: 195083 - DNA, 35 bp, Artificial Sequence
  Synthetic oligonucleotide
accacccacacgtgcatacgaagttatcgttcgtt

SEQ ID NO: 195084 - DNA, 35 bp, Artificial Sequence
  Synthetic oligonucleotide
tcttgccgcacccccacatctgcgtcctctcgttt

SEQ ID NO: 195085 - DNA, 36 bp, Artificial Sequence
  Synthetic oligonucleotide
gatcaccacacaccccttgcgagtcagttcgcgaaa

SEQ ID NO: 195086 - DNA, 35 bp, Artificial Sequence
  Synthetic oligonucleotide
tgccaccccacgcaagtgcctgcccatttccacaa

SEQ ID NO: 195087 - DNA, 36 bp, Artificial Sequence
  Synthetic oligonucleotide
agcgggggggggatactggcaaacggcgccaaggaa

SEQ ID NO: 195088 - DNA, 36 bp, Artificial Sequence
  Synthetic oligonucleotide
gtgggagggcgtgggcgacggaggctacgaagggaa

SEQ ID NO: 195089 - DNA, 36 bp, Artificial Sequence
  Synthetic oligonucleotide
tcatcgcacatttgaactacctcttcacgtagtgaa

SEQ ID NO: 195090 - DNA, 36 bp, Artificial Sequence
  Synthetic oligonucleotide
actcagcaccggcactccacttacacctcttgtgaa

SEQ ID NO: 195091 - DNA, 36 bp, Artificial Sequence
  Synthetic oligonucleotide
gtggtcgctccgtgttctttaccatcgccacactaa

SEQ ID NO: 195092 - DNA, 35 bp, Artificial Sequence
  Synthetic oligonucleotide
acccctctccgtatcgaatagcttcgtggttcaca

SEQ ID NO: 195093 - DNA, 36 bp, Artificial Sequence
  Synthetic oligonucleotide
gcatcatccgggcttagctgccgtacaacaccacca

SEQ ID NO: 195094 - DNA, 36 bp, Artificial Sequence
  Synthetic oligonucleotide
tcccgcccatccgctatcatgtctatactcctccca

SEQ ID NO: 195095 - DNA, 36 bp, Artificial Sequence
  Synthetic oligonucleotide
accgctaacgctatgctctcctacgtgtcccccgca

SEQ ID NO: 195096 - DNA, 36 bp, Artificial Sequence
  Synthetic oligonucleotide
actatgttcgccagatctgatatctaccttgccgca

SEQ ID NO: 195097 - DNA, 36 bp, Artificial Sequence
  Synthetic oligonucleotide
ttgggggggaagtctcaacggaaaagggaataggca

SEQ ID NO: 195098 - DNA, 36 bp, Artificial Sequence
  Synthetic oligonucleotide
aagccgtagagggaaggggtatgggaagatagggca

SEQ ID NO: 195099 - DNA, 36 bp, Artificial Sequence
  Synthetic oligonucleotide
tgccgccccgtacgctcggatcaattccgttcctca

SEQ ID NO: 195100 - DNA, 36 bp, Artificial Sequence
  Synthetic oligonucleotide
tcgagccctgccgcccctcaggttcaagtttcctca

SEQ ID NO: 195101 - DNA, 36 bp, Artificial Sequence
  Synthetic oligonucleotide
gaccatgtccgctgcagtgcttgatcatcgctttca

SEQ ID NO: 195102 - DNA, 37 bp, Artificial Sequence
  Synthetic oligonucleotide
gttgacggtcccgtttgtcatcgttattcctccaaga

SEQ ID NO: 195103 - DNA, 37 bp, Artificial Sequence
  Synthetic oligonucleotide
attgccgggcatgagggggtcgggtgggcaaaacaga

SEQ ID NO: 195104 - DNA, 37 bp, Artificial Sequence
  Synthetic oligonucleotide
tagatgcgagcggtggaagggggcggatgacgagaga

SEQ ID NO: 195105 - DNA, 37 bp, Artificial Sequence
  Synthetic oligonucleotide
acgtgtcagccgctatctcgttcagcttcctcctaga

SEQ ID NO: 195106 - DNA, 37 bp, Artificial Sequence
  Synthetic oligonucleotide
tccggaaccatcctcacgcgtcttcgtcctaccacga

SEQ ID NO: 195107 - DNA, 37 bp, Artificial Sequence
  Synthetic oligonucleotide
gatgagggggagggcgggtcgaggtaccatagtacga

SEQ ID NO: 195108 - DNA, 35 bp, Artificial Sequence
  Synthetic oligonucleotide
atccgccccgaacatttaatactagcctcgaccga

SEQ ID NO: 195109 - DNA, 36 bp, Artificial Sequence
  Synthetic oligonucleotide
actgtagaccgcactttgcatatagccaccgcccga

SEQ ID NO: 195110 - DNA, 37 bp, Artificial Sequence
  Synthetic oligonucleotide
atccccttccagttccgttttcgtagtccctcgccga

SEQ ID NO: 195111 - DNA, 37 bp, Artificial Sequence
  Synthetic oligonucleotide
tgcgtatacccatagcgttagatcacctgccctccga

SEQ ID NO: 195112 - DNA, 36 bp, Artificial Sequence
  Synthetic oligonucleotide
tcgaaccacccatcttagaagtcacatacgctccga

SEQ ID NO: 195113 - DNA, 37 bp, Artificial Sequence
  Synthetic oligonucleotide
aagggcgggagattggggtggtacgagggctctccga

SEQ ID NO: 195114 - DNA, 35 bp, Artificial Sequence
  Synthetic oligonucleotide
cattcgccgccacgcgttgtcatccgccattgcga

SEQ ID NO: 195115 - DNA, 37 bp, Artificial Sequence
  Synthetic oligonucleotide
gacacacgcctttccacctgcgagcatgatcttgcga

SEQ ID NO: 195116 - DNA, 37 bp, Artificial Sequence
  Synthetic oligonucleotide
tgcttcccatcatgtgcatcactctgtcccccctcga

SEQ ID NO: 195117 - DNA, 34 bp, Artificial Sequence
  Synthetic oligonucleotide
acgtaaccatccggaatcaagtgccttctctcga

SEQ ID NO: 195118 - DNA, 37 bp, Artificial Sequence
  Synthetic oligonucleotide
ggggtggcggtctcaggtcgtggtgcggaggggtcga

SEQ ID NO: 195119 - DNA, 35 bp, Artificial Sequence
  Synthetic oligonucleotide
gtcactctcaccacacttgccttctgacgcttcga

SEQ ID NO: 195120 - DNA, 36 bp, Artificial Sequence
  Synthetic oligonucleotide
gaaggggtacgagggcgagggagtggcggacaagga

SEQ ID NO: 195121 - DNA, 37 bp, Artificial Sequence
  Synthetic oligonucleotide
tgaagacggtgaacggaagggcatggtgacggaagga

SEQ ID NO: 195122 - DNA, 37 bp, Artificial Sequence
  Synthetic oligonucleotide
gtaagtggggaagtaaaaggcgggcgacccagcagga

SEQ ID NO: 195123 - DNA, 36 bp, Artificial Sequence
  Synthetic oligonucleotide
gtcccgctcattggtactctgccctctgtatccgga

SEQ ID NO: 195124 - DNA, 36 bp, Artificial Sequence
  Synthetic oligonucleotide
gagggcggtgggtggtttggtaaatgggcaggcgga

SEQ ID NO: 195125 - DNA, 37 bp, Artificial Sequence
  Synthetic oligonucleotide
gtaagggggaagggctggtattatggggtggccggga

SEQ ID NO: 195126 - DNA, 37 bp, Artificial Sequence
  Synthetic oligonucleotide
gggaggaacagatcaataacggaggggaagtggggga

SEQ ID NO: 195127 - DNA, 38 bp, Artificial Sequence
  Synthetic oligonucleotide
gtggtagacacgagataggggctaaggggcgggctgga

SEQ ID NO: 195128 - DNA, 38 bp, Artificial Sequence
  Synthetic oligonucleotide
gggagggtgaagggggaatgaacgaggagaacacatga

SEQ ID NO: 195129 - DNA, 38 bp, Artificial Sequence
  Synthetic oligonucleotide
aaagcgagtgaaggagaaaggggggacgtataagatga

SEQ ID NO: 195130 - DNA, 38 bp, Artificial Sequence
  Synthetic oligonucleotide
tacaggggagagacactgagaagggaacggagggatga

SEQ ID NO: 195131 - DNA, 37 bp, Artificial Sequence
  Synthetic oligonucleotide
gacaactcgaccgacctatttcgacccacatcactga

SEQ ID NO: 195132 - DNA, 37 bp, Artificial Sequence
  Synthetic oligonucleotide
ttccacgcagagctcccaagcccaccacacctactga

SEQ ID NO: 195133 - DNA, 35 bp, Artificial Sequence
  Synthetic oligonucleotide
acgcgccccggttctcgtataccactcgttactga

SEQ ID NO: 195134 - DNA, 38 bp, Artificial Sequence
  Synthetic oligonucleotide
gtgcccccatctgctgagtcgccttaacttacgcctga

SEQ ID NO: 195135 - DNA, 37 bp, Artificial Sequence
  Synthetic oligonucleotide
tgcggatctctgccattgtccacccgctcattcctga

SEQ ID NO: 195136 - DNA, 38 bp, Artificial Sequence
  Synthetic oligonucleotide
gatcacccgctttgttgtccttttcccagccaggctga

SEQ ID NO: 195137 - DNA, 38 bp, Artificial Sequence
  Synthetic oligonucleotide
acagagggtgggagggagtgtgcaataaatcgggctga

SEQ ID NO: 195138 - DNA, 37 bp, Artificial Sequence
  Synthetic oligonucleotide
gcccaacagcatgttgctcgttctcgccttttgctga

SEQ ID NO: 195139 - DNA, 36 bp, Artificial Sequence
  Synthetic oligonucleotide
acacgggtgagggtgggtgaccacagggttgagtga

SEQ ID NO: 195140 - DNA, 38 bp, Artificial Sequence
  Synthetic oligonucleotide
gcctgccctctgccgcccaacgagtctccccgtcgtga

SEQ ID NO: 195141 - DNA, 36 bp, Artificial Sequence
  Synthetic oligonucleotide
acacacggagattgcgggtagtgggagggctggtga

SEQ ID NO: 195142 - DNA, 36 bp, Artificial Sequence
  Synthetic oligonucleotide
gaggctccgccctgctccactgcctaccctttgtga

SEQ ID NO: 195143 - DNA, 38 bp, Artificial Sequence
  Synthetic oligonucleotide
gacgcaacactctccgaccgtttccagatacaccttga

SEQ ID NO: 195144 - DNA, 38 bp, Artificial Sequence
  Synthetic oligonucleotide
atgggacggagcaggttggaggggagggtaggttttga

SEQ ID NO: 195145 - DNA, 36 bp, Artificial Sequence
  Synthetic oligonucleotide
taccgccccccccccggagacaattgtagggtacta

SEQ ID NO: 195146 - DNA, 36 bp, Artificial Sequence
  Synthetic oligonucleotide
tctagagcgagccaatgttcctcccgccctgtacta

SEQ ID NO: 195147 - DNA, 36 bp, Artificial Sequence
  Synthetic oligonucleotide
agcacatcccgttttatagtctcctgtggctcccta

SEQ ID NO: 195148 - DNA, 35 bp, Artificial Sequence
  Synthetic oligonucleotide
gatgagagagggaggcgagaaagatagagacagta

SEQ ID NO: 195149 - DNA, 36 bp, Artificial Sequence
  Synthetic oligonucleotide
actagtccacgggaggagggagggaacgagcacgta

SEQ ID NO: 195150 - DNA, 35 bp, Artificial Sequence
  Synthetic oligonucleotide
tgtcactgctcgctcttcttgttacgcacttggta

SEQ ID NO: 195151 - DNA, 36 bp, Artificial Sequence
  Synthetic oligonucleotide
ttcaccgcttgttgccgtattgtgccttctcttgta

SEQ ID NO: 195152 - DNA, 35 bp, Artificial Sequence
  Synthetic oligonucleotide
gccccaccctactgagcgtgctctatccatcctta

SEQ ID NO: 195153 - DNA, 35 bp, Artificial Sequence
  Synthetic oligonucleotide
tagggagggaggggaccagagtcgagtagggctta

SEQ ID NO: 195154 - DNA, 34 bp, Artificial Sequence
  Synthetic oligonucleotide
gttcccgctacgacccactgacctcggaccttta

SEQ ID NO: 195155 - DNA, 35 bp, Artificial Sequence
  Synthetic oligonucleotide
agtgggaggggatggggctttaaaaggggcaatac

SEQ ID NO: 195156 - DNA, 35 bp, Artificial Sequence
  Synthetic oligonucleotide
acacacacctgacgttggtaacttctttttgcacc

SEQ ID NO: 195157 - DNA, 35 bp, Artificial Sequence
  Synthetic oligonucleotide
gagggccgcttgcagttcgtcttccagcccatacc

SEQ ID NO: 195158 - DNA, 34 bp, Artificial Sequence
  Synthetic oligonucleotide
gtaccagcgcgctcattgagctacccccccaccc

SEQ ID NO: 195159 - DNA, 35 bp, Artificial Sequence
  Synthetic oligonucleotide
tgtctgcaccaatctcgcagccggccggtaccccc

SEQ ID NO: 195160 - DNA, 35 bp, Artificial Sequence
  Synthetic oligonucleotide
gcacgcacttcgtgaccgaaactagtatccgcccc

SEQ ID NO: 195161 - DNA, 35 bp, Artificial Sequence
  Synthetic oligonucleotide
gcccctccactatgccgcaacctttgcgatgtccc

SEQ ID NO: 195162 - DNA, 35 bp, Artificial Sequence
  Synthetic oligonucleotide
ttgtgcccgctctacgttaccccatgtccgttccc

SEQ ID NO: 195163 - DNA, 35 bp, Artificial Sequence
  Synthetic oligonucleotide
tgaatccgctacaccatgcaccccggtatggctcc

SEQ ID NO: 195164 - DNA, 35 bp, Artificial Sequence
  Synthetic oligonucleotide
tgttcctcccgaccctgtgctccctagatctgtcc

SEQ ID NO: 195165 - DNA, 35 bp, Artificial Sequence
  Synthetic oligonucleotide
gtggttgcgtagtcctagtccgttcgcagtcttcc

SEQ ID NO: 195166 - DNA, 35 bp, Artificial Sequence
  Synthetic oligonucleotide
aaccgagcccgtctcggatacccgtgccaatttcc

SEQ ID NO: 195167 - DNA, 34 bp, Artificial Sequence
  Synthetic oligonucleotide
ttccgccacctacttattgtgcctctttagtagc

SEQ ID NO: 195168 - DNA, 35 bp, Artificial Sequence
  Synthetic oligonucleotide
atgtcccgccctcggtactctataggtgaccacgc

SEQ ID NO: 195169 - DNA, 34 bp, Artificial Sequence
  Synthetic oligonucleotide
tatcaccactctgacgtccccgccacactgtcgc

SEQ ID NO: 195170 - DNA, 35 bp, Artificial Sequence
  Synthetic oligonucleotide
attcgttcctgcgccgcccttgctccggcctcggc

SEQ ID NO: 195171 - DNA, 35 bp, Artificial Sequence
  Synthetic oligonucleotide
aacacgggtgtaagggggggaatggaaagccgggc

SEQ ID NO: 195172 - DNA, 35 bp, Artificial Sequence
  Synthetic oligonucleotide
gttgtaatccccgtgttcgctgtacccttcgtggc

SEQ ID NO: 195173 - DNA, 35 bp, Artificial Sequence
  Synthetic oligonucleotide
gtgtcccgtatgactttcttgaatcctgctcctgc

SEQ ID NO: 195174 - DNA, 35 bp, Artificial Sequence
  Synthetic oligonucleotide
tcgcccatccgtttgatctctattctcccctctgc

SEQ ID NO: 195175 - DNA, 35 bp, Artificial Sequence
  Synthetic oligonucleotide
tttgcatgcctccgacccgcctttgtttccgcatc

SEQ ID NO: 195176 - DNA, 35 bp, Artificial Sequence
  Synthetic oligonucleotide
acgcatgcgccgtcttcaccttttgctctgggatc

SEQ ID NO: 195177 - DNA, 35 bp, Artificial Sequence
  Synthetic oligonucleotide
gccactcccgtggctgtttactcctgatcccactc

SEQ ID NO: 195178 - DNA, 35 bp, Artificial Sequence
  Synthetic oligonucleotide
tccgtgcccctcactttgccattcctcatgtactc

SEQ ID NO: 195179 - DNA, 35 bp, Artificial Sequence
  Synthetic oligonucleotide
gtcatccaggcctactggacttctagctttgcctc

SEQ ID NO: 195180 - DNA, 35 bp, Artificial Sequence
  Synthetic oligonucleotide
atatcccgccgccctgcactttaacgacaccgctc

SEQ ID NO: 195181 - DNA, 35 bp, Artificial Sequence
  Synthetic oligonucleotide
tcagatgcatcgcctgcccccctgtcgtactgctc

SEQ ID NO: 195182 - DNA, 35 bp, Artificial Sequence
  Synthetic oligonucleotide
ttccaccctcgggcattgcagtgttatgccctctc

SEQ ID NO: 195183 - DNA, 34 bp, Artificial Sequence
  Synthetic oligonucleotide
gacagccctttggcctccacgtaccctgcttctc

SEQ ID NO: 195184 - DNA, 35 bp, Artificial Sequence
  Synthetic oligonucleotide
tgtatgacaatcgcactgcctctgcacacccattc

SEQ ID NO: 195185 - DNA, 35 bp, Artificial Sequence
  Synthetic oligonucleotide
gtcagtgctgagtacctacccgtttcatgtcattc

SEQ ID NO: 195186 - DNA, 35 bp, Artificial Sequence
  Synthetic oligonucleotide
tgtgtctcgtgggcacaacgtatttccgaaccttc

SEQ ID NO: 195187 - DNA, 35 bp, Artificial Sequence
  Synthetic oligonucleotide
ttccacacagctgaatagcgagcgccccttccttc

SEQ ID NO: 195188 - DNA, 35 bp, Artificial Sequence
  Synthetic oligonucleotide
tagccacacacccgaactgtacacattcaatcttc

SEQ ID NO: 195189 - DNA, 35 bp, Artificial Sequence
  Synthetic oligonucleotide
tcccaatctcggacgtagtacgcccttcttagttc

SEQ ID NO: 195190 - DNA, 35 bp, Artificial Sequence
  Synthetic oligonucleotide
agtggcaaaggaggagcaaaggatggtgtgagcag

SEQ ID NO: 195191 - DNA, 35 bp, Artificial Sequence
  Synthetic oligonucleotide
tcccaccattgtcccctttgccgtcacctctagag

SEQ ID NO: 195192 - DNA, 35 bp, Artificial Sequence
  Synthetic oligonucleotide
ggtggtactcgaggaggggggtgtggagcgatacg

SEQ ID NO: 195193 - DNA, 35 bp, Artificial Sequence
  Synthetic oligonucleotide
acacattcgcattattcaggccccatttatgtacg

SEQ ID NO: 195194 - DNA, 35 bp, Artificial Sequence
  Synthetic oligonucleotide
gccccttaccgctatatactgcatactccctcccg

SEQ ID NO: 195195 - DNA, 35 bp, Artificial Sequence
  Synthetic oligonucleotide
tacttcctcagagccgaccgttgctcccattcccg

SEQ ID NO: 195196 - DNA, 35 bp, Artificial Sequence
  Synthetic oligonucleotide
gatgcgccctatctgcaataacactgttccctccg

SEQ ID NO: 195197 - DNA, 35 bp, Artificial Sequence
  Synthetic oligonucleotide
cacccacctgacaattgctcattctatccaccgcg

SEQ ID NO: 195198 - DNA, 35 bp, Artificial Sequence
  Synthetic oligonucleotide
actctcccactccgcaatctccatcagcccttgcg

SEQ ID NO: 195199 - DNA, 34 bp, Artificial Sequence
  Synthetic oligonucleotide
tttggccgcaggtagtctttttcgttcaatctcg

SEQ ID NO: 195200 - DNA, 35 bp, Artificial Sequence
  Synthetic oligonucleotide
gagccatcggccgtcttgcctacaacactccctgg

SEQ ID NO: 195201 - DNA, 35 bp, Artificial Sequence
  Synthetic oligonucleotide
ggggggaggcgaatggaacgacataggaggtcatg

SEQ ID NO: 195202 - DNA, 35 bp, Artificial Sequence
  Synthetic oligonucleotide
taatagcgcctagcggttctgcctctctacccctg

SEQ ID NO: 195203 - DNA, 35 bp, Artificial Sequence
  Synthetic oligonucleotide
acgtctacctccgaagtaccggattccctcccctg

SEQ ID NO: 195204 - DNA, 35 bp, Artificial Sequence
  Synthetic oligonucleotide
gtgtagtgcgtatgtcgtcttgtatctcctccctg

SEQ ID NO: 195205 - DNA, 36 bp, Artificial Sequence
  Synthetic oligonucleotide
gagccatcagcttcgtcttacgcccgtccttccctg

SEQ ID NO: 195206 - DNA, 35 bp, Artificial Sequence
  Synthetic oligonucleotide
tcctacgcttccacctcattgagccaccattcctg

SEQ ID NO: 195207 - DNA, 35 bp, Artificial Sequence
  Synthetic oligonucleotide
tgcactctcattgccctccgtttgtctgctttctg

SEQ ID NO: 195208 - DNA, 35 bp, Artificial Sequence
  Synthetic oligonucleotide
tccaactgacagtcccgggttaacgcctttctgtg

SEQ ID NO: 195209 - DNA, 35 bp, Artificial Sequence
  Synthetic oligonucleotide
aacgcccgctatccgacttccataggcatatgttg

SEQ ID NO: 195210 - DNA, 35 bp, Artificial Sequence
  Synthetic oligonucleotide
accagctcaccatggtttccccaccgttgtgccat

SEQ ID NO: 195211 - DNA, 35 bp, Artificial Sequence
  Synthetic oligonucleotide
gacgacgccgctctcctgtctgttatggcttctat

SEQ ID NO: 195212 - DNA, 35 bp, Artificial Sequence
  Synthetic oligonucleotide
tagctcaggcttagcttcgtacctccctttctact

SEQ ID NO: 195213 - DNA, 35 bp, Artificial Sequence
  Synthetic oligonucleotide
acctacatcctccgttttgttggccctaaatgcct

SEQ ID NO: 195214 - DNA, 35 bp, Artificial Sequence
  Synthetic oligonucleotide
tgaaccatcacggtctccatctatgacctcatcct

SEQ ID NO: 195215 - DNA, 35 bp, Artificial Sequence
  Synthetic oligonucleotide
acgaggatggatgtgatgtgccttctccccctcct

SEQ ID NO: 195216 - DNA, 35 bp, Artificial Sequence
  Synthetic oligonucleotide
acgccctgcctagctaatgaagccctgctgttcct

SEQ ID NO: 195217 - DNA, 35 bp, Artificial Sequence
  Synthetic oligonucleotide
ttggcggccagagctgttgcttcccctcgccctct

SEQ ID NO: 195218 - DNA, 35 bp, Artificial Sequence
  Synthetic oligonucleotide
tagatgccaccactagctatgaccgctctcgttct

SEQ ID NO: 195219 - DNA, 35 bp, Artificial Sequence
  Synthetic oligonucleotide
gcccgcgagagcggtcttagaggtcctgcccccgt

SEQ ID NO: 195220 - DNA, 35 bp, Artificial Sequence
  Synthetic oligonucleotide
acatggagggaggggcggtgtacggaagtagaggt

SEQ ID NO: 195221 - DNA, 35 bp, Artificial Sequence
  Synthetic oligonucleotide
agcccagtcccattatgcaaagccgccgctacctt

SEQ ID NO: 195222 - DNA, 35 bp, Artificial Sequence
  Synthetic oligonucleotide
atcccacaccgctgtgtgaacggctcctttacctt

SEQ ID NO: 195223 - DNA, 35 bp, Artificial Sequence
  Synthetic oligonucleotide
gcacacacgcttggctgttctatccggatcccctt

SEQ ID NO: 195224 - DNA, 35 bp, Artificial Sequence
  Synthetic oligonucleotide
gactgtagggtgttttgctccgactccttcctctt

SEQ ID NO: 195225 - DNA, 35 bp, Artificial Sequence
  Synthetic oligonucleotide
gagcggagtaccggtgctgcctctcttcactagtt

SEQ ID NO: 195226 - DNA, 35 bp, Artificial Sequence
  Synthetic oligonucleotide
tcatcgtaacatccgcttgcgccttgctacttttt

SEQ ID NO: 195227 - DNA, 35 bp, Artificial Sequence
  Synthetic oligonucleotide
ttgggccgaagccgccattcattgttcctcaccaa

SEQ ID NO: 195228 - DNA, 36 bp, Artificial Sequence
  Synthetic oligonucleotide
ttcgccaggccgccaccctgtttagattgcccccaa

SEQ ID NO: 195229 - DNA, 35 bp, Artificial Sequence
  Synthetic oligonucleotide
tcatcccccccctctaaccgtgaatgcggttccaa

SEQ ID NO: 195230 - DNA, 35 bp, Artificial Sequence
  Synthetic oligonucleotide
tacgtgcaaaatgggttatagggagtggggggcaa

SEQ ID NO: 195231 - DNA, 36 bp, Artificial Sequence
  Synthetic oligonucleotide
aatcgcaaagggaacgggggagtaaagggtttggaa

SEQ ID NO: 195232 - DNA, 36 bp, Artificial Sequence
  Synthetic oligonucleotide
gacacgatgggacacgtacatgggggggggatataa

SEQ ID NO: 195233 - DNA, 35 bp, Artificial Sequence
  Synthetic oligonucleotide
ttgaacagcccacgcttctgctttttaacgccaca

SEQ ID NO: 195234 - DNA, 36 bp, Artificial Sequence
  Synthetic oligonucleotide
accacctccaacgcctgggctcagaccatttaccca

SEQ ID NO: 195235 - DNA, 36 bp, Artificial Sequence
  Synthetic oligonucleotide
attaaccacctgcagtgacgccgcccgtcgccccca

SEQ ID NO: 195236 - DNA, 36 bp, Artificial Sequence
  Synthetic oligonucleotide
acctggtcaatgtatcaccgacctgctcttttccca

SEQ ID NO: 195237 - DNA, 35 bp, Artificial Sequence
  Synthetic oligonucleotide
tcatcaaccgttcccgacgaggtcgaccctatcca

SEQ ID NO: 195238 - DNA, 36 bp, Artificial Sequence
  Synthetic oligonucleotide
ttcgaacgcctctttacgtgcacccggtcctgtcca

SEQ ID NO: 195239 - DNA, 35 bp, Artificial Sequence
  Synthetic oligonucleotide
gactcaccaccatgaaccgtatactcggaaccgca

SEQ ID NO: 195240 - DNA, 36 bp, Artificial Sequence
  Synthetic oligonucleotide
aaccctgtacgcctgctgtcccccccatagtgcgca

SEQ ID NO: 195241 - DNA, 36 bp, Artificial Sequence
  Synthetic oligonucleotide
gtaccccctgtttgtgcatgtactatgcccatcgca

SEQ ID NO: 195242 - DNA, 36 bp, Artificial Sequence
  Synthetic oligonucleotide
tttgcagtacagatctgcccgcctcatctgctatca

SEQ ID NO: 195243 - DNA, 36 bp, Artificial Sequence
  Synthetic oligonucleotide
gatactgctcaccttcaaccctgcggacttcactca

SEQ ID NO: 195244 - DNA, 35 bp, Artificial Sequence
  Synthetic oligonucleotide
ttgtcgcccaccatcacttgaaccatcccgactca

SEQ ID NO: 195245 - DNA, 36 bp, Artificial Sequence
  Synthetic oligonucleotide
gcgtggtccagacgcttactatgtaccgccacctca

SEQ ID NO: 195246 - DNA, 36 bp, Artificial Sequence
  Synthetic oligonucleotide
acccgcacagggtaggtcaccgccgccatttgctca

SEQ ID NO: 195247 - DNA, 35 bp, Artificial Sequence
  Synthetic oligonucleotide
gtacgcctcttcgattaatcgccagcctcctctca

SEQ ID NO: 195248 - DNA, 36 bp, Artificial Sequence
  Synthetic oligonucleotide
tcagaccccagcctgcgttacttcagcgccccgtca

SEQ ID NO: 195249 - DNA, 37 bp, Artificial Sequence
  Synthetic oligonucleotide
gacgagtcattcgagagatggggcggagggaacaaga

SEQ ID NO: 195250 - DNA, 36 bp, Artificial Sequence
  Synthetic oligonucleotide
gggggagtaaacgtagggaggaacaaagaaaagaga

SEQ ID NO: 195251 - DNA, 37 bp, Artificial Sequence
  Synthetic oligonucleotide
ttgacaaacagggttgggtgggacagggttaccgaga

SEQ ID NO: 195252 - DNA, 37 bp, Artificial Sequence
  Synthetic oligonucleotide
gatggggtcaggggctgggggaaaagtcagatcgaga

SEQ ID NO: 195253 - DNA, 37 bp, Artificial Sequence
  Synthetic oligonucleotide
tacgtgcctctgcccatcttcgttcgtactttctaga

SEQ ID NO: 195254 - DNA, 37 bp, Artificial Sequence
  Synthetic oligonucleotide
aaggggggactgagcagggtgggccgggtggaaacga

SEQ ID NO: 195255 - DNA, 36 bp, Artificial Sequence
  Synthetic oligonucleotide
ttgtcggaggacgaaggacaggggacgggggaacga

SEQ ID NO: 195256 - DNA, 37 bp, Artificial Sequence
  Synthetic oligonucleotide
acaccgccctcgactgtccacgacgaaccttgaacga

SEQ ID NO: 195257 - DNA, 37 bp, Artificial Sequence
  Synthetic oligonucleotide
aagtcgtgggggcggaaggtaggggtcgggggtacga

SEQ ID NO: 195258 - DNA, 37 bp, Artificial Sequence
  Synthetic oligonucleotide
gtaccctgccagttgcctttcaatccccgttaaccga

SEQ ID NO: 195259 - DNA, 37 bp, Artificial Sequence
  Synthetic oligonucleotide
gcactccttccgcgcctacatttcgtggtcctaccga

SEQ ID NO: 195260 - DNA, 34 bp, Artificial Sequence
  Synthetic oligonucleotide
accctcgtagccgatccgtatcgtatccatccga

SEQ ID NO: 195261 - DNA, 37 bp, Artificial Sequence
  Synthetic oligonucleotide
agcacgccttcccttcccacccagtccgatacgtcga

SEQ ID NO: 195262 - DNA, 37 bp, Artificial Sequence
  Synthetic oligonucleotide
aacagccgggtgcacgggggaagaactggggtgtcga

SEQ ID NO: 195263 - DNA, 36 bp, Artificial Sequence
  Synthetic oligonucleotide
tacaaataggcgggtatgggaggttggaggggagga

SEQ ID NO: 195264 - DNA, 37 bp, Artificial Sequence
  Synthetic oligonucleotide
ggatagaaaggtggcggactacggagagcgcggggga

SEQ ID NO: 195265 - DNA, 37 bp, Artificial Sequence
  Synthetic oligonucleotide
tcacaccgcgggcctgtttgctacttcgatccttgga

SEQ ID NO: 195266 - DNA, 38 bp, Artificial Sequence
  Synthetic oligonucleotide
agtacgtccggccgcccgctcaagccacccaccaatga

SEQ ID NO: 195267 - DNA, 37 bp, Artificial Sequence
  Synthetic oligonucleotide
tgcccaacctcagcctattagttcgcgacccccatga

SEQ ID NO: 195268 - DNA, 38 bp, Artificial Sequence
  Synthetic oligonucleotide
gccgcgcttaccatgtgtacctccttctcctctactga

SEQ ID NO: 195269 - DNA, 38 bp, Artificial Sequence
  Synthetic oligonucleotide
actgtaccccctcattgtaccattcacgcccccagtga

SEQ ID NO: 195270 - DNA, 38 bp, Artificial Sequence
  Synthetic oligonucleotide
tgtggaggtcttctcgttttagccgcccttccctgtga

SEQ ID NO: 195271 - DNA, 38 bp, Artificial Sequence
  Synthetic oligonucleotide
gcacgtcgacactgccctcccgacaccttttccattga

SEQ ID NO: 195272 - DNA, 38 bp, Artificial Sequence
  Synthetic oligonucleotide
ttgctcacaccgccctgtcatcttgaacactcacttga

SEQ ID NO: 195273 - DNA, 37 bp, Artificial Sequence
  Synthetic oligonucleotide
tgacacctcggtcgtttatcctgccgttgatccttga

SEQ ID NO: 195274 - DNA, 36 bp, Artificial Sequence
  Synthetic oligonucleotide
tcatcccatccaatgcatttcccaagacccggttga

SEQ ID NO: 195275 - DNA, 36 bp, Artificial Sequence
  Synthetic oligonucleotide
tccggtgccgccctttgtaccaccttcgccatttga

SEQ ID NO: 195276 - DNA, 35 bp, Artificial Sequence
  Synthetic oligonucleotide
acgccccttgatcgcactacgaagcctcttttcta

SEQ ID NO: 195277 - DNA, 36 bp, Artificial Sequence
  Synthetic oligonucleotide
tgatgcggggaggggcgagtggtagatagggaggta

SEQ ID NO: 195278 - DNA, 35 bp, Artificial Sequence
  Synthetic oligonucleotide
tgctgtacccctcattgtcttatcctatcgctgta

SEQ ID NO: 195279 - DNA, 36 bp, Artificial Sequence
  Synthetic oligonucleotide
acacccaggatgacctccgccctcgtgattccatta

SEQ ID NO: 195280 - DNA, 35 bp, Artificial Sequence
  Synthetic oligonucleotide
gtcacccgccattcttcagcccaccgattgcatta

SEQ ID NO: 195281 - DNA, 35 bp, Artificial Sequence
  Synthetic oligonucleotide
gacaaatgcgcgtcaccatccaattcgctgcctta

SEQ ID NO: 195282 - DNA, 35 bp, Artificial Sequence
  Synthetic oligonucleotide
tcacagccccgtttcaatactgcccccaggtcaac

SEQ ID NO: 195283 - DNA, 35 bp, Artificial Sequence
  Synthetic oligonucleotide
gtccagagccaaatgctgtccctcctcggcttaac

SEQ ID NO: 195284 - DNA, 35 bp, Artificial Sequence
  Synthetic oligonucleotide
gaccaggtgatgagtgttccttctgcttccccgac

SEQ ID NO: 195285 - DNA, 35 bp, Artificial Sequence
  Synthetic oligonucleotide
gtcaccggtccgcactcgctagattccccccatac

SEQ ID NO: 195286 - DNA, 35 bp, Artificial Sequence
  Synthetic oligonucleotide
tctatggtgccgccgttaatactgaccctccctac

SEQ ID NO: 195287 - DNA, 35 bp, Artificial Sequence
  Synthetic oligonucleotide
agaacgtcgccgctcttggtcccatatgctcctac

SEQ ID NO: 195288 - DNA, 35 bp, Artificial Sequence
  Synthetic oligonucleotide
aggagccaccgccgctgtgatctgcctatctctac

SEQ ID NO: 195289 - DNA, 35 bp, Artificial Sequence
  Synthetic oligonucleotide
tctcccccgcatccctctgggaggacctaatgtac

SEQ ID NO: 195290 - DNA, 35 bp, Artificial Sequence
  Synthetic oligonucleotide
tcgatgccgtccaacatagctgccacctcggttac

SEQ ID NO: 195291 - DNA, 35 bp, Artificial Sequence
  Synthetic oligonucleotide
atccagccgcttacatcgttatataccgttccacc

SEQ ID NO: 195292 - DNA, 35 bp, Artificial Sequence
  Synthetic oligonucleotide
tcacccactttacccgccactgtcttagaggcacc

SEQ ID NO: 195293 - DNA, 35 bp, Artificial Sequence
  Synthetic oligonucleotide
gttctcgcccgctcaagcctgcattgttcatcacc

SEQ ID NO: 195294 - DNA, 35 bp, Artificial Sequence
  Synthetic oligonucleotide
gatcggtgtcacttcctcctcccagcgtggttacc

SEQ ID NO: 195295 - DNA, 35 bp, Artificial Sequence
  Synthetic oligonucleotide
agaggtcgtagtgccatcgttcctttaagcccccc

SEQ ID NO: 195296 - DNA, 35 bp, Artificial Sequence
  Synthetic oligonucleotide
ttatcacccgcccgatgagctccatcgtgatcccc

SEQ ID NO: 195297 - DNA, 35 bp, Artificial Sequence
  Synthetic oligonucleotide
tccctatgccgccctgatagcgagaagctatcccc

SEQ ID NO: 195298 - DNA, 35 bp, Artificial Sequence
  Synthetic oligonucleotide
gccacttccacatggctattattcgctttccgccc

SEQ ID NO: 195299 - DNA, 35 bp, Artificial Sequence
  Synthetic oligonucleotide
gccccggtccgcatccgtttcagctcccacttccc

SEQ ID NO: 195300 - DNA, 36 bp, Artificial Sequence
  Synthetic oligonucleotide
gtaacaggcaacacacgctcgatcctcccggttccc

SEQ ID NO: 195301 - DNA, 35 bp, Artificial Sequence
  Synthetic oligonucleotide
ggtccacctcacctagcatgctaactcttatggcc

SEQ ID NO: 195302 - DNA, 35 bp, Artificial Sequence
  Synthetic oligonucleotide
tcaacgccgccctgccgcctggttctactgctgcc

SEQ ID NO: 195303 - DNA, 35 bp, Artificial Sequence
  Synthetic oligonucleotide
accgcgccgagtgcacttaaccatcgccgattgcc

SEQ ID NO: 195304 - DNA, 35 bp, Artificial Sequence
  Synthetic oligonucleotide
tgctgcccactcccatccacacagctgcctgctcc

SEQ ID NO: 195305 - DNA, 35 bp, Artificial Sequence
  Synthetic oligonucleotide
tccgagagcatccatttctcctgcggtatacttcc

SEQ ID NO: 195306 - DNA, 35 bp, Artificial Sequence
  Synthetic oligonucleotide
tcacattaccctccagtactcgtccaggggcttcc

SEQ ID NO: 195307 - DNA, 35 bp, Artificial Sequence
  Synthetic oligonucleotide
atcctgcctcctgttcgtgagccgcgttacgttcc

SEQ ID NO: 195308 - DNA, 36 bp, Artificial Sequence
  Synthetic oligonucleotide
aacgctggatgtagggggcggggggaagtgacgagc

SEQ ID NO: 195309 - DNA, 35 bp, Artificial Sequence
  Synthetic oligonucleotide
gtctcgctccggtccacatctgttatttgcttagc

SEQ ID NO: 195310 - DNA, 35 bp, Artificial Sequence
  Synthetic oligonucleotide
ttgtgccccttcaattcccgatataggatccacgc

SEQ ID NO: 195311 - DNA, 35 bp, Artificial Sequence
  Synthetic oligonucleotide
tatgtctggatgtcctttgccccgttttacctcgc

SEQ ID NO: 195312 - DNA, 35 bp, Artificial Sequence
  Synthetic oligonucleotide
gtctcgcaccatcgtgtctcgtctaccccattcgc

SEQ ID NO: 195313 - DNA, 35 bp, Artificial Sequence
  Synthetic oligonucleotide
ttcagcccctgttcgatcgcacccctctcttatgc

SEQ ID NO: 195314 - DNA, 35 bp, Artificial Sequence
  Synthetic oligonucleotide
accacctgggccgatcttcatagttacacaaactc

SEQ ID NO: 195315 - DNA, 35 bp, Artificial Sequence
  Synthetic oligonucleotide
agtgagctcctgccctgcccgtttctgtacccctc

SEQ ID NO: 195316 - DNA, 35 bp, Artificial Sequence
  Synthetic oligonucleotide
tcagcaactccgcagagatgtggtcgtccgccctc

SEQ ID NO: 195317 - DNA, 35 bp, Artificial Sequence
  Synthetic oligonucleotide
ttgcgggtgccccctcagatttcattctcggcctc

SEQ ID NO: 195318 - DNA, 35 bp, Artificial Sequence
  Synthetic oligonucleotide
gcctgtaccatctctcacattcatgcgtcctgctc

SEQ ID NO: 195319 - DNA, 35 bp, Artificial Sequence
  Synthetic oligonucleotide
ttaagcccctcgttagttctgtccacgccgccgtc

SEQ ID NO: 195320 - DNA, 35 bp, Artificial Sequence
  Synthetic oligonucleotide
gatcacggcactttttctatcactagcttcctttc

SEQ ID NO: 195321 - DNA, 35 bp, Artificial Sequence
  Synthetic oligonucleotide
gaggagccgatccgtactcttccccgggccttttc

SEQ ID NO: 195322 - DNA, 35 bp, Artificial Sequence
  Synthetic oligonucleotide
gagaagggaggctaggcgagatagagccgggacag

SEQ ID NO: 195323 - DNA, 35 bp, Artificial Sequence
  Synthetic oligonucleotide
agcagatgcgggcgaggggcgaggggaaattacag

SEQ ID NO: 195324 - DNA, 35 bp, Artificial Sequence
  Synthetic oligonucleotide
agggcgggaggggcgaggatatgggccatgttcag

SEQ ID NO: 195325 - DNA, 35 bp, Artificial Sequence
  Synthetic oligonucleotide
acacgtgtcatccggccctctgtctacgttcaacg

SEQ ID NO: 195326 - DNA, 35 bp, Artificial Sequence
  Synthetic oligonucleotide
tagaaagggcaagaagcggtgggggagggcacccg

SEQ ID NO: 195327 - DNA, 35 bp, Artificial Sequence
  Synthetic oligonucleotide
tgcctcatcccgttgacccccctgtatctatggcg

SEQ ID NO: 195328 - DNA, 33 bp, Artificial Sequence
  Synthetic oligonucleotide
tccccccctcctctcgttttgtacgcacatgcg

SEQ ID NO: 195329 - DNA, 35 bp, Artificial Sequence
  Synthetic oligonucleotide
tccgtaacgcccagtgcgctacgtgtctctcctcg

SEQ ID NO: 195330 - DNA, 35 bp, Artificial Sequence
  Synthetic oligonucleotide
ttgcttggccacatcaagtatctaatcctctctcg

SEQ ID NO: 195331 - DNA, 35 bp, Artificial Sequence
  Synthetic oligonucleotide
tgcacccgattcacttagtgcatattttcctttcg

SEQ ID NO: 195332 - DNA, 35 bp, Artificial Sequence
  Synthetic oligonucleotide
gacgtgtaaggaggctgaaggaggcggaagagcgg

SEQ ID NO: 195333 - DNA, 35 bp, Artificial Sequence
  Synthetic oligonucleotide
tgttgactggggcggacggaggggattgttcaggg

SEQ ID NO: 195334 - DNA, 35 bp, Artificial Sequence
  Synthetic oligonucleotide
ttgcgagccccggcgctgtgccactccccctatgg

SEQ ID NO: 195335 - DNA, 35 bp, Artificial Sequence
  Synthetic oligonucleotide
tcgtcccggccccctgtcaccatgccagactcatg

SEQ ID NO: 195336 - DNA, 35 bp, Artificial Sequence
  Synthetic oligonucleotide
gacccgcgatgtgtggtccccctggcgaatccctg

SEQ ID NO: 195337 - DNA, 35 bp, Artificial Sequence
  Synthetic oligonucleotide
tcaacccctcacgctcctccctcatgctatcggtg

SEQ ID NO: 195338 - DNA, 35 bp, Artificial Sequence
  Synthetic oligonucleotide
tcgcggtgccgcattcctaagcccctctaacattg

SEQ ID NO: 195339 - DNA, 35 bp, Artificial Sequence
  Synthetic oligonucleotide
tttcgcctccgtagccacgcgtattccaatcacat

SEQ ID NO: 195340 - DNA, 35 bp, Artificial Sequence
  Synthetic oligonucleotide
taggaggaggaggggtgaggtcagtgtaaggatat

SEQ ID NO: 195341 - DNA, 35 bp, Artificial Sequence
  Synthetic oligonucleotide
ggggcgagggggcaaaattcgagggagttaggtat

SEQ ID NO: 195342 - DNA, 35 bp, Artificial Sequence
  Synthetic oligonucleotide
tgcctactcatcatatccatggtaccgtgcctact

SEQ ID NO: 195343 - DNA, 35 bp, Artificial Sequence
  Synthetic oligonucleotide
tgtatgtacggcacgtttggcttagtttcctccct

SEQ ID NO: 195344 - DNA, 35 bp, Artificial Sequence
  Synthetic oligonucleotide
gatacgcacttatgcccgcccccttgctcaggcct

SEQ ID NO: 195345 - DNA, 34 bp, Artificial Sequence
  Synthetic oligonucleotide
gccacacgccccgaatgagctttttgcgaccgct

SEQ ID NO: 195346 - DNA, 35 bp, Artificial Sequence
  Synthetic oligonucleotide
gcacaactagacgacgcagtacgttccacccctct

SEQ ID NO: 195347 - DNA, 35 bp, Artificial Sequence
  Synthetic oligonucleotide
gagtacgccacacttggtcccattaatgaatttct

SEQ ID NO: 195348 - DNA, 35 bp, Artificial Sequence
  Synthetic oligonucleotide
gctggtctaatcgtatgccacatgtctgcctttct

SEQ ID NO: 195349 - DNA, 35 bp, Artificial Sequence
  Synthetic oligonucleotide
tctgcccggtagcctagcatttgatctcttcccgt

SEQ ID NO: 195350 - DNA, 35 bp, Artificial Sequence
  Synthetic oligonucleotide
gtacacgcctcgaatccagcgggtatcctctcctt

SEQ ID NO: 195351 - DNA, 35 bp, Artificial Sequence
  Synthetic oligonucleotide
gagcccctgctaccataacctttccgacccctctt

SEQ ID NO: 195352 - DNA, 35 bp, Artificial Sequence
  Synthetic oligonucleotide
gattacgcaggaagggagggctgggggacgccgtt

SEQ ID NO: 195353 - DNA, 35 bp, Artificial Sequence
  Synthetic oligonucleotide
tgaacagccctcccaacgtctccgcgcttctccaa

SEQ ID NO: 195354 - DNA, 35 bp, Artificial Sequence
  Synthetic oligonucleotide
aagggaggtgtggggtcgtgcgataaggggggcaa

SEQ ID NO: 195355 - DNA, 36 bp, Artificial Sequence
  Synthetic oligonucleotide
gaccaccactactgtcttgtctaaagttctcttcaa

SEQ ID NO: 195356 - DNA, 36 bp, Artificial Sequence
  Synthetic oligonucleotide
gatgatcatggtgggggggcgagacgaggaaaggaa

SEQ ID NO: 195357 - DNA, 36 bp, Artificial Sequence
  Synthetic oligonucleotide
aacgggagggtgctgtgtaatggggaagcgggaaca

SEQ ID NO: 195358 - DNA, 36 bp, Artificial Sequence
  Synthetic oligonucleotide
gtacagtgggaggggggacggacgccgtcggagaca

SEQ ID NO: 195359 - DNA, 35 bp, Artificial Sequence
  Synthetic oligonucleotide
atgaccgacgtccatctgcttcactcaccgtgaca

SEQ ID NO: 195360 - DNA, 36 bp, Artificial Sequence
  Synthetic oligonucleotide
gttcatccgattcgttgtctcgagcgctccccacca

SEQ ID NO: 195361 - DNA, 35 bp, Artificial Sequence
  Synthetic oligonucleotide
aggacaccgtgcttttccgctttgtaacgccccca

SEQ ID NO: 195362 - DNA, 36 bp, Artificial Sequence
  Synthetic oligonucleotide
gatgccaccccacacactcgccctacagtgagccca

SEQ ID NO: 195363 - DNA, 36 bp, Artificial Sequence
  Synthetic oligonucleotide
atctgctcctgtcccgcgaatccatgtctcctccca

SEQ ID NO: 195364 - DNA, 36 bp, Artificial Sequence
  Synthetic oligonucleotide
atccatcgttcgctccctttacgccggcctatgcca

SEQ ID NO: 195365 - DNA, 32 bp, Artificial Sequence
  Synthetic oligonucleotide
atcaagccgaccccgcgttttggaatcctcca

SEQ ID NO: 195366 - DNA, 35 bp, Artificial Sequence
  Synthetic oligonucleotide
gtgagctctgctgacccaccgcccgggcctctcca

SEQ ID NO: 195367 - DNA, 36 bp, Artificial Sequence
  Synthetic oligonucleotide
tccgccaccctcagcccttttcactaaacgtaagca

SEQ ID NO: 195368 - DNA, 36 bp, Artificial Sequence
  Synthetic oligonucleotide
agctatgtgacgctacgagggggggcgggacgggca

SEQ ID NO: 195369 - DNA, 36 bp, Artificial Sequence
  Synthetic oligonucleotide
tgtgcgttcgcctctgtcctctactcttcctgtgca

SEQ ID NO: 195370 - DNA, 36 bp, Artificial Sequence
  Synthetic oligonucleotide
tagggggggactgggtgggagagggtacgggcgtca

SEQ ID NO: 195371 - DNA, 36 bp, Artificial Sequence
  Synthetic oligonucleotide
tctacacgccgcctgcttctacctacactccggtca

SEQ ID NO: 195372 - DNA, 36 bp, Artificial Sequence
  Synthetic oligonucleotide
ttaccacccgactcctgacagtgtatcagttggtca

SEQ ID NO: 195373 - DNA, 36 bp, Artificial Sequence
  Synthetic oligonucleotide
gtgcacacccccggtcatttatctcgacgcacttca

SEQ ID NO: 195374 - DNA, 35 bp, Artificial Sequence
  Synthetic oligonucleotide
tcgcacttccatccagtctatccttcgcctgttca

SEQ ID NO: 195375 - DNA, 36 bp, Artificial Sequence
  Synthetic oligonucleotide
tccatcgcaggcaaatgtccgctaccaccttcaaga

SEQ ID NO: 195376 - DNA, 37 bp, Artificial Sequence
  Synthetic oligonucleotide
atgcccgcacataccgcctgtctttcccaatcgcaga

SEQ ID NO: 195377 - DNA, 37 bp, Artificial Sequence
  Synthetic oligonucleotide
ggggggagcaggaggagtagggagtactacatggaga

SEQ ID NO: 195378 - DNA, 36 bp, Artificial Sequence
  Synthetic oligonucleotide
gcgacaggggggggtagcatgacaagggagtggaga

SEQ ID NO: 195379 - DNA, 37 bp, Artificial Sequence
  Synthetic oligonucleotide
gttgccaacccatctgtttttttgtgcctccactaga

SEQ ID NO: 195380 - DNA, 37 bp, Artificial Sequence
  Synthetic oligonucleotide
atgtgcgctagcccgatttagtccctgttccccccga

SEQ ID NO: 195381 - DNA, 37 bp, Artificial Sequence
  Synthetic oligonucleotide
tacaggaatgatgtccgtactctatgcccgccgccga

SEQ ID NO: 195382 - DNA, 36 bp, Artificial Sequence
  Synthetic oligonucleotide
tagcgatcattcatccgtttccgcgcccgtttccga

SEQ ID NO: 195383 - DNA, 37 bp, Artificial Sequence
  Synthetic oligonucleotide
ggaggcgaggggcgggagtggaatttgaacggggcga

SEQ ID NO: 195384 - DNA, 37 bp, Artificial Sequence
  Synthetic oligonucleotide
tgtcatacgggacggagaatggaagcaatgggggcga

SEQ ID NO: 195385 - DNA, 37 bp, Artificial Sequence
  Synthetic oligonucleotide
tggaccccgacccgtttcatctgcctccatctggcga

SEQ ID NO: 195386 - DNA, 37 bp, Artificial Sequence
  Synthetic oligonucleotide
gccttagccaattggctctacctcctcgatttatcga

SEQ ID NO: 195387 - DNA, 37 bp, Artificial Sequence
  Synthetic oligonucleotide
taccgctccagtttagtcaacaaccttgctccctcga

SEQ ID NO: 195388 - DNA, 37 bp, Artificial Sequence
  Synthetic oligonucleotide
aagcacggaagaagaggaaggaggggcaggccgtcga

SEQ ID NO: 195389 - DNA, 36 bp, Artificial Sequence
  Synthetic oligonucleotide
ttaggaggggcgtgcggtgatcgggggggggcagga

SEQ ID NO: 195390 - DNA, 37 bp, Artificial Sequence
  Synthetic oligonucleotide
tgccatcagttacatcttcgtgcctctcccattcgga

SEQ ID NO: 195391 - DNA, 36 bp, Artificial Sequence
  Synthetic oligonucleotide
tccgtccaccaccatttttatccgcttcagtcggga

SEQ ID NO: 195392 - DNA, 37 bp, Artificial Sequence
  Synthetic oligonucleotide
acatgggaggggggggggggaggtaggagcgagggga

SEQ ID NO: 195393 - DNA, 37 bp, Artificial Sequence
  Synthetic oligonucleotide
gtgggcaagtgagttctgggggggtgggcggagggga

SEQ ID NO: 195394 - DNA, 35 bp, Artificial Sequence
  Synthetic oligonucleotide
gtaggggccgattaagacactagggtgggagggga

SEQ ID NO: 195395 - DNA, 37 bp, Artificial Sequence
  Synthetic oligonucleotide
aagtccatgggggagaaggggggcaaaagcaggggga

SEQ ID NO: 195396 - DNA, 36 bp, Artificial Sequence
  Synthetic oligonucleotide
atcgcacaccgcgcgtcgataccctctccctttgga

SEQ ID NO: 195397 - DNA, 37 bp, Artificial Sequence
  Synthetic oligonucleotide
accagtcacacctgctttactagccctgccgtttgga

SEQ ID NO: 195398 - DNA, 38 bp, Artificial Sequence
  Synthetic oligonucleotide
taccccgacctctgaacttatagccgcaccattcatga

SEQ ID NO: 195399 - DNA, 37 bp, Artificial Sequence
  Synthetic oligonucleotide
tcattagctcatccctgccctcctcgacgtcgtatga

SEQ ID NO: 195400 - DNA, 36 bp, Artificial Sequence
  Synthetic oligonucleotide
gacagtgcggagggtcggaaccggaggggggactga

SEQ ID NO: 195401 - DNA, 37 bp, Artificial Sequence
  Synthetic oligonucleotide
acaacccacggatcttatacgccacgtaaccccctga

SEQ ID NO: 195402 - DNA, 38 bp, Artificial Sequence
  Synthetic oligonucleotide
tcctcgagcatcactcgttttactcaacttctccctga

SEQ ID NO: 195403 - DNA, 38 bp, Artificial Sequence
  Synthetic oligonucleotide
gcatcacgccttgactataactgttccaccatatctga

SEQ ID NO: 195404 - DNA, 38 bp, Artificial Sequence
  Synthetic oligonucleotide
gcccgccgcttctatgcattgccttgtcccatctctga

SEQ ID NO: 195405 - DNA, 38 bp, Artificial Sequence
  Synthetic oligonucleotide
acactggtgtagcagtgttttcgttccttcaattctga

SEQ ID NO: 195406 - DNA, 38 bp, Artificial Sequence
  Synthetic oligonucleotide
gagagaacaggggaggtaggagccgagtgagcgagtga

SEQ ID NO: 195407 - DNA, 38 bp, Artificial Sequence
  Synthetic oligonucleotide
agagggaacagtagcgatagaagggccggggcgagtga

SEQ ID NO: 195408 - DNA, 37 bp, Artificial Sequence
  Synthetic oligonucleotide
tgcacgccccggtgccgctccatatatctcttagtga

SEQ ID NO: 195409 - DNA, 38 bp, Artificial Sequence
  Synthetic oligonucleotide
gcaggtacgggcctagggaggggaagggatgagcgtga

SEQ ID NO: 195410 - DNA, 37 bp, Artificial Sequence
  Synthetic oligonucleotide
tgtggggaggagggggggggattaacatgagcattga

SEQ ID NO: 195411 - DNA, 38 bp, Artificial Sequence
  Synthetic oligonucleotide
aacgtccagccgtatcaccgtctttaccgccctcttga

SEQ ID NO: 195412 - DNA, 37 bp, Artificial Sequence
  Synthetic oligonucleotide
atccacatcccctagctccacccaaggacagtgttga

SEQ ID NO: 195413 - DNA, 33 bp, Artificial Sequence
  Synthetic oligonucleotide
gccgaccctcacccggtaaagcccgattgcata

SEQ ID NO: 195414 - DNA, 35 bp, Artificial Sequence
  Synthetic oligonucleotide
gagccgccagctctgttccaactctactaccacta

SEQ ID NO: 195415 - DNA, 35 bp, Artificial Sequence
  Synthetic oligonucleotide
acccccagacctcatgcgtttcgctttcgaaccta

SEQ ID NO: 195416 - DNA, 35 bp, Artificial Sequence
  Synthetic oligonucleotide
tccgcaacttcccgccctgatccgccttgtttcta

SEQ ID NO: 195417 - DNA, 36 bp, Artificial Sequence
  Synthetic oligonucleotide
gtggagcacaaagggacaaaaggaggagagttcgta

SEQ ID NO: 195418 - DNA, 35 bp, Artificial Sequence
  Synthetic oligonucleotide
gatgcttgcgcctgccgtcgcctacccgttcatta

SEQ ID NO: 195419 - DNA, 35 bp, Artificial Sequence
  Synthetic oligonucleotide
tgttgccatccatctggcggacgaccaaactcaac

SEQ ID NO: 195420 - DNA, 35 bp, Artificial Sequence
  Synthetic oligonucleotide
tcaactcccgagctctcgcctgatcgtctcttcac

SEQ ID NO: 195421 - DNA, 35 bp, Artificial Sequence
  Synthetic oligonucleotide
tcttgcctccgcaacaccctcaggccgtacgcgac

SEQ ID NO: 195422 - DNA, 35 bp, Artificial Sequence
  Synthetic oligonucleotide
tccacgccttctgggccctcgaccatgcattcacc

SEQ ID NO: 195423 - DNA, 35 bp, Artificial Sequence
  Synthetic oligonucleotide
tacttgtgcccccatgctgaacctcgtcacaaccc

SEQ ID NO: 195424 - DNA, 35 bp, Artificial Sequence
  Synthetic oligonucleotide
tagcgctggtaagattcttcaattgccatcccccc

SEQ ID NO: 195425 - DNA, 35 bp, Artificial Sequence
  Synthetic oligonucleotide
gtgtgtcccgctcgacgtacttcaacgacctcccc

SEQ ID NO: 195426 - DNA, 34 bp, Artificial Sequence
  Synthetic oligonucleotide
gactccaattcgtttatctgtcatcatggtcccc

SEQ ID NO: 195427 - DNA, 35 bp, Artificial Sequence
  Synthetic oligonucleotide
tgaccccagccccaaacattgctactctcgtgccc

SEQ ID NO: 195428 - DNA, 35 bp, Artificial Sequence
  Synthetic oligonucleotide
tctcgggtcagtactcggtgcaacatccccttccc

SEQ ID NO: 195429 - DNA, 35 bp, Artificial Sequence
  Synthetic oligonucleotide
gtcacactcagttctgcgcctactttatcaccgcc

SEQ ID NO: 195430 - DNA, 35 bp, Artificial Sequence
  Synthetic oligonucleotide
tcgtacgttgcccatgtctaatccacaccctcgcc

SEQ ID NO: 195431 - DNA, 35 bp, Artificial Sequence
  Synthetic oligonucleotide
acaccacctcacaatctgtgcttcttaccctggcc

SEQ ID NO: 195432 - DNA, 35 bp, Artificial Sequence
  Synthetic oligonucleotide
gatggggggaggggcgggtgtattcggcatttgcc

SEQ ID NO: 195433 - DNA, 35 bp, Artificial Sequence
  Synthetic oligonucleotide
gccctccgaaccgaccggttgcacaagaccgctcc

SEQ ID NO: 195434 - DNA, 35 bp, Artificial Sequence
  Synthetic oligonucleotide
gccccctgtcgcagcctactttacgttgtccttcc

SEQ ID NO: 195435 - DNA, 35 bp, Artificial Sequence
  Synthetic oligonucleotide
gtgcggtccaaaagttgctgtgctctggtctttcc

SEQ ID NO: 195436 - DNA, 35 bp, Artificial Sequence
  Synthetic oligonucleotide
gacgaggtagtggtgggtgggtgcggcggaggagc

SEQ ID NO: 195437 - DNA, 35 bp, Artificial Sequence
  Synthetic oligonucleotide
taaggagccactaggggagaagggtctgggggagc

SEQ ID NO: 195438 - DNA, 35 bp, Artificial Sequence
  Synthetic oligonucleotide
tgcctacctcactactctttttccctgctacgggc

SEQ ID NO: 195439 - DNA, 35 bp, Artificial Sequence
  Synthetic oligonucleotide
ttgccgcaccaccctgcgccttacaatatagctgc

SEQ ID NO: 195440 - DNA, 35 bp, Artificial Sequence
  Synthetic oligonucleotide
tgccaacggttacatcctcgagtgcgatcccttgc

SEQ ID NO: 195441 - DNA, 27 bp, Artificial Sequence
  Synthetic oligonucleotide
attccgtcgtatcgagcctaccccatc

SEQ ID NO: 195442 - DNA, 35 bp, Artificial Sequence
  Synthetic oligonucleotide
ttcatggcgaagtgttttgttgcccttcctgcatc

SEQ ID NO: 195443 - DNA, 35 bp, Artificial Sequence
  Synthetic oligonucleotide
tcattcctccgtgctctcacctctccaccgcgatc

SEQ ID NO: 195444 - DNA, 35 bp, Artificial Sequence
  Synthetic oligonucleotide
tgaatcgccgtcggtacccgcgaaagtctaccctc

SEQ ID NO: 195445 - DNA, 35 bp, Artificial Sequence
  Synthetic oligonucleotide
tctacaatcggcacatttgacatccccttttgctc

SEQ ID NO: 195446 - DNA, 35 bp, Artificial Sequence
  Synthetic oligonucleotide
ttccagcgtacacgctttctatcggctgttctctc

SEQ ID NO: 195447 - DNA, 35 bp, Artificial Sequence
  Synthetic oligonucleotide
actgatccgccatccgctttgtatcctccgtggtc

SEQ ID NO: 195448 - DNA, 35 bp, Artificial Sequence
  Synthetic oligonucleotide
ttgtcccccctttggcgaatttgcacctgttggtc

SEQ ID NO: 195449 - DNA, 35 bp, Artificial Sequence
  Synthetic oligonucleotide
gctggcgacggttttcgctttcctgtacccttgtc

SEQ ID NO: 195450 - DNA, 35 bp, Artificial Sequence
  Synthetic oligonucleotide
tagccgcataccgaccgttctgcccgccgcctttc

SEQ ID NO: 195451 - DNA, 35 bp, Artificial Sequence
  Synthetic oligonucleotide
attccccgctcggctaggtcgcgccacacctttag

SEQ ID NO: 195452 - DNA, 35 bp, Artificial Sequence
  Synthetic oligonucleotide
tgtacgcctctgcctacataacaaccctcatgacg

SEQ ID NO: 195453 - DNA, 35 bp, Artificial Sequence
  Synthetic oligonucleotide
gagctggggggtgggtagggacaggaactatgacg

SEQ ID NO: 195454 - DNA, 35 bp, Artificial Sequence
  Synthetic oligonucleotide
gtgagctgcacgctctatcctatgcctatcacccg

SEQ ID NO: 195455 - DNA, 35 bp, Artificial Sequence
  Synthetic oligonucleotide
tccgaacttggagagcgccactaactttccccccg

SEQ ID NO: 195456 - DNA, 35 bp, Artificial Sequence
  Synthetic oligonucleotide
tcaggttcagaccggaaggggggggccggggaagg

SEQ ID NO: 195457 - DNA, 34 bp, Artificial Sequence
  Synthetic oligonucleotide
gccgagaagaagggaggcataaggggcaagcagg

SEQ ID NO: 195458 - DNA, 35 bp, Artificial Sequence
  Synthetic oligonucleotide
gagggcataagatagggaactgggaggggacgagg

SEQ ID NO: 195459 - DNA, 35 bp, Artificial Sequence
  Synthetic oligonucleotide
taggactcgtggacggcggatgaagggtgggtcgg

SEQ ID NO: 195460 - DNA, 36 bp, Artificial Sequence
  Synthetic oligonucleotide
agactcgtaccacccccatcaggcatcggccccctg

SEQ ID NO: 195461 - DNA, 35 bp, Artificial Sequence
  Synthetic oligonucleotide
ttggattgcctcggtggaaaccgcccctctctctg

SEQ ID NO: 195462 - DNA, 35 bp, Artificial Sequence
  Synthetic oligonucleotide
aggacggtggctgttttcttcgttgtccctctgtg

SEQ ID NO: 195463 - DNA, 35 bp, Artificial Sequence
  Synthetic oligonucleotide
acagactggtcaatcgggttgggtggagggtattg

SEQ ID NO: 195464 - DNA, 36 bp, Artificial Sequence
  Synthetic oligonucleotide
acagcccgcgcgtgtttatgcctatcttctgccttg

SEQ ID NO: 195465 - DNA, 35 bp, Artificial Sequence
  Synthetic oligonucleotide
aagacgcagttcgcatcagccgactccatctcttg

SEQ ID NO: 195466 - DNA, 35 bp, Artificial Sequence
  Synthetic oligonucleotide
gatgaacagagtggtggagaagtagggcggggcat

SEQ ID NO: 195467 - DNA, 35 bp, Artificial Sequence
  Synthetic oligonucleotide
atcgcccctcactgccctgattcgccgtattctat

SEQ ID NO: 195468 - DNA, 35 bp, Artificial Sequence
  Synthetic oligonucleotide
tcatggcctatcctttcgctggtctagccccttat

SEQ ID NO: 195469 - DNA, 35 bp, Artificial Sequence
  Synthetic oligonucleotide
acgtactccccataccgttacgactaggataccct

SEQ ID NO: 195470 - DNA, 35 bp, Artificial Sequence
  Synthetic oligonucleotide
gctgtcatccaattgtctgcttactcctcttgcct

SEQ ID NO: 195471 - DNA, 35 bp, Artificial Sequence
  Synthetic oligonucleotide
gtcacgacacgcatttgcatctcgcccaaagtcct

SEQ ID NO: 195472 - DNA, 35 bp, Artificial Sequence
  Synthetic oligonucleotide
agccacaccccgccatgttagcgtttacgcgtcct

SEQ ID NO: 195473 - DNA, 35 bp, Artificial Sequence
  Synthetic oligonucleotide
ggcaactacccgcaacgtgtctacgcacctgtcct

SEQ ID NO: 195474 - DNA, 35 bp, Artificial Sequence
  Synthetic oligonucleotide
gttcactcagtctcgcccttccttgaagccttcct

SEQ ID NO: 195475 - DNA, 35 bp, Artificial Sequence
  Synthetic oligonucleotide
taactgcaacgactccggtcccacaccctgttcct

SEQ ID NO: 195476 - DNA, 35 bp, Artificial Sequence
  Synthetic oligonucleotide
atcattggcctcagccgcatagcctttcccgctct

SEQ ID NO: 195477 - DNA, 34 bp, Artificial Sequence
  Synthetic oligonucleotide
tccgcctggtccctcctatcgcgtatcgacgtct

SEQ ID NO: 195478 - DNA, 35 bp, Artificial Sequence
  Synthetic oligonucleotide
actcccgctaccagaatcacctaggcgctgtttct

SEQ ID NO: 195479 - DNA, 35 bp, Artificial Sequence
  Synthetic oligonucleotide
actgtgcaatcaccatctgtatcgctaccattcgt

SEQ ID NO: 195480 - DNA, 36 bp, Artificial Sequence
  Synthetic oligonucleotide
gaggggtaaggggtgggggtgcaaagtggcgactgt

SEQ ID NO: 195481 - DNA, 35 bp, Artificial Sequence
  Synthetic oligonucleotide
agacacccgacgtccacctctcctaactggccatt

SEQ ID NO: 195482 - DNA, 35 bp, Artificial Sequence
  Synthetic oligonucleotide
tcacccgctgtcccccgttttattcgcgttcattt

SEQ ID NO: 195483 - DNA, 35 bp, Artificial Sequence
  Synthetic oligonucleotide
gtgggtcgatgggatctagggagggcgcattattt

SEQ ID NO: 195484 - DNA, 35 bp, Artificial Sequence
  Synthetic oligonucleotide
agatcgagcggaggttggcttattcctggttgttt

SEQ ID NO: 195485 - DNA, 35 bp, Artificial Sequence
  Synthetic oligonucleotide
tgttaccaggtgcactttgtcttactgcttctttt

SEQ ID NO: 195486 - DNA, 36 bp, Artificial Sequence
  Synthetic oligonucleotide
gaagccccagacttcgaaatatgcaccacctcacaa

SEQ ID NO: 195487 - DNA, 35 bp, Artificial Sequence
  Synthetic oligonucleotide
tcaacctatgtgcttatctcgcctgatcccaccaa

SEQ ID NO: 195488 - DNA, 35 bp, Artificial Sequence
  Synthetic oligonucleotide
acattcgccacattgatatgcccccattgcaccaa

SEQ ID NO: 195489 - DNA, 36 bp, Artificial Sequence
  Synthetic oligonucleotide
tcgctacatccatcccgcgtaattagcggctctcaa

SEQ ID NO: 195490 - DNA, 35 bp, Artificial Sequence
  Synthetic oligonucleotide
aagaggatggaagtaaggtagggagcataagggaa

SEQ ID NO: 195491 - DNA, 36 bp, Artificial Sequence
  Synthetic oligonucleotide
gacgcccccatgctataattaatggtatgtccccca

SEQ ID NO: 195492 - DNA, 35 bp, Artificial Sequence
  Synthetic oligonucleotide
acaccttacgtcatttgcccccggacccctcgcca

SEQ ID NO: 195493 - DNA, 36 bp, Artificial Sequence
  Synthetic oligonucleotide
acatcacgttcgcctagtctttccagctcccggcca

SEQ ID NO: 195494 - DNA, 35 bp, Artificial Sequence
  Synthetic oligonucleotide
gccgccccgccgcggtaccacacatactcgctcca

SEQ ID NO: 195495 - DNA, 35 bp, Artificial Sequence
  Synthetic oligonucleotide
ttctacctccagatcttgacatctaccggcttcca

SEQ ID NO: 195496 - DNA, 35 bp, Artificial Sequence
  Synthetic oligonucleotide
tctgtcccaccgacttgtcctgcccttgcatcgca

SEQ ID NO: 195497 - DNA, 36 bp, Artificial Sequence
  Synthetic oligonucleotide
ttggtcacatacaaaacggtggagaggggggaggca

SEQ ID NO: 195498 - DNA, 36 bp, Artificial Sequence
  Synthetic oligonucleotide
gaaggcgagaactgggtggaggaatgaggagcggca

SEQ ID NO: 195499 - DNA, 35 bp, Artificial Sequence
  Synthetic oligonucleotide
acagccattctgtcaggctcatcgcctccgctgca

SEQ ID NO: 195500 - DNA, 34 bp, Artificial Sequence
  Synthetic oligonucleotide
acggtaccaccgctgagcatcttctccccgatca

SEQ ID NO: 195501 - DNA, 36 bp, Artificial Sequence
  Synthetic oligonucleotide
gccgccccgggactcctacatgacaggccgctctca

SEQ ID NO: 195502 - DNA, 36 bp, Artificial Sequence
  Synthetic oligonucleotide
gggaagtcgagggccagtgggcggagaagggcaaga

SEQ ID NO: 195503 - DNA, 38 bp, Artificial Sequence
  Synthetic oligonucleotide
gatcggttgccatgcgagggaggaaggggcggagaaga

SEQ ID NO: 195504 - DNA, 37 bp, Artificial Sequence
  Synthetic oligonucleotide
aaccaagggggaaaggaaggacaggagaatcggcaga

SEQ ID NO: 195505 - DNA, 37 bp, Artificial Sequence
  Synthetic oligonucleotide
gtggaggacaggggaataggcacggggattatagaga

SEQ ID NO: 195506 - DNA, 37 bp, Artificial Sequence
  Synthetic oligonucleotide
atcgtccactcccaggttcctcgtctactctccgaga

SEQ ID NO: 195507 - DNA, 37 bp, Artificial Sequence
  Synthetic oligonucleotide
tgagccgttggggtgcaaacggaacgagggggggaga

SEQ ID NO: 195508 - DNA, 35 bp, Artificial Sequence
  Synthetic oligonucleotide
tccctgacccagttctgcttactgccggatcacga

SEQ ID NO: 195509 - DNA, 35 bp, Artificial Sequence
  Synthetic oligonucleotide
gatgcctgtgtccgtttcgagccgcatccccccga

SEQ ID NO: 195510 - DNA, 36 bp, Artificial Sequence
  Synthetic oligonucleotide
acagtctacccctctgccatgttgatccattcgcga

SEQ ID NO: 195511 - DNA, 37 bp, Artificial Sequence
  Synthetic oligonucleotide
ggaatggtggcaatggggagcaggggacggttggcga

SEQ ID NO: 195512 - DNA, 37 bp, Artificial Sequence
  Synthetic oligonucleotide
gagtgcgggtggagggtgtgggcgcggggattgagga

SEQ ID NO: 195513 - DNA, 36 bp, Artificial Sequence
  Synthetic oligonucleotide
tgtgaacaacgttagggggggaaggagtggctagga

SEQ ID NO: 195514 - DNA, 37 bp, Artificial Sequence
  Synthetic oligonucleotide
gcgttgggcggggggggtgtaacggaggggacccgga

SEQ ID NO: 195515 - DNA, 37 bp, Artificial Sequence
  Synthetic oligonucleotide
atgctgcccacctacctcgttgcccctccttcccgga

SEQ ID NO: 195516 - DNA, 37 bp, Artificial Sequence
  Synthetic oligonucleotide
acatccacctccacgctcctgagcttgccactcggga

SEQ ID NO: 195517 - DNA, 36 bp, Artificial Sequence
  Synthetic oligonucleotide
gtcaacgaagggcggggggggcttagactcatggga

SEQ ID NO: 195518 - DNA, 37 bp, Artificial Sequence
  Synthetic oligonucleotide
gctgggacagggaaggtgttggaatggggaaaatgga

SEQ ID NO: 195519 - DNA, 37 bp, Artificial Sequence
  Synthetic oligonucleotide
ggacaccaccctgctactgtgtcaatcctttcgtgga

SEQ ID NO: 195520 - DNA, 38 bp, Artificial Sequence
  Synthetic oligonucleotide
gatcccgctcaatcgtaacacgaacccttccgccatga

SEQ ID NO: 195521 - DNA, 38 bp, Artificial Sequence
  Synthetic oligonucleotide
gcgaaaacgctcccatctctaacgtactccatccatga

SEQ ID NO: 195522 - DNA, 38 bp, Artificial Sequence
  Synthetic oligonucleotide
tgttgctgtcctttttggtttcccgtcgcccttcatga

SEQ ID NO: 195523 - DNA, 38 bp, Artificial Sequence
  Synthetic oligonucleotide
accgtcatcccgccttcctgcctgcgctgacactatga

SEQ ID NO: 195524 - DNA, 38 bp, Artificial Sequence
  Synthetic oligonucleotide
gacaacatcaacgtattttacgctgcactcccacctga

SEQ ID NO: 195525 - DNA, 35 bp, Artificial Sequence
  Synthetic oligonucleotide
tcatagtgcgcccgactccttcctatcagacctga

SEQ ID NO: 195526 - DNA, 37 bp, Artificial Sequence
  Synthetic oligonucleotide
gaacccgtgctctgacctgactttgaacccgccctga

SEQ ID NO: 195527 - DNA, 38 bp, Artificial Sequence
  Synthetic oligonucleotide
gtcaaggggggagggaagtgtgagagggggaggcctga

SEQ ID NO: 195528 - DNA, 37 bp, Artificial Sequence
  Synthetic oligonucleotide
tggactcgcgacaccgtgcctctatttcccgtcctga

SEQ ID NO: 195529 - DNA, 38 bp, Artificial Sequence
  Synthetic oligonucleotide
acgcacgatcacatctgacccatccgctccggtcctga

SEQ ID NO: 195530 - DNA, 37 bp, Artificial Sequence
  Synthetic oligonucleotide
agccgtcgctccaatttttactctcgccctgtcctga

SEQ ID NO: 195531 - DNA, 36 bp, Artificial Sequence
  Synthetic oligonucleotide
gtcgtgaacaggaggaagtgggagaggggcggctga

SEQ ID NO: 195532 - DNA, 37 bp, Artificial Sequence
  Synthetic oligonucleotide
gcaggaagggtggaggagatagggcgaggggccgtga

SEQ ID NO: 195533 - DNA, 36 bp, Artificial Sequence
  Synthetic oligonucleotide
ggtgctaccctcttgctccgttaatatcacctttga

SEQ ID NO: 195534 - DNA, 35 bp, Artificial Sequence
  Synthetic oligonucleotide
agacaccacagtcctcctgatttcgggtccctata

SEQ ID NO: 195535 - DNA, 35 bp, Artificial Sequence
  Synthetic oligonucleotide
tacacctccctcagacattttgatcctctagccta

SEQ ID NO: 195536 - DNA, 36 bp, Artificial Sequence
  Synthetic oligonucleotide
tgacacgccggtggttattattattcgtcacgccta

SEQ ID NO: 195537 - DNA, 35 bp, Artificial Sequence
  Synthetic oligonucleotide
tgcccaccagttcggtatctctccccagccatcta

SEQ ID NO: 195538 - DNA, 35 bp, Artificial Sequence
  Synthetic oligonucleotide
acgtgagcctcaagcttagaactccccttcatcta

SEQ ID NO: 195539 - DNA, 35 bp, Artificial Sequence
  Synthetic oligonucleotide
cccgccccaccctgagtctagacttgaccacctta

SEQ ID NO: 195540 - DNA, 36 bp, Artificial Sequence
  Synthetic oligonucleotide
tatcgcatccgtgcgtgctgctagatccccctctta

SEQ ID NO: 195541 - DNA, 35 bp, Artificial Sequence
  Synthetic oligonucleotide
tccatgccaccccgcgtaatcgtcacgccctacac

SEQ ID NO: 195542 - DNA, 35 bp, Artificial Sequence
  Synthetic oligonucleotide
tgcatcctgtgggtatgcgcccactactgctccac

SEQ ID NO: 195543 - DNA, 35 bp, Artificial Sequence
  Synthetic oligonucleotide
gcccaacatcttacacgcgtattcggggtcttcac

SEQ ID NO: 195544 - DNA, 35 bp, Artificial Sequence
  Synthetic oligonucleotide
tctgtaccaccgactgtgctcattttacttttcac

SEQ ID NO: 195545 - DNA, 35 bp, Artificial Sequence
  Synthetic oligonucleotide
acactcgcgctgtgttatcctctgccgcaatgtac

SEQ ID NO: 195546 - DNA, 35 bp, Artificial Sequence
  Synthetic oligonucleotide
tccggagccacaccggtgttcaatgccctcctacc

SEQ ID NO: 195547 - DNA, 35 bp, Artificial Sequence
  Synthetic oligonucleotide
tacttcatgcaagcagctgtacttcttctaccccc

SEQ ID NO: 195548 - DNA, 35 bp, Artificial Sequence
  Synthetic oligonucleotide
gtatggtccggttagttgtcgttagccgtcgcccc

SEQ ID NO: 195549 - DNA, 35 bp, Artificial Sequence
  Synthetic oligonucleotide
aacgcctcgcgttcgcaattgttcttacgcctccc

SEQ ID NO: 195550 - DNA, 35 bp, Artificial Sequence
  Synthetic oligonucleotide
tacccccgtcccaccctttcgagctgatgaacgcc

SEQ ID NO: 195551 - DNA, 35 bp, Artificial Sequence
  Synthetic oligonucleotide
ttgacaccccgttacatagatctagtttcaccgcc

SEQ ID NO: 195552 - DNA, 35 bp, Artificial Sequence
  Synthetic oligonucleotide
gacacgccggttcggacgagaaccttccatccgcc

SEQ ID NO: 195553 - DNA, 35 bp, Artificial Sequence
  Synthetic oligonucleotide
gtaagccaatgccgccagttctaataccttcgtcc

SEQ ID NO: 195554 - DNA, 35 bp, Artificial Sequence
  Synthetic oligonucleotide
tccgaggcgatgcgcatcatggtcacctcccttcc

SEQ ID NO: 195555 - DNA, 35 bp, Artificial Sequence
  Synthetic oligonucleotide
gcactgacgagttatgggctacgtcactgccttcc

SEQ ID NO: 195556 - DNA, 35 bp, Artificial Sequence
  Synthetic oligonucleotide
tcagccctcacttctctatcatcgggtccaacagc

SEQ ID NO: 195557 - DNA, 35 bp, Artificial Sequence
  Synthetic oligonucleotide
ttcgtaccccacccgctagtcacagtcaccctcgc

SEQ ID NO: 195558 - DNA, 35 bp, Artificial Sequence
  Synthetic oligonucleotide
tcatccgccgtatcccctgttgtaaaccatctcgc

SEQ ID NO: 195559 - DNA, 34 bp, Artificial Sequence
  Synthetic oligonucleotide
gccacgcccatgccccgaagccctccgcctaggc

SEQ ID NO: 195560 - DNA, 35 bp, Artificial Sequence
  Synthetic oligonucleotide
ttacgagagcgtgagttcgccctccctatccatgc

SEQ ID NO: 195561 - DNA, 35 bp, Artificial Sequence
  Synthetic oligonucleotide
taactgcgtgagtgttgtccgtactccattcctgc

SEQ ID NO: 195562 - DNA, 35 bp, Artificial Sequence
  Synthetic oligonucleotide
gcctgtgtacgataatgcataccgcccacctctgc

SEQ ID NO: 195563 - DNA, 35 bp, Artificial Sequence
  Synthetic oligonucleotide
tgtcggggggggattccatgggtgggcgaaggtgc

SEQ ID NO: 195564 - DNA, 34 bp, Artificial Sequence
  Synthetic oligonucleotide
tcacactcgtgttgcccctcccggttttacaatc

SEQ ID NO: 195565 - DNA, 35 bp, Artificial Sequence
  Synthetic oligonucleotide
accccaagcccacagcgttcatttgccactgcatc

SEQ ID NO: 195566 - DNA, 35 bp, Artificial Sequence
  Synthetic oligonucleotide
tctggggcacattgttaacttgtctccactctatc

SEQ ID NO: 195567 - DNA, 35 bp, Artificial Sequence
  Synthetic oligonucleotide
tcctgactgcctcgagtttcgcgtcaccacttatc

SEQ ID NO: 195568 - DNA, 35 bp, Artificial Sequence
  Synthetic oligonucleotide
gtccccgtaatgttagcgtcgctcatctgaacctc

SEQ ID NO: 195569 - DNA, 35 bp, Artificial Sequence
  Synthetic oligonucleotide
gaggccgattcccgtgcattcagcatactcacctc

SEQ ID NO: 195570 - DNA, 35 bp, Artificial Sequence
  Synthetic oligonucleotide
atccttgcccctcgatgcctcccgatcacgccctc

SEQ ID NO: 195571 - DNA, 35 bp, Artificial Sequence
  Synthetic oligonucleotide
tcctacatctgccgttgttgtatggcgctgccctc

SEQ ID NO: 195572 - DNA, 35 bp, Artificial Sequence
  Synthetic oligonucleotide
gtaccttgtgcgcgctcacttgatcgtccctcctc

SEQ ID NO: 195573 - DNA, 35 bp, Artificial Sequence
  Synthetic oligonucleotide
tgcggagcatctttgtactttattgtcccttcctc

SEQ ID NO: 195574 - DNA, 35 bp, Artificial Sequence
  Synthetic oligonucleotide
atgccaccgatagtaacctgcccacgaattccgtc

SEQ ID NO: 195575 - DNA, 35 bp, Artificial Sequence
  Synthetic oligonucleotide
ttgcccgccccatcacggttacgtttgtcaatgtc

SEQ ID NO: 195576 - DNA, 35 bp, Artificial Sequence
  Synthetic oligonucleotide
gacgcacaaccccgcagttgaccatccatgttgtc

SEQ ID NO: 195577 - DNA, 35 bp, Artificial Sequence
  Synthetic oligonucleotide
tgatggcccaccgaactcgtcgacacactatattc

SEQ ID NO: 195578 - DNA, 35 bp, Artificial Sequence
  Synthetic oligonucleotide
tctgtcagacgcgcgtgtagctatgtcgcccgttc

SEQ ID NO: 195579 - DNA, 35 bp, Artificial Sequence
  Synthetic oligonucleotide
tgcggagccgtttgccttgtatttccccgagtttc

SEQ ID NO: 195580 - DNA, 34 bp, Artificial Sequence
  Synthetic oligonucleotide
taccttcatccgactgacccattcaacacctgag

SEQ ID NO: 195581 - DNA, 35 bp, Artificial Sequence
  Synthetic oligonucleotide
ttcccgtagagtgcattgtaccatcccccgtttag

SEQ ID NO: 195582 - DNA, 35 bp, Artificial Sequence
  Synthetic oligonucleotide
gtccatccccccctaagtagcgttaataacgtacg

SEQ ID NO: 195583 - DNA, 35 bp, Artificial Sequence
  Synthetic oligonucleotide
tcatcctgtgcgcaatcggtattatctcctgcccg

SEQ ID NO: 195584 - DNA, 35 bp, Artificial Sequence
  Synthetic oligonucleotide
tactctaacacgtgcccctctgctgcctatccgcg

SEQ ID NO: 195585 - DNA, 35 bp, Artificial Sequence
  Synthetic oligonucleotide
acacggtctctgtagctggccgcaaatctttctcg

SEQ ID NO: 195586 - DNA, 35 bp, Artificial Sequence
  Synthetic oligonucleotide
tagtcgacaccatctatagtcattccgccttgtcg

SEQ ID NO: 195587 - DNA, 35 bp, Artificial Sequence
  Synthetic oligonucleotide
tcgagctcatgttgcctcctgtcatgctctcttcg

SEQ ID NO: 195588 - DNA, 35 bp, Artificial Sequence
  Synthetic oligonucleotide
gtggggctgagtaagggggggactagtaggaaggg

SEQ ID NO: 195589 - DNA, 35 bp, Artificial Sequence
  Synthetic oligonucleotide
tgcggggtgggtgagaacaaggataggggattggg

SEQ ID NO: 195590 - DNA, 35 bp, Artificial Sequence
  Synthetic oligonucleotide
acacgacgacgcccgatgggtcattgtcccccctg

SEQ ID NO: 195591 - DNA, 35 bp, Artificial Sequence
  Synthetic oligonucleotide
tgtgtagctgccgttcacctgtaccgatcctcctg

SEQ ID NO: 195592 - DNA, 35 bp, Artificial Sequence
  Synthetic oligonucleotide
tgtggggagggaggagtgggtcgcaaagctgagtg

SEQ ID NO: 195593 - DNA, 35 bp, Artificial Sequence
  Synthetic oligonucleotide
acacaccacctaacatgttcgccgttccgatcttg

SEQ ID NO: 195594 - DNA, 35 bp, Artificial Sequence
  Synthetic oligonucleotide
gaagggggggaggaggggggtaggttaaaaacaat

SEQ ID NO: 195595 - DNA, 35 bp, Artificial Sequence
  Synthetic oligonucleotide
agatcacacattcattgcttaattagctacaccat

SEQ ID NO: 195596 - DNA, 35 bp, Artificial Sequence
  Synthetic oligonucleotide
tgcgctcgcccttacacgtgacaccctgcttgcat

SEQ ID NO: 195597 - DNA, 35 bp, Artificial Sequence
  Synthetic oligonucleotide
tagggcgggtgggttatgtgcaaatttcgcgggat

SEQ ID NO: 195598 - DNA, 35 bp, Artificial Sequence
  Synthetic oligonucleotide
gaaacgtcgccgtcctttgtacctccatttacact

SEQ ID NO: 195599 - DNA, 35 bp, Artificial Sequence
  Synthetic oligonucleotide
gcgaacctcgtgtcgtccgcaccttccggttcact

SEQ ID NO: 195600 - DNA, 35 bp, Artificial Sequence
  Synthetic oligonucleotide
gtcgcgacactaactgcccgagtttcctaacccct

SEQ ID NO: 195601 - DNA, 35 bp, Artificial Sequence
  Synthetic oligonucleotide
acgtgccctctgttgtccccatacgttcctgccct

SEQ ID NO: 195602 - DNA, 35 bp, Artificial Sequence
  Synthetic oligonucleotide
tggtctcatccaatccgatattcggcatcctccct

SEQ ID NO: 195603 - DNA, 35 bp, Artificial Sequence
  Synthetic oligonucleotide
tgagacatcacccctccgaccgacacagtagtcct

SEQ ID NO: 195604 - DNA, 35 bp, Artificial Sequence
  Synthetic oligonucleotide
tctcgtgtgcagatcgcgcaagcctaccatttcct

SEQ ID NO: 195605 - DNA, 35 bp, Artificial Sequence
  Synthetic oligonucleotide
ttcagcacgcttgctggtcccatgccctatacgct

SEQ ID NO: 195606 - DNA, 35 bp, Artificial Sequence
  Synthetic oligonucleotide
accaccttcgctcggatcagtgctatgcatcctct

SEQ ID NO: 195607 - DNA, 35 bp, Artificial Sequence
  Synthetic oligonucleotide
gatggtcgggagaaagagacgcaagaggggtaggt

SEQ ID NO: 195608 - DNA, 35 bp, Artificial Sequence
  Synthetic oligonucleotide
gccactccacactttatgccatgtacatccctggt

SEQ ID NO: 195609 - DNA, 35 bp, Artificial Sequence
  Synthetic oligonucleotide
acatcggggtgggaaagcgggtcggtaagggaatt

SEQ ID NO: 195610 - DNA, 35 bp, Artificial Sequence
  Synthetic oligonucleotide
tgtcgcccgtcatcgagtcctccatcatcttgttt

SEQ ID NO: 195611 - DNA, 35 bp, Artificial Sequence
  Synthetic oligonucleotide
gggggtgacggagggagggaacggggcgtatgaaa

SEQ ID NO: 195612 - DNA, 36 bp, Artificial Sequence
  Synthetic oligonucleotide
gccaccctttagctgccttaactccgccagtcacaa

SEQ ID NO: 195613 - DNA, 36 bp, Artificial Sequence
  Synthetic oligonucleotide
ttcgcatcatacacgtgctgctccgacgcccaccaa

SEQ ID NO: 195614 - DNA, 36 bp, Artificial Sequence
  Synthetic oligonucleotide
attgacacctccttttcctgtattaagcctatccaa

SEQ ID NO: 195615 - DNA, 36 bp, Artificial Sequence
  Synthetic oligonucleotide
tactacgacacgtcgtctaaagcccccgacccgcaa

SEQ ID NO: 195616 - DNA, 35 bp, Artificial Sequence
  Synthetic oligonucleotide
tcgtatccccggcctatttctatccgctccaggaa

SEQ ID NO: 195617 - DNA, 35 bp, Artificial Sequence
  Synthetic oligonucleotide
atccaagtaacgggcggaagggagcgggctaggaa

SEQ ID NO: 195618 - DNA, 36 bp, Artificial Sequence
  Synthetic oligonucleotide
ggtgggatagggaggatggagacggtgcagtgataa

SEQ ID NO: 195619 - DNA, 35 bp, Artificial Sequence
  Synthetic oligonucleotide
gaacaccatctgcgggccaaacacttcacgcttaa

SEQ ID NO: 195620 - DNA, 35 bp, Artificial Sequence
  Synthetic oligonucleotide
accccctctcacaatgtctatagtcgtcccagaca

SEQ ID NO: 195621 - DNA, 35 bp, Artificial Sequence
  Synthetic oligonucleotide
tcacactgtttgcgtgtagtaaccccatccctaca

SEQ ID NO: 195622 - DNA, 36 bp, Artificial Sequence
  Synthetic oligonucleotide
atccctccgcccaccaggttcgtacttgactgacca

SEQ ID NO: 195623 - DNA, 36 bp, Artificial Sequence
  Synthetic oligonucleotide
gtgctccccccagcaatttcgtcgttcatcgaccca

SEQ ID NO: 195624 - DNA, 36 bp, Artificial Sequence
  Synthetic oligonucleotide
gtcacatcatccggcttggtttacgcactgtaccca

SEQ ID NO: 195625 - DNA, 36 bp, Artificial Sequence
  Synthetic oligonucleotide
atgacctcctgtcgcgacgtggcatacatcgcccca

SEQ ID NO: 195626 - DNA, 36 bp, Artificial Sequence
  Synthetic oligonucleotide
tcccgcccatcctctatcatgtctatacgcctccca

SEQ ID NO: 195627 - DNA, 36 bp, Artificial Sequence
  Synthetic oligonucleotide
tacatacgactcatctattgtgccacctcctcgcca

SEQ ID NO: 195628 - DNA, 36 bp, Artificial Sequence
  Synthetic oligonucleotide
tcgttggccccactattgctctagcttccgctgcca

SEQ ID NO: 195629 - DNA, 36 bp, Artificial Sequence
  Synthetic oligonucleotide
tgtccaagtgcatccgtccaatcgccgccattgcca

SEQ ID NO: 195630 - DNA, 33 bp, Artificial Sequence
  Synthetic oligonucleotide
tatggtacgctgcctactgacctattcttgcca

SEQ ID NO: 195631 - DNA, 35 bp, Artificial Sequence
  Synthetic oligonucleotide
ttagacgcgccccgaggccgccagaccctgctcca

SEQ ID NO: 195632 - DNA, 36 bp, Artificial Sequence
  Synthetic oligonucleotide
accatcacccggtcgcctttgcacacgtttcccgca

SEQ ID NO: 195633 - DNA, 35 bp, Artificial Sequence
  Synthetic oligonucleotide
aatcaccgtacctcctgtcaaatgtgcgttctgca

SEQ ID NO: 195634 - DNA, 35 bp, Artificial Sequence
  Synthetic oligonucleotide
gaggaacatcgtcacttacgccccccaccattgca

SEQ ID NO: 195635 - DNA, 36 bp, Artificial Sequence
  Synthetic oligonucleotide
tgtggcaccaaatcttcgtaccgccatgttccctca

SEQ ID NO: 195636 - DNA, 36 bp, Artificial Sequence
  Synthetic oligonucleotide
tccacccatgtcggagcccatgcttcatgaacttca

SEQ ID NO: 195637 - DNA, 37 bp, Artificial Sequence
  Synthetic oligonucleotide
gaacagggtatcggggggcgaatggagaaggcgaaga

SEQ ID NO: 195638 - DNA, 37 bp, Artificial Sequence
  Synthetic oligonucleotide
gtgtcctccgcaggttgtgcttgtactccatccacga

SEQ ID NO: 195639 - DNA, 37 bp, Artificial Sequence
  Synthetic oligonucleotide
ttgccgctcctcggcactccttcccaccatttcacga

SEQ ID NO: 195640 - DNA, 37 bp, Artificial Sequence
  Synthetic oligonucleotide
gcagaaacaaggaagggatcggcgggagagaggacga

SEQ ID NO: 195641 - DNA, 36 bp, Artificial Sequence
  Synthetic oligonucleotide
gatgggcgtgaacgggggaggttacagggctcagga

SEQ ID NO: 195642 - DNA, 37 bp, Artificial Sequence
  Synthetic oligonucleotide
acctctccgccatatggttctttttcgctctctagga

SEQ ID NO: 195643 - DNA, 37 bp, Artificial Sequence
  Synthetic oligonucleotide
accgggaagaggggtcataagaaagggatgggacgga

SEQ ID NO: 195644 - DNA, 35 bp, Artificial Sequence
  Synthetic oligonucleotide
acgcacacccctgccctgccttttcgttcctcgga

SEQ ID NO: 195645 - DNA, 36 bp, Artificial Sequence
  Synthetic oligonucleotide
ggtggaggttcgcaagcggggaaaggaaggttcgga

SEQ ID NO: 195646 - DNA, 37 bp, Artificial Sequence
  Synthetic oligonucleotide
gacaacgattggtgctagggcatgggagggggaggga

SEQ ID NO: 195647 - DNA, 37 bp, Artificial Sequence
  Synthetic oligonucleotide
gtcatcggcaaaggggggcaacggtggatagtaggga

SEQ ID NO: 195648 - DNA, 37 bp, Artificial Sequence
  Synthetic oligonucleotide
gcgagacggagagaagccgcaggacagagggacggga

SEQ ID NO: 195649 - DNA, 37 bp, Artificial Sequence
  Synthetic oligonucleotide
gccacagggttgggtagtatgtggagagagggcggga

SEQ ID NO: 195650 - DNA, 35 bp, Artificial Sequence
  Synthetic oligonucleotide
tccggagaggttaggctgaggatagggggggggga

SEQ ID NO: 195651 - DNA, 37 bp, Artificial Sequence
  Synthetic oligonucleotide
agaaggacaagggtggggaaggcatgggacaatggga

SEQ ID NO: 195652 - DNA, 37 bp, Artificial Sequence
  Synthetic oligonucleotide
ggataagggcgggaagcgtggcaggaaagggatggga

SEQ ID NO: 195653 - DNA, 35 bp, Artificial Sequence
  Synthetic oligonucleotide
tacccacacccgtttttttttccacctcccgtgga

SEQ ID NO: 195654 - DNA, 37 bp, Artificial Sequence
  Synthetic oligonucleotide
tgagaggcgtggagaagaaagacgggggagctgtgga

SEQ ID NO: 195655 - DNA, 38 bp, Artificial Sequence
  Synthetic oligonucleotide
gaggaacaggggagaagagataggccggtgtacaatga

SEQ ID NO: 195656 - DNA, 37 bp, Artificial Sequence
  Synthetic oligonucleotide
tgccccgcgcaacctgttcattgcccgcatcccatga

SEQ ID NO: 195657 - DNA, 38 bp, Artificial Sequence
  Synthetic oligonucleotide
tgaggtggggaagcacaaggtggggaagggtggtatga

SEQ ID NO: 195658 - DNA, 38 bp, Artificial Sequence
  Synthetic oligonucleotide
gagatagggtgaagggagggcggaataagggcttatga

SEQ ID NO: 195659 - DNA, 38 bp, Artificial Sequence
  Synthetic oligonucleotide
ggtccgtcattggaactgcccttctcacgcccgcctga

SEQ ID NO: 195660 - DNA, 38 bp, Artificial Sequence
  Synthetic oligonucleotide
ggtggaaggcgggaggaggggtacactgaagcgcgtga

SEQ ID NO: 195661 - DNA, 38 bp, Artificial Sequence
  Synthetic oligonucleotide
ttgcccgatcgctctgttctcgtccccacctggcgtga

SEQ ID NO: 195662 - DNA, 38 bp, Artificial Sequence
  Synthetic oligonucleotide
gggaggagaatgacggaagaagggagaagtcgtcgtga

SEQ ID NO: 195663 - DNA, 35 bp, Artificial Sequence
  Synthetic oligonucleotide
taaccatgccaggctctccttatgcttccctgtga

SEQ ID NO: 195664 - DNA, 37 bp, Artificial Sequence
  Synthetic oligonucleotide
tgccccccacgctccgttaacatctaggcacttgtga

SEQ ID NO: 195665 - DNA, 38 bp, Artificial Sequence
  Synthetic oligonucleotide
ggaacaaggtggggaaggttaagggggagggtttgtga

SEQ ID NO: 195666 - DNA, 38 bp, Artificial Sequence
  Synthetic oligonucleotide
tgactcgatctgttgctctgatcctcaccttgccttga

SEQ ID NO: 195667 - DNA, 38 bp, Artificial Sequence
  Synthetic oligonucleotide
aagctgggggggaactggcgggagggcaaggggcttga

SEQ ID NO: 195668 - DNA, 35 bp, Artificial Sequence
  Synthetic oligonucleotide
gtccaccgcctccgttctcctgttgcccggaacta

SEQ ID NO: 195669 - DNA, 36 bp, Artificial Sequence
  Synthetic oligonucleotide
tgcgtgtcaccttccctacgcctatattgtgtccta

SEQ ID NO: 195670 - DNA, 27 bp, Artificial Sequence
  Synthetic oligonucleotide
tgactgccctacccccctctgcagcta

SEQ ID NO: 195671 - DNA, 36 bp, Artificial Sequence
  Synthetic oligonucleotide
tcaagcgctccgtcctgcccttgcgttctgattcta

SEQ ID NO: 195672 - DNA, 36 bp, Artificial Sequence
  Synthetic oligonucleotide
tactgcttcgaatcacatgccctctgccttaccgta

SEQ ID NO: 195673 - DNA, 36 bp, Artificial Sequence
  Synthetic oligonucleotide
tcccttccccagtccctcgcgaaccatgtcttcgta

SEQ ID NO: 195674 - DNA, 36 bp, Artificial Sequence
  Synthetic oligonucleotide
agccgcgctgtcttgttgttctcctctccgccatta

SEQ ID NO: 195675 - DNA, 36 bp, Artificial Sequence
  Synthetic oligonucleotide
gtgagagcggtggggaggggtggaggttgcgcatta

SEQ ID NO: 195676 - DNA, 36 bp, Artificial Sequence
  Synthetic oligonucleotide
tataccgcggctgctgatatagccctgcacctctta

SEQ ID NO: 195677 - DNA, 35 bp, Artificial Sequence
  Synthetic oligonucleotide
tccccaccttcatacgtgctcgattcaccttctta

SEQ ID NO: 195678 - DNA, 36 bp, Artificial Sequence
  Synthetic oligonucleotide
tccaccatcccagcgtttccaccgaagacccggtta

SEQ ID NO: 195679 - DNA, 36 bp, Artificial Sequence
  Synthetic oligonucleotide
gctgcactcggctgtctactccctcttttgctgtta

SEQ ID NO: 195680 - DNA, 35 bp, Artificial Sequence
  Synthetic oligonucleotide
tcacaccctctctatgttctctcatggcgtcaaac

SEQ ID NO: 195681 - DNA, 34 bp, Artificial Sequence
  Synthetic oligonucleotide
gtaccatcccctagtagccggttcccctactcac

SEQ ID NO: 195682 - DNA, 35 bp, Artificial Sequence
  Synthetic oligonucleotide
acacgccgagcgtacgccggtgactcacgcctacc

SEQ ID NO: 195683 - DNA, 35 bp, Artificial Sequence
  Synthetic oligonucleotide
ttgcacaaccgtgcaattactgtatttgtttaccc

SEQ ID NO: 195684 - DNA, 35 bp, Artificial Sequence
  Synthetic oligonucleotide
gctcacgcctcggccgttaacctacgaaactgccc

SEQ ID NO: 195685 - DNA, 35 bp, Artificial Sequence
  Synthetic oligonucleotide
acccccaccgtgcacatgagctcagcgctcgtccc

SEQ ID NO: 195686 - DNA, 35 bp, Artificial Sequence
  Synthetic oligonucleotide
atgctctggcggtcctgattagctgcgccgttccc

SEQ ID NO: 195687 - DNA, 35 bp, Artificial Sequence
  Synthetic oligonucleotide
gtgcactgtcgtatctgtacctgccctatgttccc

SEQ ID NO: 195688 - DNA, 35 bp, Artificial Sequence
  Synthetic oligonucleotide
ttccgaccccacgtcgaatatgtcaccttgcagcc

SEQ ID NO: 195689 - DNA, 35 bp, Artificial Sequence
  Synthetic oligonucleotide
tcaaaagcccttcccgttattcccgacgacgcgcc

SEQ ID NO: 195690 - DNA, 35 bp, Artificial Sequence
  Synthetic oligonucleotide
taccccgccgttcgtgaatcccttggctcctatcc

SEQ ID NO: 195691 - DNA, 35 bp, Artificial Sequence
  Synthetic oligonucleotide
gcgcattcggcggtagcctttccagcctgctatcc

SEQ ID NO: 195692 - DNA, 35 bp, Artificial Sequence
  Synthetic oligonucleotide
gccggtcacgttaaagtgatccgcctgtcccctcc

SEQ ID NO: 195693 - DNA, 35 bp, Artificial Sequence
  Synthetic oligonucleotide
atcgagcacgttcgatcttatcggttgccctctcc

SEQ ID NO: 195694 - DNA, 35 bp, Artificial Sequence
  Synthetic oligonucleotide
acacccatacggcatatactaaacctggtcaccgc

SEQ ID NO: 195695 - DNA, 35 bp, Artificial Sequence
  Synthetic oligonucleotide
gccgaccacgatccattgcaaatgccttccctcgc

SEQ ID NO: 195696 - DNA, 35 bp, Artificial Sequence
  Synthetic oligonucleotide
acgagagctaagtctgcttcttctccccgtaatgc

SEQ ID NO: 195697 - DNA, 35 bp, Artificial Sequence
  Synthetic oligonucleotide
ttccaccttcttatgccctcttgccgccattatgc

SEQ ID NO: 195698 - DNA, 35 bp, Artificial Sequence
  Synthetic oligonucleotide
acctacgcctctgacgcccttcccgcatattctgc

SEQ ID NO: 195699 - DNA, 35 bp, Artificial Sequence
  Synthetic oligonucleotide
accggccccgcccaccgcagtcgcgcctactactc

SEQ ID NO: 195700 - DNA, 35 bp, Artificial Sequence
  Synthetic oligonucleotide
gagcggcaaggcacacgcgcatccctcggcccctc

SEQ ID NO: 195701 - DNA, 35 bp, Artificial Sequence
  Synthetic oligonucleotide
tcgtcccacgcggccaactgaggctcccttctctc

SEQ ID NO: 195702 - DNA, 35 bp, Artificial Sequence
  Synthetic oligonucleotide
accatcacagaatggtgcctgcgcccctccccgtc

SEQ ID NO: 195703 - DNA, 35 bp, Artificial Sequence
  Synthetic oligonucleotide
agtcaagtaccgccatacacctgctcactccggtc

SEQ ID NO: 195704 - DNA, 35 bp, Artificial Sequence
  Synthetic oligonucleotide
gaccttacgcgggtgtacccatttgtgccgttgtc

SEQ ID NO: 195705 - DNA, 36 bp, Artificial Sequence
  Synthetic oligonucleotide
gccgtccacttcgactgttttgtatcctttgtcttc

SEQ ID NO: 195706 - DNA, 35 bp, Artificial Sequence
  Synthetic oligonucleotide
tgcccgaccactctgtctgactcgccccccggttc

SEQ ID NO: 195707 - DNA, 35 bp, Artificial Sequence
  Synthetic oligonucleotide
aacccaaccacctaatgttgagtccgttccatttc

SEQ ID NO: 195708 - DNA, 35 bp, Artificial Sequence
  Synthetic oligonucleotide
gatgccaccttgcatatgattctcagccgcatttc

SEQ ID NO: 195709 - DNA, 35 bp, Artificial Sequence
  Synthetic oligonucleotide
actgtaagggggagggaagaatgagaacgattgag

SEQ ID NO: 195710 - DNA, 35 bp, Artificial Sequence
  Synthetic oligonucleotide
tcccacgaaccgcccactctgtagtatacttaacg

SEQ ID NO: 195711 - DNA, 35 bp, Artificial Sequence
  Synthetic oligonucleotide
acccagccttggctccttactatatcgactctacg

SEQ ID NO: 195712 - DNA, 35 bp, Artificial Sequence
  Synthetic oligonucleotide
agttccacacactatataggtctcgctttcacccg

SEQ ID NO: 195713 - DNA, 35 bp, Artificial Sequence
  Synthetic oligonucleotide
gcctactcactatttcaaccgcgtcaactacgccg

SEQ ID NO: 195714 - DNA, 35 bp, Artificial Sequence
  Synthetic oligonucleotide
aaagacagtagtattgatacggaggggagggggcg

SEQ ID NO: 195715 - DNA, 35 bp, Artificial Sequence
  Synthetic oligonucleotide
gccgtggtaggaagggacggggaaagcacggaggg

SEQ ID NO: 195716 - DNA, 35 bp, Artificial Sequence
  Synthetic oligonucleotide
gttcacggggggaggggtagaacgctctcaagggg

SEQ ID NO: 195717 - DNA, 36 bp, Artificial Sequence
  Synthetic oligonucleotide
tgtcgtggcaagaaagcaaaggaggctagggtgggg

SEQ ID NO: 195718 - DNA, 35 bp, Artificial Sequence
  Synthetic oligonucleotide
agagcgggagagggtcagtaaaggaggtgggatgg

SEQ ID NO: 195719 - DNA, 35 bp, Artificial Sequence
  Synthetic oligonucleotide
gattgcgccagtgttaccgtctcttcaacctcctg

SEQ ID NO: 195720 - DNA, 35 bp, Artificial Sequence
  Synthetic oligonucleotide
tgcctgttcactcgtgtgcccccgcccccttcctg

SEQ ID NO: 195721 - DNA, 36 bp, Artificial Sequence
  Synthetic oligonucleotide
acacgcttgctgccggtcttcccttgagcctatctg

SEQ ID NO: 195722 - DNA, 35 bp, Artificial Sequence
  Synthetic oligonucleotide
gttcgcacgagtgtggctgatccatctttctcttg

SEQ ID NO: 195723 - DNA, 35 bp, Artificial Sequence
  Synthetic oligonucleotide
accgctccctcatccggaaattcagtacaactcat

SEQ ID NO: 195724 - DNA, 35 bp, Artificial Sequence
  Synthetic oligonucleotide
ggaaggggggcgagtggattgaaatgaagcgggat

SEQ ID NO: 195725 - DNA, 35 bp, Artificial Sequence
  Synthetic oligonucleotide
gaagtaggaggagaggcaaagggactgtgtatgat

SEQ ID NO: 195726 - DNA, 35 bp, Artificial Sequence
  Synthetic oligonucleotide
tgaaaccccatagcttgcgcggaacactaccctat

SEQ ID NO: 195727 - DNA, 35 bp, Artificial Sequence
  Synthetic oligonucleotide
gccacgcccgctgctaactgctttctgtcctcact

SEQ ID NO: 195728 - DNA, 35 bp, Artificial Sequence
  Synthetic oligonucleotide
gaccagactccgcactggtgtgaacgctctcccct

SEQ ID NO: 195729 - DNA, 35 bp, Artificial Sequence
  Synthetic oligonucleotide
tagacccctgttagcctcgcgatctctcactgcct

SEQ ID NO: 195730 - DNA, 35 bp, Artificial Sequence
  Synthetic oligonucleotide
atctcacaactgttgcttgggctcaccgtactcct

SEQ ID NO: 195731 - DNA, 35 bp, Artificial Sequence
  Synthetic oligonucleotide
gggtggacgaaagacaatgacaggggaggggagct

SEQ ID NO: 195732 - DNA, 35 bp, Artificial Sequence
  Synthetic oligonucleotide
gtttccgtcccttcactcttctagcgtgctctgct

SEQ ID NO: 195733 - DNA, 35 bp, Artificial Sequence
  Synthetic oligonucleotide
tcactgccaacccgccactggccctttcgacctct

SEQ ID NO: 195734 - DNA, 35 bp, Artificial Sequence
  Synthetic oligonucleotide
gacagagggggtggtcggggaacctgaagcgcggt

SEQ ID NO: 195735 - DNA, 35 bp, Artificial Sequence
  Synthetic oligonucleotide
attcgcctaatgcgtgatactcttccctctctggt

SEQ ID NO: 195736 - DNA, 35 bp, Artificial Sequence
  Synthetic oligonucleotide
acatcacacaggccataatcatcgtctttacctgt

SEQ ID NO: 195737 - DNA, 34 bp, Artificial Sequence
  Synthetic oligonucleotide
ggtaacgtgcgaaaggtctctccctctcctctgt

SEQ ID NO: 195738 - DNA, 34 bp, Artificial Sequence
  Synthetic oligonucleotide
gtcgccacctccctgcattgttagctttcacctt

SEQ ID NO: 195739 - DNA, 35 bp, Artificial Sequence
  Synthetic oligonucleotide
tgccaacaccctaaaatgccttaactgtctgcctt

SEQ ID NO: 195740 - DNA, 35 bp, Artificial Sequence
  Synthetic oligonucleotide
aaaaccgccctccgtcccgcgcgccaacagtgctt

SEQ ID NO: 195741 - DNA, 35 bp, Artificial Sequence
  Synthetic oligonucleotide
ttgaatcctggttagtgccaccgttccatcccgtt

SEQ ID NO: 195742 - DNA, 35 bp, Artificial Sequence
  Synthetic oligonucleotide
tacgacaccgttcctaaatgtcccttgccgtcttt

SEQ ID NO: 195743 - DNA, 35 bp, Artificial Sequence
  Synthetic oligonucleotide
gtgcgggggggagtaacgggtaggtgatcggaaaa

SEQ ID NO: 195744 - DNA, 35 bp, Artificial Sequence
  Synthetic oligonucleotide
taggtctgacgtcaagtcttctgttcctcctccaa

SEQ ID NO: 195745 - DNA, 36 bp, Artificial Sequence
  Synthetic oligonucleotide
agtgtgccccgtgctttgaccttcttttttgccgaa

SEQ ID NO: 195746 - DNA, 35 bp, Artificial Sequence
  Synthetic oligonucleotide
gacctccaccgtggttgtctcctacgactcctgaa

SEQ ID NO: 195747 - DNA, 35 bp, Artificial Sequence
  Synthetic oligonucleotide
tacgcaggtgcctccgccgtccatcgactttttaa

SEQ ID NO: 195748 - DNA, 35 bp, Artificial Sequence
  Synthetic oligonucleotide
gcataacctcctcctgcgttgtcctacggtccaca

SEQ ID NO: 195749 - DNA, 36 bp, Artificial Sequence
  Synthetic oligonucleotide
gatcgcctcacctcttcgcataccccggtttgcaca

SEQ ID NO: 195750 - DNA, 36 bp, Artificial Sequence
  Synthetic oligonucleotide
gctgagcacccctgccgcgaattacattgcttcaca

SEQ ID NO: 195751 - DNA, 36 bp, Artificial Sequence
  Synthetic oligonucleotide
tgactcatgccgccgcgttattcgaccaccccacca

SEQ ID NO: 195752 - DNA, 36 bp, Artificial Sequence
  Synthetic oligonucleotide
gtcgagggaggggtcaataaggggaggtggggacca

SEQ ID NO: 195753 - DNA, 35 bp, Artificial Sequence
  Synthetic oligonucleotide
tgctacgcccgccgtactcccgctgaccaacccca

SEQ ID NO: 195754 - DNA, 35 bp, Artificial Sequence
  Synthetic oligonucleotide
ggagctctcccacctgttatcaatacgttcctcca

SEQ ID NO: 195755 - DNA, 36 bp, Artificial Sequence
  Synthetic oligonucleotide
gatcaccttgcatatctgtccccggagccatgtcca

SEQ ID NO: 195756 - DNA, 36 bp, Artificial Sequence
  Synthetic oligonucleotide
tgggtcgcttgcacatccgtattccatcctttggca

SEQ ID NO: 195757 - DNA, 36 bp, Artificial Sequence
  Synthetic oligonucleotide
attcacgcccgctctataaagtttccgtttcttgca

SEQ ID NO: 195758 - DNA, 36 bp, Artificial Sequence
  Synthetic oligonucleotide
ttacacccgctgtatcgatcatacagtccttcatca

SEQ ID NO: 195759 - DNA, 35 bp, Artificial Sequence
  Synthetic oligonucleotide
tgaccaacgcagtgttatccgaatcatccccctca

SEQ ID NO: 195760 - DNA, 36 bp, Artificial Sequence
  Synthetic oligonucleotide
tacgcgccgttttacgcgatattatttgccatctca

SEQ ID NO: 195761 - DNA, 36 bp, Artificial Sequence
  Synthetic oligonucleotide
gccacagcctcctgtagtcgcgcccatcatctctca

SEQ ID NO: 195762 - DNA, 36 bp, Artificial Sequence
  Synthetic oligonucleotide
aggacagtgcattatctgttcgctctcccccggtca

SEQ ID NO: 195763 - DNA, 35 bp, Artificial Sequence
  Synthetic oligonucleotide
accaccgccacatgctggctcctttgcatccttca

SEQ ID NO: 195764 - DNA, 36 bp, Artificial Sequence
  Synthetic oligonucleotide
tcctccgccctgctgcatgtcctccactcacgttca

SEQ ID NO: 195765 - DNA, 36 bp, Artificial Sequence
  Synthetic oligonucleotide
gtccactggtgccctgcttacttactcctatgttca

SEQ ID NO: 195766 - DNA, 37 bp, Artificial Sequence
  Synthetic oligonucleotide
ggtagaaggagaggaagcataggaaaacgcaggaaga

SEQ ID NO: 195767 - DNA, 35 bp, Artificial Sequence
  Synthetic oligonucleotide
gtccacgcccgccgttccgttcctcgtcacccaga

SEQ ID NO: 195768 - DNA, 36 bp, Artificial Sequence
  Synthetic oligonucleotide
aacgacaaagcgagggagcaagtaggatagagcaga

SEQ ID NO: 195769 - DNA, 37 bp, Artificial Sequence
  Synthetic oligonucleotide
aacccccgccccattttatgatccaggcctccagaga

SEQ ID NO: 195770 - DNA, 37 bp, Artificial Sequence
  Synthetic oligonucleotide
tcccacttccctcgacgttgttcatgtcccctataga

SEQ ID NO: 195771 - DNA, 37 bp, Artificial Sequence
  Synthetic oligonucleotide
gccaacgacggttagcctatccaccttccttcaccga

SEQ ID NO: 195772 - DNA, 36 bp, Artificial Sequence
  Synthetic oligonucleotide
tggatgccacgtttctcctctacgcccttctgccga

SEQ ID NO: 195773 - DNA, 36 bp, Artificial Sequence
  Synthetic oligonucleotide
tgctgcttccatgtcatcttttccatctgctcgcga

SEQ ID NO: 195774 - DNA, 37 bp, Artificial Sequence
  Synthetic oligonucleotide
gtggttgccattctctgttgcgccttctgtttctcga

SEQ ID NO: 195775 - DNA, 37 bp, Artificial Sequence
  Synthetic oligonucleotide
gaacggcgcctcaggctatcctgctcacctctttcga

SEQ ID NO: 195776 - DNA, 36 bp, Artificial Sequence
  Synthetic oligonucleotide
taccgcatcctccgcctgcttgaaaccattcacgga

SEQ ID NO: 195777 - DNA, 37 bp, Artificial Sequence
  Synthetic oligonucleotide
tgtccagggcgggcggggtatagggtctagggacgga

SEQ ID NO: 195778 - DNA, 37 bp, Artificial Sequence
  Synthetic oligonucleotide
gtcccgccaccagttctgaaacgcctgaccgcccgga

SEQ ID NO: 195779 - DNA, 37 bp, Artificial Sequence
  Synthetic oligonucleotide
aggagccaccgccccctcattgacgttctgttccgga

SEQ ID NO: 195780 - DNA, 37 bp, Artificial Sequence
  Synthetic oligonucleotide
ggtcacacgcgttcgtctccccctccgttcattcgga

SEQ ID NO: 195781 - DNA, 37 bp, Artificial Sequence
  Synthetic oligonucleotide
gccgggggggtgagggtgcgtagaatgggtgttcgga

SEQ ID NO: 195782 - DNA, 37 bp, Artificial Sequence
  Synthetic oligonucleotide
gggagtggaagggggcgaaaagtcgacgccgggggga

SEQ ID NO: 195783 - DNA, 37 bp, Artificial Sequence
  Synthetic oligonucleotide
aaaggggagcgtgaacaaggtgaagcagcggggggga

SEQ ID NO: 195784 - DNA, 37 bp, Artificial Sequence
  Synthetic oligonucleotide
tgcacgtgaagggtggctgagtggacggcggggggga

SEQ ID NO: 195785 - DNA, 35 bp, Artificial Sequence
  Synthetic oligonucleotide
atccgcgctccagtttttttccatctccgctggga

SEQ ID NO: 195786 - DNA, 37 bp, Artificial Sequence
  Synthetic oligonucleotide
gtcagggtgggacgggtagagagttcatcatttggga

SEQ ID NO: 195787 - DNA, 36 bp, Artificial Sequence
  Synthetic oligonucleotide
gcgggaacgtaggaagaggagaggaaaacgggtgga

SEQ ID NO: 195788 - DNA, 37 bp, Artificial Sequence
  Synthetic oligonucleotide
atggaggagaagggcgtgaacagggatacgggcatga

SEQ ID NO: 195789 - DNA, 35 bp, Artificial Sequence
  Synthetic oligonucleotide
acgacgacatcctctgtaacgtgcccttcccctga

SEQ ID NO: 195790 - DNA, 38 bp, Artificial Sequence
  Synthetic oligonucleotide
tgaccgacgccgcttgtcaatgaccacccctctgctga

SEQ ID NO: 195791 - DNA, 38 bp, Artificial Sequence
  Synthetic oligonucleotide
gaagcgagcccggtagggtagggaaaagacgggggtga

SEQ ID NO: 195792 - DNA, 37 bp, Artificial Sequence
  Synthetic oligonucleotide
gatgcataataggaggaagggaaagtcggggatgtga

SEQ ID NO: 195793 - DNA, 38 bp, Artificial Sequence
  Synthetic oligonucleotide
agacgcgccactatcatagctcatccctttcctcttga

SEQ ID NO: 195794 - DNA, 38 bp, Artificial Sequence
  Synthetic oligonucleotide
gctccccccctggctttcattgactaaatgtctcttga

SEQ ID NO: 195795 - DNA, 38 bp, Artificial Sequence
  Synthetic oligonucleotide
gtcccgcattccccctgtccctaaggtcgctgtcttga

SEQ ID NO: 195796 - DNA, 35 bp, Artificial Sequence
  Synthetic oligonucleotide
atcacctccgcctggtcgtaccagaccatttgata

SEQ ID NO: 195797 - DNA, 35 bp, Artificial Sequence
  Synthetic oligonucleotide
ttgagccgcaattcctccgtcgccctttctaagta

SEQ ID NO: 195798 - DNA, 35 bp, Artificial Sequence
  Synthetic oligonucleotide
ataggggtgagagggcgggagggtatgcttacgta

SEQ ID NO: 195799 - DNA, 36 bp, Artificial Sequence
  Synthetic oligonucleotide
tcagaccctcctacccgcctaagtacgtttacggta

SEQ ID NO: 195800 - DNA, 35 bp, Artificial Sequence
  Synthetic oligonucleotide
tcccacactcggatgactactagcctcttttccac

SEQ ID NO: 195801 - DNA, 35 bp, Artificial Sequence
  Synthetic oligonucleotide
aactgtgcgttcgcttgctattcaacgccccttac

SEQ ID NO: 195802 - DNA, 35 bp, Artificial Sequence
  Synthetic oligonucleotide
ggaccttgccactgacgccccttatgccgtccacc

SEQ ID NO: 195803 - DNA, 35 bp, Artificial Sequence
  Synthetic oligonucleotide
tcctggggcacatacatcgttgtacgctctctacc

SEQ ID NO: 195804 - DNA, 35 bp, Artificial Sequence
  Synthetic oligonucleotide
tatcctcagccccagccgttccttttgacgccccc

SEQ ID NO: 195805 - DNA, 35 bp, Artificial Sequence
  Synthetic oligonucleotide
acacacgcctgagacccgctggatcctccgccccc

SEQ ID NO: 195806 - DNA, 35 bp, Artificial Sequence
  Synthetic oligonucleotide
gtctcgccacctttaatacactgttcatggccccc

SEQ ID NO: 195807 - DNA, 35 bp, Artificial Sequence
  Synthetic oligonucleotide
gacgaccacgtcctcgcctcctatattttgtcccc

SEQ ID NO: 195808 - DNA, 35 bp, Artificial Sequence
  Synthetic oligonucleotide
gtgaccccttggaattgttacagatccctgcgccc

SEQ ID NO: 195809 - DNA, 36 bp, Artificial Sequence
  Synthetic oligonucleotide
gtagagcccatctttggttcatctggtcctttcgcc

SEQ ID NO: 195810 - DNA, 35 bp, Artificial Sequence
  Synthetic oligonucleotide
ttggagctcgaccgttttgcccctgtcgccaggcc

SEQ ID NO: 195811 - DNA, 35 bp, Artificial Sequence
  Synthetic oligonucleotide
gttccgccgcctgacgcttccctgtagccgctgcc

SEQ ID NO: 195812 - DNA, 35 bp, Artificial Sequence
  Synthetic oligonucleotide
taccgccccagcctctcgaccatcatgctccatcc

SEQ ID NO: 195813 - DNA, 35 bp, Artificial Sequence
  Synthetic oligonucleotide
tgcacggtatgcattcctctacatcgagtccatcc

SEQ ID NO: 195814 - DNA, 35 bp, Artificial Sequence
  Synthetic oligonucleotide
agtagcgaggcagaacgccctatctccatccctcc

SEQ ID NO: 195815 - DNA, 35 bp, Artificial Sequence
  Synthetic oligonucleotide
gattgtcgtccctgtaaatgtcctcttttccgtcc

SEQ ID NO: 195816 - DNA, 35 bp, Artificial Sequence
  Synthetic oligonucleotide
gctgtgctggctgttacccgtagtctttcctccgc

SEQ ID NO: 195817 - DNA, 35 bp, Artificial Sequence
  Synthetic oligonucleotide
gttgctccggctcttctcgccgcatgtcccacctc

SEQ ID NO: 195818 - DNA, 35 bp, Artificial Sequence
  Synthetic oligonucleotide
tcacactccgtccactcgcaagaggcttccagctc

SEQ ID NO: 195819 - DNA, 35 bp, Artificial Sequence
  Synthetic oligonucleotide
gccactcgtcggtcgtttgctgctcctcggtggtc

SEQ ID NO: 195820 - DNA, 35 bp, Artificial Sequence
  Synthetic oligonucleotide
gtctccacaagcgacagtaccccctcgtctttgtc

SEQ ID NO: 195821 - DNA, 35 bp, Artificial Sequence
  Synthetic oligonucleotide
tacgaacctgtcccgtacgaatattcgtgtcattc

SEQ ID NO: 195822 - DNA, 35 bp, Artificial Sequence
  Synthetic oligonucleotide
aactcctccgccgattttagtctcgattctagttc

SEQ ID NO: 195823 - DNA, 35 bp, Artificial Sequence
  Synthetic oligonucleotide
atcactacacttgtcgcgatcctaggtcccttttc

SEQ ID NO: 195824 - DNA, 35 bp, Artificial Sequence
  Synthetic oligonucleotide
gggtgggtgggggcgtaaacgggagtatcgttttc

SEQ ID NO: 195825 - DNA, 35 bp, Artificial Sequence
  Synthetic oligonucleotide
tgcctcgacagtcgcgttctcttccaacttttttc

SEQ ID NO: 195826 - DNA, 35 bp, Artificial Sequence
  Synthetic oligonucleotide
gaggggagcagtgaagaggaagtgggccgaataag

SEQ ID NO: 195827 - DNA, 35 bp, Artificial Sequence
  Synthetic oligonucleotide
gagcgaacacgggtgaggtaggggagaacgcgcag

SEQ ID NO: 195828 - DNA, 35 bp, Artificial Sequence
  Synthetic oligonucleotide
tggggagggagggagatgttgcagggggttctacg

SEQ ID NO: 195829 - DNA, 35 bp, Artificial Sequence
  Synthetic oligonucleotide
gacccctccgctatcctgccatctacgacgcaccg

SEQ ID NO: 195830 - DNA, 35 bp, Artificial Sequence
  Synthetic oligonucleotide
gccacgcgccccatcccttgttctattgatcaccg

SEQ ID NO: 195831 - DNA, 35 bp, Artificial Sequence
  Synthetic oligonucleotide
ttgtccccccgtccgaattactcttggtctctccg

SEQ ID NO: 195832 - DNA, 35 bp, Artificial Sequence
  Synthetic oligonucleotide
gacgatgtcatgtccgttctaggtgccccccctcg

SEQ ID NO: 195833 - DNA, 35 bp, Artificial Sequence
  Synthetic oligonucleotide
tagcggggcaatacttggggcggggactgagaagg

SEQ ID NO: 195834 - DNA, 35 bp, Artificial Sequence
  Synthetic oligonucleotide
aatggagtgggaatgaaaacggaggtcggacacgg

SEQ ID NO: 195835 - DNA, 35 bp, Artificial Sequence
  Synthetic oligonucleotide
atcgagcgagctcagcttatcgttcttctttccgg

SEQ ID NO: 195836 - DNA, 35 bp, Artificial Sequence
  Synthetic oligonucleotide
gatcccaggcttggtaccgctgattcatccccatg

SEQ ID NO: 195837 - DNA, 35 bp, Artificial Sequence
  Synthetic oligonucleotide
gtgcgggtaggggtgtggagggttatctactcatg

SEQ ID NO: 195838 - DNA, 35 bp, Artificial Sequence
  Synthetic oligonucleotide
gctggtaagccgcttctcctatattcgtcgcactg

SEQ ID NO: 195839 - DNA, 35 bp, Artificial Sequence
  Synthetic oligonucleotide
ttagcaccgcgcagcatctcgtcactaccttcctg

SEQ ID NO: 195840 - DNA, 35 bp, Artificial Sequence
  Synthetic oligonucleotide
tgaggagaagggcaaggaggaattactggtggctg

SEQ ID NO: 195841 - DNA, 35 bp, Artificial Sequence
  Synthetic oligonucleotide
tccgccccttgtcaacgccggacccccgaatattg

SEQ ID NO: 195842 - DNA, 35 bp, Artificial Sequence
  Synthetic oligonucleotide
gtgccaccccttgcgtcgttcgacccttcctattg

SEQ ID NO: 195843 - DNA, 35 bp, Artificial Sequence
  Synthetic oligonucleotide
accgagctccttgtcctcctcttcgccatttcaat

SEQ ID NO: 195844 - DNA, 35 bp, Artificial Sequence
  Synthetic oligonucleotide
gaatgccactcacgcctgacttggacactctccat

SEQ ID NO: 195845 - DNA, 35 bp, Artificial Sequence
  Synthetic oligonucleotide
gtacatgggagggggggtgagttagtgaaaagcat

SEQ ID NO: 195846 - DNA, 35 bp, Artificial Sequence
  Synthetic oligonucleotide
gccccgcggtggtgtcatctcgatctatctttcat

SEQ ID NO: 195847 - DNA, 35 bp, Artificial Sequence
  Synthetic oligonucleotide
agaggccgaaatgggtggagggggggtgcgctgat

SEQ ID NO: 195848 - DNA, 35 bp, Artificial Sequence
  Synthetic oligonucleotide
acacttactccatcatccttccttgcacgaactat

SEQ ID NO: 195849 - DNA, 35 bp, Artificial Sequence
  Synthetic oligonucleotide
gcagggcgcaccgtgtcctctttttctgcctttat

SEQ ID NO: 195850 - DNA, 35 bp, Artificial Sequence
  Synthetic oligonucleotide
gcaccaaccgtcatggtctatcgccaatctatact

SEQ ID NO: 195851 - DNA, 35 bp, Artificial Sequence
  Synthetic oligonucleotide
gacgttatctgcccttcaccttgcgtatcggtact

SEQ ID NO: 195852 - DNA, 36 bp, Artificial Sequence
  Synthetic oligonucleotide
ttacgtcacggggtcactattcgtttgtttcgccct

SEQ ID NO: 195853 - DNA, 35 bp, Artificial Sequence
  Synthetic oligonucleotide
gacctcccacatggctaacatactctgaactcgct

SEQ ID NO: 195854 - DNA, 35 bp, Artificial Sequence
  Synthetic oligonucleotide
atcccagctgccgtccacctgcctgttcataatct

SEQ ID NO: 195855 - DNA, 35 bp, Artificial Sequence
  Synthetic oligonucleotide
tgtctaccgcacctcgtgttgctgctccctcctct

SEQ ID NO: 195856 - DNA, 35 bp, Artificial Sequence
  Synthetic oligonucleotide
gacgccgctgccctctgtccattttcccgttacgt

SEQ ID NO: 195857 - DNA, 35 bp, Artificial Sequence
  Synthetic oligonucleotide
tgcttccttacctcgttttatcgtcacgtacctgt

SEQ ID NO: 195858 - DNA, 35 bp, Artificial Sequence
  Synthetic oligonucleotide
gttcacgacagccagcacactttccatccttgtgt

SEQ ID NO: 195859 - DNA, 35 bp, Artificial Sequence
  Synthetic oligonucleotide
ttccggagcggtattctgcacacgcacctgtcctt

SEQ ID NO: 195860 - DNA, 35 bp, Artificial Sequence
  Synthetic oligonucleotide
aaccaggcccaagaccgtcaaatcgaccacctctt

SEQ ID NO: 195861 - DNA, 35 bp, Artificial Sequence
  Synthetic oligonucleotide
gtgctaggccgtctttgttctccgttcttatcgtt

SEQ ID NO: 195862 - DNA, 35 bp, Artificial Sequence
  Synthetic oligonucleotide
gtcctccaagcgtgttcggccgttcgttccttgtt

SEQ ID NO: 195863 - DNA, 35 bp, Artificial Sequence
  Synthetic oligonucleotide
accacaccttgatgcgctttgttactgtggtcttt

SEQ ID NO: 195864 - DNA, 35 bp, Artificial Sequence
  Synthetic oligonucleotide
tatcccccgtcgccccgaagggtatgttcattttt

SEQ ID NO: 195865 - DNA, 36 bp, Artificial Sequence
  Synthetic oligonucleotide
gtaccatcatggcgcgtatagtatcctttcgttaaa

SEQ ID NO: 195866 - DNA, 35 bp, Artificial Sequence
  Synthetic oligonucleotide
tgccaacagccgcctcttattagtacctcctagaa

SEQ ID NO: 195867 - DNA, 35 bp, Artificial Sequence
  Synthetic oligonucleotide
agcggggtacatagcacgggtgaggagagggggaa

SEQ ID NO: 195868 - DNA, 36 bp, Artificial Sequence
  Synthetic oligonucleotide
tcagtgcagagacggatagtgagggcggggtaataa

SEQ ID NO: 195869 - DNA, 36 bp, Artificial Sequence
  Synthetic oligonucleotide
tgtccgcctgtcgcttagctcttgttcacgccctaa

SEQ ID NO: 195870 - DNA, 36 bp, Artificial Sequence
  Synthetic oligonucleotide
gaccagggtacaagggcggggtgggcagtgtagtaa

SEQ ID NO: 195871 - DNA, 36 bp, Artificial Sequence
  Synthetic oligonucleotide
tctcgccccctctgtcctgctcataccaatgctaca

SEQ ID NO: 195872 - DNA, 36 bp, Artificial Sequence
  Synthetic oligonucleotide
gacggggtcgccattcgtttcccgtgcatttcccca

SEQ ID NO: 195873 - DNA, 36 bp, Artificial Sequence
  Synthetic oligonucleotide
accatgcgtcactctccccgttctcgagttttgcca

SEQ ID NO: 195874 - DNA, 36 bp, Artificial Sequence
  Synthetic oligonucleotide
tgttacaccattgtttacgctcaccgtgcatctcca

SEQ ID NO: 195875 - DNA, 36 bp, Artificial Sequence
  Synthetic oligonucleotide
acgctcccgcctttccacataagcgccgttgttcca

SEQ ID NO: 195876 - DNA, 36 bp, Artificial Sequence
  Synthetic oligonucleotide
tccatccaatgctctatcgctccctgttgtttctca

SEQ ID NO: 195877 - DNA, 34 bp, Artificial Sequence
  Synthetic oligonucleotide
tacgcccacttcattgaagcacatacctttttca

SEQ ID NO: 195878 - DNA, 37 bp, Artificial Sequence
  Synthetic oligonucleotide
gaggacgagtaggtaaagaggagcaggtgtagtcaga

SEQ ID NO: 195879 - DNA, 37 bp, Artificial Sequence
  Synthetic oligonucleotide
ggtggatagggaaggcgatggagtaatgtggcgtaga

SEQ ID NO: 195880 - DNA, 37 bp, Artificial Sequence
  Synthetic oligonucleotide
atgtcccgcccctcacctcgcgtcgccctctgtacga

SEQ ID NO: 195881 - DNA, 37 bp, Artificial Sequence
  Synthetic oligonucleotide
aacacctgcgcacgtcttgtacacgcttcatttccga

SEQ ID NO: 195882 - DNA, 37 bp, Artificial Sequence
  Synthetic oligonucleotide
tgcgaaggggacaggggggtaccgaagagtgtggcga

SEQ ID NO: 195883 - DNA, 37 bp, Artificial Sequence
  Synthetic oligonucleotide
gagagggaagattaggaggagcgagggccgttggcga

SEQ ID NO: 195884 - DNA, 37 bp, Artificial Sequence
  Synthetic oligonucleotide
acacctcccacatgtcacccgctcaaccgtcaatcga

SEQ ID NO: 195885 - DNA, 37 bp, Artificial Sequence
  Synthetic oligonucleotide
accacccagccccatgttcctcacagcacgtcgagga

SEQ ID NO: 195886 - DNA, 37 bp, Artificial Sequence
  Synthetic oligonucleotide
tccatctgggtgggggggtatatgggcgaactacgga

SEQ ID NO: 195887 - DNA, 35 bp, Artificial Sequence
  Synthetic oligonucleotide
tgtcagtccacccacgtttgtatctcctgcccgga

SEQ ID NO: 195888 - DNA, 37 bp, Artificial Sequence
  Synthetic oligonucleotide
agggtgggggttgtgtgctatgattctttgggcggga

SEQ ID NO: 195889 - DNA, 37 bp, Artificial Sequence
  Synthetic oligonucleotide
gcaagcaactgctattgtttccgcccccgccttggga

SEQ ID NO: 195890 - DNA, 38 bp, Artificial Sequence
  Synthetic oligonucleotide
tatgtctccctcagccagcacatggaccattttactga

SEQ ID NO: 195891 - DNA, 38 bp, Artificial Sequence
  Synthetic oligonucleotide
tatcgccacagcttgtactgctgcaccttcttacctga

SEQ ID NO: 195892 - DNA, 38 bp, Artificial Sequence
  Synthetic oligonucleotide
acgtacgcagtcccgataatgctcaccgtttgccctga

SEQ ID NO: 195893 - DNA, 37 bp, Artificial Sequence
  Synthetic oligonucleotide
acagcatccctgccttattcacctcgctactccgtga

SEQ ID NO: 195894 - DNA, 36 bp, Artificial Sequence
  Synthetic oligonucleotide
actacaccagcaggagggggggggccattagggtga

SEQ ID NO: 195895 - DNA, 37 bp, Artificial Sequence
  Synthetic oligonucleotide
tgcgggatgccgggggaagagaacgaagtgactgtga

SEQ ID NO: 195896 - DNA, 38 bp, Artificial Sequence
  Synthetic oligonucleotide
tgtaacgtcgaacggttgacctcgctgctttcccttga

SEQ ID NO: 195897 - DNA, 37 bp, Artificial Sequence
  Synthetic oligonucleotide
gctgccgcccgagctgctcacgttcctgtcgccttga

SEQ ID NO: 195898 - DNA, 38 bp, Artificial Sequence
  Synthetic oligonucleotide
gcaaaccgcacaggctcccttctgatccaccatcttga

SEQ ID NO: 195899 - DNA, 37 bp, Artificial Sequence
  Synthetic oligonucleotide
agtgcctccccgtataagcccccgtgccctatcttga

SEQ ID NO: 195900 - DNA, 38 bp, Artificial Sequence
  Synthetic oligonucleotide
gttcgctccacgccaccatctcgcagtcaattagttga

SEQ ID NO: 195901 - DNA, 38 bp, Artificial Sequence
  Synthetic oligonucleotide
taggccatgctcaccatctgttctctctgttccgttga

SEQ ID NO: 195902 - DNA, 37 bp, Artificial Sequence
  Synthetic oligonucleotide
gtccgacgcacgatgttctaacccctcttcatgttga

SEQ ID NO: 195903 - DNA, 37 bp, Artificial Sequence
  Synthetic oligonucleotide
gctcacgaccccagttgcgcctactctcatcttttga

SEQ ID NO: 195904 - DNA, 36 bp, Artificial Sequence
  Synthetic oligonucleotide
tgccccctcgctgctctaagctctgctccacaaata

SEQ ID NO: 195905 - DNA, 36 bp, Artificial Sequence
  Synthetic oligonucleotide
atcgcccgctcaccgcccctgtaaaattgcttgata

SEQ ID NO: 195906 - DNA, 36 bp, Artificial Sequence
  Synthetic oligonucleotide
gcctgcagtgatcacttcatgtcttcggtcccccta

SEQ ID NO: 195907 - DNA, 36 bp, Artificial Sequence
  Synthetic oligonucleotide
tagtctgccaccttcttattgagtcttcgctgccta

SEQ ID NO: 195908 - DNA, 36 bp, Artificial Sequence
  Synthetic oligonucleotide
ttgaactagccccctctcgtgcacttatgttctcta

SEQ ID NO: 195909 - DNA, 36 bp, Artificial Sequence
  Synthetic oligonucleotide
agcacgggtggagggagaggatgagagatggtggta

SEQ ID NO: 195910 - DNA, 36 bp, Artificial Sequence
  Synthetic oligonucleotide
agtccaccgtagtggcttacccgttgctccattgta

SEQ ID NO: 195911 - DNA, 36 bp, Artificial Sequence
  Synthetic oligonucleotide
gtttgctgccctgtcaccgtcgccctgccatcctta

SEQ ID NO: 195912 - DNA, 35 bp, Artificial Sequence
  Synthetic oligonucleotide
tgttacccctgttcgtgcattgccccaccctgtta

SEQ ID NO: 195913 - DNA, 36 bp, Artificial Sequence
  Synthetic oligonucleotide
gtggtccacgctccacctctgtctgcctcgaattta

SEQ ID NO: 195914 - DNA, 36 bp, Artificial Sequence
  Synthetic oligonucleotide
aacagagcatgcatttgccttatcaccatccgttta

SEQ ID NO: 195915 - DNA, 35 bp, Artificial Sequence
  Synthetic oligonucleotide
tgattcgccctggttccgctccagtccccccgtac

SEQ ID NO: 195916 - DNA, 35 bp, Artificial Sequence
  Synthetic oligonucleotide
attcatgcaggtcacgccgctcgctcaggtacacc

SEQ ID NO: 195917 - DNA, 35 bp, Artificial Sequence
  Synthetic oligonucleotide
aacgatctgcgtcatacccccccgtccagctcacc

SEQ ID NO: 195918 - DNA, 35 bp, Artificial Sequence
  Synthetic oligonucleotide
ctctcgccccgatactcgtgatttatgttcatacc

SEQ ID NO: 195919 - DNA, 35 bp, Artificial Sequence
  Synthetic oligonucleotide
aggtagccactgcctcccgtctctgtcgtcgaccc

SEQ ID NO: 195920 - DNA, 35 bp, Artificial Sequence
  Synthetic oligonucleotide
gcccacaccgccccgacctagcatggacggtaccc

SEQ ID NO: 195921 - DNA, 35 bp, Artificial Sequence
  Synthetic oligonucleotide
tgggtgtgttgacatctgtctcggcccgctccccc

SEQ ID NO: 195922 - DNA, 35 bp, Artificial Sequence
  Synthetic oligonucleotide
gaagcgcatggcattcgaaccgcatctatctgccc

SEQ ID NO: 195923 - DNA, 35 bp, Artificial Sequence
  Synthetic oligonucleotide
gcatgcacactggtctatcgaaacattccggtccc

SEQ ID NO: 195924 - DNA, 35 bp, Artificial Sequence
  Synthetic oligonucleotide
tccgaatcgcgcttggtagtctctagtccattccc

SEQ ID NO: 195925 - DNA, 35 bp, Artificial Sequence
  Synthetic oligonucleotide
gggtgcgcccatgttcacgcagattaccctccgcc

SEQ ID NO: 195926 - DNA, 35 bp, Artificial Sequence
  Synthetic oligonucleotide
gacaacatagcttatccatagcacagcctctcgcc

SEQ ID NO: 195927 - DNA, 35 bp, Artificial Sequence
  Synthetic oligonucleotide
tccgacctgcccattgttctcgcgcttcaccggcc

SEQ ID NO: 195928 - DNA, 35 bp, Artificial Sequence
  Synthetic oligonucleotide
gtcccgccattcgtttccaggattctacccctgcc

SEQ ID NO: 195929 - DNA, 31 bp, Artificial Sequence
  Synthetic oligonucleotide
agccgtgcgatctcatacttcctgggctgcc

SEQ ID NO: 195930 - DNA, 35 bp, Artificial Sequence
  Synthetic oligonucleotide
tacgcaagccgccgacgttgaccgctgtgccctcc

SEQ ID NO: 195931 - DNA, 35 bp, Artificial Sequence
  Synthetic oligonucleotide
tctacaccagctactatgctgacctcacatgctcc

SEQ ID NO: 195932 - DNA, 35 bp, Artificial Sequence
  Synthetic oligonucleotide
tgacttcaccgtggtctgataccgcgatctgctcc

SEQ ID NO: 195933 - DNA, 35 bp, Artificial Sequence
  Synthetic oligonucleotide
gttgacgcacgtgtcaacgcttccactcctagtcc

SEQ ID NO: 195934 - DNA, 35 bp, Artificial Sequence
  Synthetic oligonucleotide
gccatcgccgcctgctatcgcccacgccggtttcc

SEQ ID NO: 195935 - DNA, 35 bp, Artificial Sequence
  Synthetic oligonucleotide
gcgctcgacgccgtttcctttccccgccgtaaagc

SEQ ID NO: 195936 - DNA, 34 bp, Artificial Sequence
  Synthetic oligonucleotide
tgccccccgcctatcgctccctttcgctggtagc

SEQ ID NO: 195937 - DNA, 35 bp, Artificial Sequence
  Synthetic oligonucleotide
atcccctgcacttgtgccgttccgttcattcccgc

SEQ ID NO: 195938 - DNA, 35 bp, Artificial Sequence
  Synthetic oligonucleotide
tgttcgccccctccacaccatagacacgttaaggc

SEQ ID NO: 195939 - DNA, 35 bp, Artificial Sequence
  Synthetic oligonucleotide
tacacacgcactcgcttcgtcctgttgattcctgc

SEQ ID NO: 195940 - DNA, 35 bp, Artificial Sequence
  Synthetic oligonucleotide
tcacatccaaccgcatggtattctcttctcgctgc

SEQ ID NO: 195941 - DNA, 35 bp, Artificial Sequence
  Synthetic oligonucleotide
tcgaccgcaggccttgttcaccgttaccctacatc

SEQ ID NO: 195942 - DNA, 35 bp, Artificial Sequence
  Synthetic oligonucleotide
tcacgccgcccccttccatgccttgaggtttactc

SEQ ID NO: 195943 - DNA, 35 bp, Artificial Sequence
  Synthetic oligonucleotide
ttggactccccagtgcttacccccgaccgttgctc

SEQ ID NO: 195944 - DNA, 35 bp, Artificial Sequence
  Synthetic oligonucleotide
ttgcgtctagctttccctgtcatttctgcactctc

SEQ ID NO: 195945 - DNA, 35 bp, Artificial Sequence
  Synthetic oligonucleotide
gaacacgtttccggctgcgcatcgcgaccattctc

SEQ ID NO: 195946 - DNA, 32 bp, Artificial Sequence
  Synthetic oligonucleotide
attgcacctgtaccattacgctacgctttttc

SEQ ID NO: 195947 - DNA, 35 bp, Artificial Sequence
  Synthetic oligonucleotide
tgcaccggtggtatgtgctcgccccctgtttccag

SEQ ID NO: 195948 - DNA, 35 bp, Artificial Sequence
  Synthetic oligonucleotide
ggtgggaaagcggctgggggggggaattatgcgag

SEQ ID NO: 195949 - DNA, 36 bp, Artificial Sequence
  Synthetic oligonucleotide
acgcatgggaggagagtggggatagcacgagttgag

SEQ ID NO: 195950 - DNA, 35 bp, Artificial Sequence
  Synthetic oligonucleotide
tgcggagttgcgggggaatcggaggagggcgctag

SEQ ID NO: 195951 - DNA, 35 bp, Artificial Sequence
  Synthetic oligonucleotide
tccagccccgctgctcatccgttcgcctagctacg

SEQ ID NO: 195952 - DNA, 35 bp, Artificial Sequence
  Synthetic oligonucleotide
ggggacataggggtgggcgaatgggccatcgtacg

SEQ ID NO: 195953 - DNA, 35 bp, Artificial Sequence
  Synthetic oligonucleotide
gtccccatcaactgaccgcactggctcccgatccg

SEQ ID NO: 195954 - DNA, 35 bp, Artificial Sequence
  Synthetic oligonucleotide
ggtggtgacgtgggaaggagaagtacagacgtccg

SEQ ID NO: 195955 - DNA, 35 bp, Artificial Sequence
  Synthetic oligonucleotide
gtgacaaccagcctgttaacatacgtacgccctcg

SEQ ID NO: 195956 - DNA, 35 bp, Artificial Sequence
  Synthetic oligonucleotide
tagtaaggggggaggtaggagtggtgtgcgtaagg

SEQ ID NO: 195957 - DNA, 35 bp, Artificial Sequence
  Synthetic oligonucleotide
atgggggagacgccgggcgggaggacgcatgaggg

SEQ ID NO: 195958 - DNA, 35 bp, Artificial Sequence
  Synthetic oligonucleotide
gtggggaggtgagaggcggtttggggttggtaggg

SEQ ID NO: 195959 - DNA, 35 bp, Artificial Sequence
  Synthetic oligonucleotide
agggggaaggaagggcgggtatacgttgcctcggg

SEQ ID NO: 195960 - DNA, 35 bp, Artificial Sequence
  Synthetic oligonucleotide
gctccaccggctcgtctatattgccatctctactg

SEQ ID NO: 195961 - DNA, 35 bp, Artificial Sequence
  Synthetic oligonucleotide
tgtcgctcagtcgcattcgtttctgttccatccat

SEQ ID NO: 195962 - DNA, 35 bp, Artificial Sequence
  Synthetic oligonucleotide
gatgagtcagttcccccgccccgagaccacactat

SEQ ID NO: 195963 - DNA, 35 bp, Artificial Sequence
  Synthetic oligonucleotide
acccacgtcccgccgttacacacgttgtcctctat

SEQ ID NO: 195964 - DNA, 35 bp, Artificial Sequence
  Synthetic oligonucleotide
tcgccgccatctcatggcacatccttccacgcact

SEQ ID NO: 195965 - DNA, 35 bp, Artificial Sequence
  Synthetic oligonucleotide
gactaccctccccagctttgcagctgtccacgact

SEQ ID NO: 195966 - DNA, 35 bp, Artificial Sequence
  Synthetic oligonucleotide
tttgcgcccccgtccggagctgctccccacaccct

SEQ ID NO: 195967 - DNA, 35 bp, Artificial Sequence
  Synthetic oligonucleotide
aagacacactcaattgtgcgctgccgattcaccct

SEQ ID NO: 195968 - DNA, 35 bp, Artificial Sequence
  Synthetic oligonucleotide
ttaggacagccgctttggatttactacttccctct

SEQ ID NO: 195969 - DNA, 35 bp, Artificial Sequence
  Synthetic oligonucleotide
tgtaccgtacgcatgccgtcgattccttcccgtct

SEQ ID NO: 195970 - DNA, 35 bp, Artificial Sequence
  Synthetic oligonucleotide
acacatcccgaactctccgcatccgatcttcgagt

SEQ ID NO: 195971 - DNA, 35 bp, Artificial Sequence
  Synthetic oligonucleotide
gggtcgcaggggggaggaaagcaatgcagttgggt

SEQ ID NO: 195972 - DNA, 35 bp, Artificial Sequence
  Synthetic oligonucleotide
tgtaccacggagctcgagtcccgttcccttctatt

SEQ ID NO: 195973 - DNA, 35 bp, Artificial Sequence
  Synthetic oligonucleotide
taccgacccgcaataccatttagaccctcggactt

SEQ ID NO: 195974 - DNA, 35 bp, Artificial Sequence
  Synthetic oligonucleotide
gctccagtcgttctgctcattccctccaaagcctt

SEQ ID NO: 195975 - DNA, 35 bp, Artificial Sequence
  Synthetic oligonucleotide
gtgctgcagtactatctggttgcatcacggtcctt

SEQ ID NO: 195976 - DNA, 35 bp, Artificial Sequence
  Synthetic oligonucleotide
gacctgttatgtgtgccgtctagtcccggttcctt

SEQ ID NO: 195977 - DNA, 35 bp, Artificial Sequence
  Synthetic oligonucleotide
tttgcgggacggcctccatggttctcgctactctt

SEQ ID NO: 195978 - DNA, 35 bp, Artificial Sequence
  Synthetic oligonucleotide
agaacaacgcccttgctatcacctgccctgggttt

SEQ ID NO: 195979 - DNA, 35 bp, Artificial Sequence
  Synthetic oligonucleotide
aacatggggtgggagcgggcgagatgtggggtttt

SEQ ID NO: 195980 - DNA, 35 bp, Artificial Sequence
  Synthetic oligonucleotide
tgcccgacgacgctgtgtatcccctccgctgtttt

SEQ ID NO: 195981 - DNA, 36 bp, Artificial Sequence
  Synthetic oligonucleotide
accagcgaggggtgggtactgggtgggcacttccaa

SEQ ID NO: 195982 - DNA, 36 bp, Artificial Sequence
  Synthetic oligonucleotide
ggaaagggggacacgaatggtgagatgacggggcaa

SEQ ID NO: 195983 - DNA, 36 bp, Artificial Sequence
  Synthetic oligonucleotide
tcaccaccccttgcctaagacgcggaccccttggaa

SEQ ID NO: 195984 - DNA, 35 bp, Artificial Sequence
  Synthetic oligonucleotide
gccaccccccgggcatacctatcgttcttcttgaa

SEQ ID NO: 195985 - DNA, 36 bp, Artificial Sequence
  Synthetic oligonucleotide
ttgtgcctcctgccaatctgtacatatacgccataa

SEQ ID NO: 195986 - DNA, 36 bp, Artificial Sequence
  Synthetic oligonucleotide
tgacgtggtccgccactcttttatgacccattttaa

SEQ ID NO: 195987 - DNA, 35 bp, Artificial Sequence
  Synthetic oligonucleotide
actccacctacgactgccacgggtacgctagtaca

SEQ ID NO: 195988 - DNA, 36 bp, Artificial Sequence
  Synthetic oligonucleotide
tccacacccattgtggtttctctgttaccttcacca

SEQ ID NO: 195989 - DNA, 36 bp, Artificial Sequence
  Synthetic oligonucleotide
gaccccctcgcgagatccctgtttgcgccggtacca

SEQ ID NO: 195990 - DNA, 36 bp, Artificial Sequence
  Synthetic oligonucleotide
atgctcctcctcatcacattagcctcgcgggtacca

SEQ ID NO: 195991 - DNA, 35 bp, Artificial Sequence
  Synthetic oligonucleotide
gagtagggcagacacaaggggcgagggtgggatca

SEQ ID NO: 195992 - DNA, 36 bp, Artificial Sequence
  Synthetic oligonucleotide
ttgtccgccccatctactgcattagtccacatctca

SEQ ID NO: 195993 - DNA, 36 bp, Artificial Sequence
  Synthetic oligonucleotide
gacgccgccctaggtatcgttctggtgtctttctca

SEQ ID NO: 195994 - DNA, 35 bp, Artificial Sequence
  Synthetic oligonucleotide
atttgccgcaatcggctcccgctgtttacccttca

SEQ ID NO: 195995 - DNA, 36 bp, Artificial Sequence
  Synthetic oligonucleotide
atgttcgtgctacagctgccttttacttaccgttca

SEQ ID NO: 195996 - DNA, 36 bp, Artificial Sequence
  Synthetic oligonucleotide
tgttaccccccctttatgtgaccgtgaaccgtttca

SEQ ID NO: 195997 - DNA, 37 bp, Artificial Sequence
  Synthetic oligonucleotide
gagggaacatcgcgaagggtggaatggaacgggaaga

SEQ ID NO: 195998 - DNA, 36 bp, Artificial Sequence
  Synthetic oligonucleotide
gcacgggtaggagagggtagcgaggggatatccaga

SEQ ID NO: 195999 - DNA, 37 bp, Artificial Sequence
  Synthetic oligonucleotide
ttatcgcagggggaccatggaagggcgggaacggaga

SEQ ID NO: 196000 - DNA, 37 bp, Artificial Sequence
  Synthetic oligonucleotide
gaggccatacctcgcttgttgagccctcttaccccga

SEQ ID NO: 196001 - DNA, 36 bp, Artificial Sequence
  Synthetic oligonucleotide
gatgggttcagcctcgtacttctgcctacattccga

SEQ ID NO: 196002 - DNA, 37 bp, Artificial Sequence
  Synthetic oligonucleotide
gccggtggccacacgttcctctcctccatattcgcga

SEQ ID NO: 196003 - DNA, 37 bp, Artificial Sequence
  Synthetic oligonucleotide
tatgccgcagttgttcttccccctgtgcgttcggcga

SEQ ID NO: 196004 - DNA, 36 bp, Artificial Sequence
  Synthetic oligonucleotide
ttccgcaccctgcctgcttcctatttcacacctcga

SEQ ID NO: 196005 - DNA, 37 bp, Artificial Sequence
  Synthetic oligonucleotide
atcccaccgcctaccagatttgttcgttgctcctcga

SEQ ID NO: 196006 - DNA, 31 bp, Artificial Sequence
  Synthetic oligonucleotide
tcatacactccgccccaccgcttcgcttcga

SEQ ID NO: 196007 - DNA, 36 bp, Artificial Sequence
  Synthetic oligonucleotide
gaggggaggggtgggagcgactacggcccctcagga

SEQ ID NO: 196008 - DNA, 35 bp, Artificial Sequence
  Synthetic oligonucleotide
gatgagacggatagacgcgcatggggggtggagga

SEQ ID NO: 196009 - DNA, 37 bp, Artificial Sequence
  Synthetic oligonucleotide
tttcacccccgatgacaatgctccccgttacaccgga

SEQ ID NO: 196010 - DNA, 37 bp, Artificial Sequence
  Synthetic oligonucleotide
aagacggaacggggaatggaagaagcgtggaagcgga

SEQ ID NO: 196011 - DNA, 37 bp, Artificial Sequence
  Synthetic oligonucleotide
gcacacgcccgcagctcctccgctacacgtacaggga

SEQ ID NO: 196012 - DNA, 37 bp, Artificial Sequence
  Synthetic oligonucleotide
tgagagtgggaggggtttttgcagacactgggcggga

SEQ ID NO: 196013 - DNA, 36 bp, Artificial Sequence
  Synthetic oligonucleotide
agacgggtaggtaggagaaatggtaggcaaagggga

SEQ ID NO: 196014 - DNA, 35 bp, Artificial Sequence
  Synthetic oligonucleotide
tgacgcagtgggaaggagggcgtgctagacgggga

SEQ ID NO: 196015 - DNA, 37 bp, Artificial Sequence
  Synthetic oligonucleotide
aagggatgacaggaggtgggcggaggcaaaattggga

SEQ ID NO: 196016 - DNA, 37 bp, Artificial Sequence
  Synthetic oligonucleotide
aaagtgggagggtggggacagggttggtctgaatgga

SEQ ID NO: 196017 - DNA, 36 bp, Artificial Sequence
  Synthetic oligonucleotide
gttctccaccactccgtgatacttaccagtcttgga

SEQ ID NO: 196018 - DNA, 38 bp, Artificial Sequence
  Synthetic oligonucleotide
gcaacgctcgctctcctaactccgccctgtccacatga

SEQ ID NO: 196019 - DNA, 37 bp, Artificial Sequence
  Synthetic oligonucleotide
tagggggagggtggtgttaagggacgtgggggactga

SEQ ID NO: 196020 - DNA, 37 bp, Artificial Sequence
  Synthetic oligonucleotide
tgaacacctccgtgcgtgcacttctttctcttactga

SEQ ID NO: 196021 - DNA, 38 bp, Artificial Sequence
  Synthetic oligonucleotide
gcaccaccacaaccgttgccaggacctctccatcctga

SEQ ID NO: 196022 - DNA, 38 bp, Artificial Sequence
  Synthetic oligonucleotide
tcacgcagtctccttgtctcccgcattccctctcctga

SEQ ID NO: 196023 - DNA, 38 bp, Artificial Sequence
  Synthetic oligonucleotide
tggactcatcccttgttcttaaggttctcccccgctga

SEQ ID NO: 196024 - DNA, 38 bp, Artificial Sequence
  Synthetic oligonucleotide
tacgcgacacagtaatgttatgtcttccctcccgctga

SEQ ID NO: 196025 - DNA, 36 bp, Artificial Sequence
  Synthetic oligonucleotide
gcatgtaactgcccctttgaccaccacctgacgtga

SEQ ID NO: 196026 - DNA, 37 bp, Artificial Sequence
  Synthetic oligonucleotide
gtccactctcaactcgcatatgcccgatcctcggtga

SEQ ID NO: 196027 - DNA, 37 bp, Artificial Sequence
  Synthetic oligonucleotide
gctgtcgtaggcaggggggaggattaacatggggtga

SEQ ID NO: 196028 - DNA, 37 bp, Artificial Sequence
  Synthetic oligonucleotide
tcagccacacttctagtgttactccttggttccttga

SEQ ID NO: 196029 - DNA, 38 bp, Artificial Sequence
  Synthetic oligonucleotide
gcgcacgacagcactgccatttgcctccatcctcttga

SEQ ID NO: 196030 - DNA, 38 bp, Artificial Sequence
  Synthetic oligonucleotide
gatcgtcacagacggggggcgggagggtaggctcttga

SEQ ID NO: 196031 - DNA, 38 bp, Artificial Sequence
  Synthetic oligonucleotide
tacctccccataagcgcatctaactcccccgcagttga

SEQ ID NO: 196032 - DNA, 38 bp, Artificial Sequence
  Synthetic oligonucleotide
tagtgcccgtgaggatcgttctgcccgcccaccgttga

SEQ ID NO: 196033 - DNA, 38 bp, Artificial Sequence
  Synthetic oligonucleotide
ttcgcccccaccctggctagttagactgcacttgttga

SEQ ID NO: 196034 - DNA, 35 bp, Artificial Sequence
  Synthetic oligonucleotide
gtgacccctcgcatgtcccgccatcctagccgata

SEQ ID NO: 196035 - DNA, 36 bp, Artificial Sequence
  Synthetic oligonucleotide
gttgccgggagatagggtcgggagggatcttttata

SEQ ID NO: 196036 - DNA, 36 bp, Artificial Sequence
  Synthetic oligonucleotide
tacactgactgtccgccccccatccaacgcccccta

SEQ ID NO: 196037 - DNA, 35 bp, Artificial Sequence
  Synthetic oligonucleotide
aacgagccctcgctcagtggctccacgctccccta

SEQ ID NO: 196038 - DNA, 35 bp, Artificial Sequence
  Synthetic oligonucleotide
acaataggggggtaagtggtggtgggacggcgcta

SEQ ID NO: 196039 - DNA, 36 bp, Artificial Sequence
  Synthetic oligonucleotide
atgcacaccgtggacttgcgtatcaccccccatcta

SEQ ID NO: 196040 - DNA, 37 bp, Artificial Sequence
  Synthetic oligonucleotide
ttccgtcctagctgtcttccatggccctgtaactcta

SEQ ID NO: 196041 - DNA, 37 bp, Artificial Sequence
  Synthetic oligonucleotide
gtgggcggtgcagtgggggtagaaggtgggatctcta

SEQ ID NO: 196042 - DNA, 36 bp, Artificial Sequence
  Synthetic oligonucleotide
gacaaggcaggttatttaggggcgaaggagggagta

SEQ ID NO: 196043 - DNA, 36 bp, Artificial Sequence
  Synthetic oligonucleotide
tatgacaagcgtgatcacccgtccctgtttccatta

SEQ ID NO: 196044 - DNA, 33 bp, Artificial Sequence
  Synthetic oligonucleotide
gcgttgaagtaggagggggtggacgggcattta

SEQ ID NO: 196045 - DNA, 35 bp, Artificial Sequence
  Synthetic oligonucleotide
gcaacttagcacccgtcccatctgtacccgattta

SEQ ID NO: 196046 - DNA, 32 bp, Artificial Sequence
  Synthetic oligonucleotide
aactgacgctaattcacgtaaagccccttcac

SEQ ID NO: 196047 - DNA, 35 bp, Artificial Sequence
  Synthetic oligonucleotide
tgcgacgtccttcctgtccgtccccagcctccgac

SEQ ID NO: 196048 - DNA, 35 bp, Artificial Sequence
  Synthetic oligonucleotide
ttcacctctcacccacgagtccagaaccttctgac

SEQ ID NO: 196049 - DNA, 35 bp, Artificial Sequence
  Synthetic oligonucleotide
atgcacccgcatcctgtccacatccattggtctac

SEQ ID NO: 196050 - DNA, 35 bp, Artificial Sequence
  Synthetic oligonucleotide
tcactctgtgggcagtgcgttccggctctccgacc

SEQ ID NO: 196051 - DNA, 35 bp, Artificial Sequence
  Synthetic oligonucleotide
atggaaggcaccatccgctcccagttcaccgagcc

SEQ ID NO: 196052 - DNA, 35 bp, Artificial Sequence
  Synthetic oligonucleotide
tgcccttacctgcccacgacctgtctgcttacgcc

SEQ ID NO: 196053 - DNA, 35 bp, Artificial Sequence
  Synthetic oligonucleotide
tcttggcgagcttagattattcgtcccaccccgcc

SEQ ID NO: 196054 - DNA, 35 bp, Artificial Sequence
  Synthetic oligonucleotide
gtccccctctatgctgtacactctgatactccgcc

SEQ ID NO: 196055 - DNA, 35 bp, Artificial Sequence
  Synthetic oligonucleotide
gacatccccaggcccggtctaccagatcacctgcc

SEQ ID NO: 196056 - DNA, 35 bp, Artificial Sequence
  Synthetic oligonucleotide
tccaccaccgattgtacttcctttgtctagctgcc

SEQ ID NO: 196057 - DNA, 35 bp, Artificial Sequence
  Synthetic oligonucleotide
atagagcggaagtagcgccaaagcaccgcccctcc

SEQ ID NO: 196058 - DNA, 35 bp, Artificial Sequence
  Synthetic oligonucleotide
gatgccatcctatttttataaccttggccgtttcc

SEQ ID NO: 196059 - DNA, 35 bp, Artificial Sequence
  Synthetic oligonucleotide
gactaacttcacctgtaccttccccagtgtgtcgc

SEQ ID NO: 196060 - DNA, 35 bp, Artificial Sequence
  Synthetic oligonucleotide
gtcaaggaagttgccgtccgtcgtcctcgccatgc

SEQ ID NO: 196061 - DNA, 35 bp, Artificial Sequence
  Synthetic oligonucleotide
gcacatcgccccatgaatattcgtcccttttctgc

SEQ ID NO: 196062 - DNA, 35 bp, Artificial Sequence
  Synthetic oligonucleotide
acagtccggcttccccatctctcgtgaccccttgc

SEQ ID NO: 196063 - DNA, 35 bp, Artificial Sequence
  Synthetic oligonucleotide
ttcgatcgacgccgtattatgtccccgcctctatc

SEQ ID NO: 196064 - DNA, 35 bp, Artificial Sequence
  Synthetic oligonucleotide
ttatgcctcacattctatatgtagcaactctcctc

SEQ ID NO: 196065 - DNA, 35 bp, Artificial Sequence
  Synthetic oligonucleotide
tgtaccccagcagattcgctctaggtctcacgctc

SEQ ID NO: 196066 - DNA, 35 bp, Artificial Sequence
  Synthetic oligonucleotide
gcctctgcatccctgccccctaagtcgcaccgctc

SEQ ID NO: 196067 - DNA, 35 bp, Artificial Sequence
  Synthetic oligonucleotide
gagtagcatcatcctcgccatcttatccgtgtctc

SEQ ID NO: 196068 - DNA, 35 bp, Artificial Sequence
  Synthetic oligonucleotide
tccgacaaacggccttgtgtcctgccgaacttctc

SEQ ID NO: 196069 - DNA, 35 bp, Artificial Sequence
  Synthetic oligonucleotide
tcgcaccactaagattgttcctaatggcccttctc

SEQ ID NO: 196070 - DNA, 35 bp, Artificial Sequence
  Synthetic oligonucleotide
tgttcctccgcccatgaaggttgacttcgttcgtc

SEQ ID NO: 196071 - DNA, 35 bp, Artificial Sequence
  Synthetic oligonucleotide
accccacacacatattggatactctacgtcttgtc

SEQ ID NO: 196072 - DNA, 35 bp, Artificial Sequence
  Synthetic oligonucleotide
tcgcatcatccgcggaactgtacgttctcccattc

SEQ ID NO: 196073 - DNA, 35 bp, Artificial Sequence
  Synthetic oligonucleotide
actcgactccgcttctcaggctgcatagctcattc

SEQ ID NO: 196074 - DNA, 35 bp, Artificial Sequence
  Synthetic oligonucleotide
ttagcagataactcatgtccattgccccctgcttc

SEQ ID NO: 196075 - DNA, 35 bp, Artificial Sequence
  Synthetic oligonucleotide
acccttgggtcccttcgtttattactgtcccgttc

SEQ ID NO: 196076 - DNA, 35 bp, Artificial Sequence
  Synthetic oligonucleotide
acagaccaggggaatggaagaaagggctaggaaag

SEQ ID NO: 196077 - DNA, 35 bp, Artificial Sequence
  Synthetic oligonucleotide
atcccatcctctgctcgctgtacgtccttctttag

SEQ ID NO: 196078 - DNA, 35 bp, Artificial Sequence
  Synthetic oligonucleotide
gcatcaccttctcccgtgcctctgaagcttaaacg

SEQ ID NO: 196079 - DNA, 34 bp, Artificial Sequence
  Synthetic oligonucleotide
ttttgcaacactgacttctgttcttacctcctcg

SEQ ID NO: 196080 - DNA, 35 bp, Artificial Sequence
  Synthetic oligonucleotide
ttagcgcccaacgatctctcgtttcattcctctcg

SEQ ID NO: 196081 - DNA, 35 bp, Artificial Sequence
  Synthetic oligonucleotide
gggggcgggtgggtgcggtagtttgactccattcg

SEQ ID NO: 196082 - DNA, 34 bp, Artificial Sequence
  Synthetic oligonucleotide
tacacctcaaccgtgcctatgctccccgccaagg

SEQ ID NO: 196083 - DNA, 35 bp, Artificial Sequence
  Synthetic oligonucleotide
gcactgcgcgaatcccatcgtttctcccctgaagg

SEQ ID NO: 196084 - DNA, 35 bp, Artificial Sequence
  Synthetic oligonucleotide
ttacgtcacatccaactgttctacgcctcccgcgg

SEQ ID NO: 196085 - DNA, 35 bp, Artificial Sequence
  Synthetic oligonucleotide
atacttggctgttaacctacctcgtcttccctcgg

SEQ ID NO: 196086 - DNA, 35 bp, Artificial Sequence
  Synthetic oligonucleotide
gatgcacgcccgttatccaccgctcctttacctgg

SEQ ID NO: 196087 - DNA, 35 bp, Artificial Sequence
  Synthetic oligonucleotide
agacggcaagacgggtggcaaggagggggtattgg

SEQ ID NO: 196088 - DNA, 35 bp, Artificial Sequence
  Synthetic oligonucleotide
aacacgccctttctgtagatccccatgtccccctg

SEQ ID NO: 196089 - DNA, 35 bp, Artificial Sequence
  Synthetic oligonucleotide
acgtgcccaggcgccaattcatctcatttctcctg

SEQ ID NO: 196090 - DNA, 35 bp, Artificial Sequence
  Synthetic oligonucleotide
gccggtaccacactccaattaacccatgatttctg

SEQ ID NO: 196091 - DNA, 35 bp, Artificial Sequence
  Synthetic oligonucleotide
gccgttcgacctcccccacttagcggatgccattg

SEQ ID NO: 196092 - DNA, 35 bp, Artificial Sequence
  Synthetic oligonucleotide
aggagaatggtcagtccgctctcaaccgccaccat

SEQ ID NO: 196093 - DNA, 35 bp, Artificial Sequence
  Synthetic oligonucleotide
actccctctcctgacgactacaacacacagcatat

SEQ ID NO: 196094 - DNA, 35 bp, Artificial Sequence
  Synthetic oligonucleotide
ggtcgtgctgcctccttcttgccggttattacact

SEQ ID NO: 196095 - DNA, 35 bp, Artificial Sequence
  Synthetic oligonucleotide
gtcctcctcacgtgtggcttccttgtccccttact

SEQ ID NO: 196096 - DNA, 35 bp, Artificial Sequence
  Synthetic oligonucleotide
gggagggagggtgggcatatacgagggataggcct

SEQ ID NO: 196097 - DNA, 35 bp, Artificial Sequence
  Synthetic oligonucleotide
tcacccccgaccgcgtcttcgtagagcaccctcct

SEQ ID NO: 196098 - DNA, 35 bp, Artificial Sequence
  Synthetic oligonucleotide
gcagacgaactactgcgtaactgtctcccttctct

SEQ ID NO: 196099 - DNA, 35 bp, Artificial Sequence
  Synthetic oligonucleotide
gcgggtgggggggtagtgcaagtggtgggaattct

SEQ ID NO: 196100 - DNA, 35 bp, Artificial Sequence
  Synthetic oligonucleotide
tccaccggcaattttccgcccctcgctccccgggt

SEQ ID NO: 196101 - DNA, 35 bp, Artificial Sequence
  Synthetic oligonucleotide
tgaagcctcccatcgcgcattttcagtccgcagtt

SEQ ID NO: 196102 - DNA, 35 bp, Artificial Sequence
  Synthetic oligonucleotide
aagggtgggcgcaacacctggaacacgggagggtt

SEQ ID NO: 196103 - DNA, 35 bp, Artificial Sequence
  Synthetic oligonucleotide
tgatcccccgatcaccgttcttctagattcctgtt

SEQ ID NO: 196104 - DNA, 35 bp, Artificial Sequence
  Synthetic oligonucleotide
actagcgcgccacacctgtttacttacattccttt

SEQ ID NO: 196105 - DNA, 35 bp, Artificial Sequence
  Synthetic oligonucleotide
gacggatacggaggcatgaagggtgggtagaaaaa

SEQ ID NO: 196106 - DNA, 36 bp, Artificial Sequence
  Synthetic oligonucleotide
aaagagcgccccactatatgtcatctgccggtccaa

SEQ ID NO: 196107 - DNA, 35 bp, Artificial Sequence
  Synthetic oligonucleotide
acttccgccctcatcgtgcctatccctacggcgaa

SEQ ID NO: 196108 - DNA, 36 bp, Artificial Sequence
  Synthetic oligonucleotide
agggaaggatgggggtgaagggcgtggtggatcaca

SEQ ID NO: 196109 - DNA, 36 bp, Artificial Sequence
  Synthetic oligonucleotide
acatgttcgcgccattgtactgccctgcctttcaca

SEQ ID NO: 196110 - DNA, 35 bp, Artificial Sequence
  Synthetic oligonucleotide
acacgctcccgatgatacgcatccatccattccca

SEQ ID NO: 196111 - DNA, 36 bp, Artificial Sequence
  Synthetic oligonucleotide
ttcgactcagccaccgattgcgtttccattttccca

SEQ ID NO: 196112 - DNA, 35 bp, Artificial Sequence
  Synthetic oligonucleotide
aaccgggcattccacattatgtcatcacgccgcca

SEQ ID NO: 196113 - DNA, 36 bp, Artificial Sequence
  Synthetic oligonucleotide
gctagcccgtaccgccccgtccgcctttaacggcca

SEQ ID NO: 196114 - DNA, 35 bp, Artificial Sequence
  Synthetic oligonucleotide
gatccacactgcatgctgcctttagcctacctcca

SEQ ID NO: 196115 - DNA, 36 bp, Artificial Sequence
  Synthetic oligonucleotide
acgcaaagtccgcttctctcacaatgtaccgttcca

SEQ ID NO: 196116 - DNA, 35 bp, Artificial Sequence
  Synthetic oligonucleotide
acgaccctaccgctgccaaaaaagccctacccgca

SEQ ID NO: 196117 - DNA, 36 bp, Artificial Sequence
  Synthetic oligonucleotide
gccacccgtttcatccgtcttgtactgcaccttgca

SEQ ID NO: 196118 - DNA, 36 bp, Artificial Sequence
  Synthetic oligonucleotide
ttggatccggctccgagcgtttctgctgcactatca

SEQ ID NO: 196119 - DNA, 36 bp, Artificial Sequence
  Synthetic oligonucleotide
tgacaacgctcatccggtcacttttaacgccactca

SEQ ID NO: 196120 - DNA, 36 bp, Artificial Sequence
  Synthetic oligonucleotide
tgacggagacgcctgccgccgggattcgctacctca

SEQ ID NO: 196121 - DNA, 36 bp, Artificial Sequence
  Synthetic oligonucleotide
gagaagggccgggggaagaaggataggatgcagtca

SEQ ID NO: 196122 - DNA, 36 bp, Artificial Sequence
  Synthetic oligonucleotide
tgcctaccactgctttgtcaactcgttccctgttca

SEQ ID NO: 196123 - DNA, 36 bp, Artificial Sequence
  Synthetic oligonucleotide
gcgcaatacccacacttgtccgtcctgttcgtttca

SEQ ID NO: 196124 - DNA, 36 bp, Artificial Sequence
  Synthetic oligonucleotide
gagtgcatatcggggggagggggataccaggccaga

SEQ ID NO: 196125 - DNA, 37 bp, Artificial Sequence
  Synthetic oligonucleotide
gccgagaggcgcgggaaggtagaagtgggaggtcaga

SEQ ID NO: 196126 - DNA, 37 bp, Artificial Sequence
  Synthetic oligonucleotide
ttgtcaggggagggcaagggggcggtggaatcagaga

SEQ ID NO: 196127 - DNA, 37 bp, Artificial Sequence
  Synthetic oligonucleotide
gcccagaggggaagggaataaaaggggggagggtaga

SEQ ID NO: 196128 - DNA, 37 bp, Artificial Sequence
  Synthetic oligonucleotide
ggccatggaaggaaaaggtaaggggcaaggaagacga

SEQ ID NO: 196129 - DNA, 36 bp, Artificial Sequence
  Synthetic oligonucleotide
gtggatcatgtcgagggggagggcgagataggacga

SEQ ID NO: 196130 - DNA, 37 bp, Artificial Sequence
  Synthetic oligonucleotide
gcagagggagggggcgaaagtgcggtgtggatgacga

SEQ ID NO: 196131 - DNA, 37 bp, Artificial Sequence
  Synthetic oligonucleotide
gcgacgtacgccacattgatctcccacaatcttacga

SEQ ID NO: 196132 - DNA, 36 bp, Artificial Sequence
  Synthetic oligonucleotide
tctctccaccaccgcgacgcgacgtctcactcccga

SEQ ID NO: 196133 - DNA, 36 bp, Artificial Sequence
  Synthetic oligonucleotide
gagtgtcctcaccccgttctcttcctgccctcccga

SEQ ID NO: 196134 - DNA, 37 bp, Artificial Sequence
  Synthetic oligonucleotide
cacacgccgcctgacggtttcaattgccgccctccga

SEQ ID NO: 196135 - DNA, 37 bp, Artificial Sequence
  Synthetic oligonucleotide
gcccgcacccataaagtgtctacgttaactcctccga

SEQ ID NO: 196136 - DNA, 37 bp, Artificial Sequence
  Synthetic oligonucleotide
tacacccgtagatagccctcattgtcatcctgtccga

SEQ ID NO: 196137 - DNA, 35 bp, Artificial Sequence
  Synthetic oligonucleotide
gactcggggggagttgggcagggagaaaacggcga

SEQ ID NO: 196138 - DNA, 36 bp, Artificial Sequence
  Synthetic oligonucleotide
ggtagacgaggagcacaagggggcggagtggggcga

SEQ ID NO: 196139 - DNA, 37 bp, Artificial Sequence
  Synthetic oligonucleotide
atgaccctttgacgccgtatcatccttcattcctcga

SEQ ID NO: 196140 - DNA, 37 bp, Artificial Sequence
  Synthetic oligonucleotide
ggtgagaggaaagaggggtgggaaacgcctgatagga

SEQ ID NO: 196141 - DNA, 37 bp, Artificial Sequence
  Synthetic oligonucleotide
gccacctgtccgtctgtccctccgcctccttctagga

SEQ ID NO: 196142 - DNA, 37 bp, Artificial Sequence
  Synthetic oligonucleotide
gtggggagtggagatggggtcagggagcgaaccggga

SEQ ID NO: 196143 - DNA, 36 bp, Artificial Sequence
  Synthetic oligonucleotide
ttgcgtgacgagggaggggtgcggagcgttgcggga

SEQ ID NO: 196144 - DNA, 36 bp, Artificial Sequence
  Synthetic oligonucleotide
tccaggtcagggccgattcgatgggggggaagggga

SEQ ID NO: 196145 - DNA, 37 bp, Artificial Sequence
  Synthetic oligonucleotide
gtctgttgcctccctgtcatgcctgcaccttattgga

SEQ ID NO: 196146 - DNA, 37 bp, Artificial Sequence
  Synthetic oligonucleotide
gtggacgagtacagaggcgggggggcgttgactatga

SEQ ID NO: 196147 - DNA, 36 bp, Artificial Sequence
  Synthetic oligonucleotide
tcaaacggttcagtgtctaaactccccccgacctga

SEQ ID NO: 196148 - DNA, 38 bp, Artificial Sequence
  Synthetic oligonucleotide
tacatgtagggcgggtaggagaagggaagcaccgctga

SEQ ID NO: 196149 - DNA, 37 bp, Artificial Sequence
  Synthetic oligonucleotide
tcagcgtagctcatcctgcgtcaacctcccaccgtga

SEQ ID NO: 196150 - DNA, 38 bp, Artificial Sequence
  Synthetic oligonucleotide
acttggcgcctatttataactccctgtttcccccgtga

SEQ ID NO: 196151 - DNA, 38 bp, Artificial Sequence
  Synthetic oligonucleotide
tcactcgtcaaaccctgtaaccttacgcccttccgtga

SEQ ID NO: 196152 - DNA, 38 bp, Artificial Sequence
  Synthetic oligonucleotide
gacaggggaactgggcgggcgaacgggaccctgggtga

SEQ ID NO: 196153 - DNA, 37 bp, Artificial Sequence
  Synthetic oligonucleotide
gcacgacagtccctgcctcagctccgtactaacttga

SEQ ID NO: 196154 - DNA, 38 bp, Artificial Sequence
  Synthetic oligonucleotide
gtctccgccggactcgtaagccccccgctaccgcttga

SEQ ID NO: 196155 - DNA, 38 bp, Artificial Sequence
  Synthetic oligonucleotide
aacctgccgatccgtgtgcatctcatctcccccgttga

SEQ ID NO: 196156 - DNA, 38 bp, Artificial Sequence
  Synthetic oligonucleotide
gagagtggcggacggcggggttgggcgggggactttga

SEQ ID NO: 196157 - DNA, 37 bp, Artificial Sequence
  Synthetic oligonucleotide
ttgtagcgggcacatcgtttgtcggcccctcttttga

SEQ ID NO: 196158 - DNA, 36 bp, Artificial Sequence
  Synthetic oligonucleotide
gcacaagctgtccgctttgccctctcgtactgaata

SEQ ID NO: 196159 - DNA, 35 bp, Artificial Sequence
  Synthetic oligonucleotide
acaccttagcatgaggtacgcccactctcttcata

SEQ ID NO: 196160 - DNA, 35 bp, Artificial Sequence
  Synthetic oligonucleotide
ttcaccacgttccaccgggcctacatgttcgacta

SEQ ID NO: 196161 - DNA, 35 bp, Artificial Sequence
  Synthetic oligonucleotide
tcacgcgtagcaattgtctcatgttcacgcctcta

SEQ ID NO: 196162 - DNA, 35 bp, Artificial Sequence
  Synthetic oligonucleotide
tccccaagaccctgctggccccagtctcacttcta

SEQ ID NO: 196163 - DNA, 35 bp, Artificial Sequence
  Synthetic oligonucleotide
acgcatgctgccgcctgtttcaagtctccgccgta

SEQ ID NO: 196164 - DNA, 36 bp, Artificial Sequence
  Synthetic oligonucleotide
atcccaatcctccccagtgtacacaccgagtgggta

SEQ ID NO: 196165 - DNA, 35 bp, Artificial Sequence
  Synthetic oligonucleotide
tccccacccacattgtgtggtatcctagtattgta

SEQ ID NO: 196166 - DNA, 36 bp, Artificial Sequence
  Synthetic oligonucleotide
gactgcgatgtgacccatgctcgttcccctcgttta

SEQ ID NO: 196167 - DNA, 35 bp, Artificial Sequence
  Synthetic oligonucleotide
atgaccccattcccctgccgctaagtccgttccac

SEQ ID NO: 196168 - DNA, 35 bp, Artificial Sequence
  Synthetic oligonucleotide
tgtcaccaccggacacttgcctatactaccttcac

SEQ ID NO: 196169 - DNA, 35 bp, Artificial Sequence
  Synthetic oligonucleotide
atccaccagtaccatttgactataatccgtttcac

SEQ ID NO: 196170 - DNA, 35 bp, Artificial Sequence
  Synthetic oligonucleotide
tagcgccgcctatataacatcctggccttttcgac

SEQ ID NO: 196171 - DNA, 35 bp, Artificial Sequence
  Synthetic oligonucleotide
atagtggcgtccctgcatcataggccctccgctac

SEQ ID NO: 196172 - DNA, 35 bp, Artificial Sequence
  Synthetic oligonucleotide
gccaacgtctaacgcgatattatgccctctgctac

SEQ ID NO: 196173 - DNA, 35 bp, Artificial Sequence
  Synthetic oligonucleotide
tcactacccttgatgtcttaaggcccttaccaccc

SEQ ID NO: 196174 - DNA, 35 bp, Artificial Sequence
  Synthetic oligonucleotide
acaagctgtgccgacttgtagttctgttccgcccc

SEQ ID NO: 196175 - DNA, 35 bp, Artificial Sequence
  Synthetic oligonucleotide
aaccagccagccgttcacatccgcgtatcctcccc

SEQ ID NO: 196176 - DNA, 36 bp, Artificial Sequence
  Synthetic oligonucleotide
ttgcatggtcacgtattgtatccgcccacgctcccc

SEQ ID NO: 196177 - DNA, 35 bp, Artificial Sequence
  Synthetic oligonucleotide
tgaactggtcctagctttatgcaccgcccgctccc

SEQ ID NO: 196178 - DNA, 35 bp, Artificial Sequence
  Synthetic oligonucleotide
gcattgccaccccgccgacacatggttactttccc

SEQ ID NO: 196179 - DNA, 35 bp, Artificial Sequence
  Synthetic oligonucleotide
tacccgacatcgtgccgcgcacccgagtccctgcc

SEQ ID NO: 196180 - DNA, 35 bp, Artificial Sequence
  Synthetic oligonucleotide
tcgcgacggtccgccgtaccctcaacacccgtgcc

SEQ ID NO: 196181 - DNA, 35 bp, Artificial Sequence
  Synthetic oligonucleotide
ttccatcgagtgattgtgcaaattgctcgccctcc

SEQ ID NO: 196182 - DNA, 35 bp, Artificial Sequence
  Synthetic oligonucleotide
ttggaccccactgacctgtttgcgaacgcccgtcc

SEQ ID NO: 196183 - DNA, 35 bp, Artificial Sequence
  Synthetic oligonucleotide
ttgagcacacagtcggagtattgtacctcccgtcc

SEQ ID NO: 196184 - DNA, 35 bp, Artificial Sequence
  Synthetic oligonucleotide
tcatccttcgcactgaatacgggccattttgttcc

SEQ ID NO: 196185 - DNA, 34 bp, Artificial Sequence
  Synthetic oligonucleotide
agacccccgcatgcagtattccccccccgctagc

SEQ ID NO: 196186 - DNA, 35 bp, Artificial Sequence
  Synthetic oligonucleotide
ggtggagcctgaacgggggggagatggtacgaggc

SEQ ID NO: 196187 - DNA, 35 bp, Artificial Sequence
  Synthetic oligonucleotide
gctggcgttagaccgcctaaccccttgcccactgc

SEQ ID NO: 196188 - DNA, 33 bp, Artificial Sequence
  Synthetic oligonucleotide
gtggggttgacccgccacaagcacccttccatc

SEQ ID NO: 196189 - DNA, 35 bp, Artificial Sequence
  Synthetic oligonucleotide
tgagcattgcctaccgttctaccgacatactcatc

SEQ ID NO: 196190 - DNA, 35 bp, Artificial Sequence
  Synthetic oligonucleotide
gacctcctccacttgtctcgtgcccgacgaccctc

SEQ ID NO: 196191 - DNA, 35 bp, Artificial Sequence
  Synthetic oligonucleotide
ttatcacccaccatacgcgtggaaagcccgccctc

SEQ ID NO: 196192 - DNA, 35 bp, Artificial Sequence
  Synthetic oligonucleotide
gttggtcctgttgttcctttgtgcgatgtgccctc

SEQ ID NO: 196193 - DNA, 35 bp, Artificial Sequence
  Synthetic oligonucleotide
tagcaagagccccgttgtgccgtcgcgcgatcctc

SEQ ID NO: 196194 - DNA, 35 bp, Artificial Sequence
  Synthetic oligonucleotide
tgcgtcacttcctcatcccttagtcggcccagctc

SEQ ID NO: 196195 - DNA, 35 bp, Artificial Sequence
  Synthetic oligonucleotide
atcgcccaggtccgacttgaccatccagccccttc

SEQ ID NO: 196196 - DNA, 35 bp, Artificial Sequence
  Synthetic oligonucleotide
tgcgcatacagttgcttcacccattggcattcttc

SEQ ID NO: 196197 - DNA, 35 bp, Artificial Sequence
  Synthetic oligonucleotide
gagggcacctctcgttatatttgccgtcctagttc

SEQ ID NO: 196198 - DNA, 35 bp, Artificial Sequence
  Synthetic oligonucleotide
tgcctcgctccgttaacccgttagtaacacctttc

SEQ ID NO: 196199 - DNA, 35 bp, Artificial Sequence
  Synthetic oligonucleotide
gcgggatgggaaggggggggagtgaggcatacaag

SEQ ID NO: 196200 - DNA, 35 bp, Artificial Sequence
  Synthetic oligonucleotide
gatggggtaatagcatagagcggggaagggacgag

SEQ ID NO: 196201 - DNA, 35 bp, Artificial Sequence
  Synthetic oligonucleotide
aagagggcgaaggcagtagaacaggatgaagctag

SEQ ID NO: 196202 - DNA, 36 bp, Artificial Sequence
  Synthetic oligonucleotide
atctgccccttcaccccggtgtcttctcagcgtacg

SEQ ID NO: 196203 - DNA, 35 bp, Artificial Sequence
  Synthetic oligonucleotide
gccgttagagtccctgcatttcatttacaccaccg

SEQ ID NO: 196204 - DNA, 34 bp, Artificial Sequence
  Synthetic oligonucleotide
gctcattcggggcaattgtcgttccatctcaccg

SEQ ID NO: 196205 - DNA, 34 bp, Artificial Sequence
  Synthetic oligonucleotide
attcgcctcacatctcacgcaagacctgtccccg

SEQ ID NO: 196206 - DNA, 35 bp, Artificial Sequence
  Synthetic oligonucleotide
atgacccacccaatggcataatccatcattccccg

SEQ ID NO: 196207 - DNA, 35 bp, Artificial Sequence
  Synthetic oligonucleotide
acgtagcacccgttttattccaccccgtcgctgcg

SEQ ID NO: 196208 - DNA, 35 bp, Artificial Sequence
  Synthetic oligonucleotide
ttcccgctctgtctgcctgcccccgatggtaatcg

SEQ ID NO: 196209 - DNA, 35 bp, Artificial Sequence
  Synthetic oligonucleotide
tcgatcctggtactcgttaaaccttcctgccttcg

SEQ ID NO: 196210 - DNA, 35 bp, Artificial Sequence
  Synthetic oligonucleotide
tgtcacaggagggcaagaaagaatcgggaaaaagg

SEQ ID NO: 196211 - DNA, 35 bp, Artificial Sequence
  Synthetic oligonucleotide
gaatgcgggatgggaaagggttcgtgcggggtagg

SEQ ID NO: 196212 - DNA, 35 bp, Artificial Sequence
  Synthetic oligonucleotide
tgaagtgggaggggaatggagctgttggggcgtgg

SEQ ID NO: 196213 - DNA, 35 bp, Artificial Sequence
  Synthetic oligonucleotide
acccccgacccaccaccgcgcatgcgagcactatg

SEQ ID NO: 196214 - DNA, 35 bp, Artificial Sequence
  Synthetic oligonucleotide
ttactgcgagggtgcgggtggagatgcgggaagtg

SEQ ID NO: 196215 - DNA, 35 bp, Artificial Sequence
  Synthetic oligonucleotide
gctttccgcccccctatactgtgtcattactcgtg

SEQ ID NO: 196216 - DNA, 36 bp, Artificial Sequence
  Synthetic oligonucleotide
gccgcccttcacgttttgccacccgactcgctggtg

SEQ ID NO: 196217 - DNA, 35 bp, Artificial Sequence
  Synthetic oligonucleotide
tccatacctccgccgatcttagctaacagaaaaat

SEQ ID NO: 196218 - DNA, 33 bp, Artificial Sequence
  Synthetic oligonucleotide
gcactacacctggttcttggttcgactttctat

SEQ ID NO: 196219 - DNA, 35 bp, Artificial Sequence
  Synthetic oligonucleotide
tcatggagcgcttactctgttcgtcacctctcact

SEQ ID NO: 196220 - DNA, 35 bp, Artificial Sequence
  Synthetic oligonucleotide
gactgactatggcagtatacgctctacctgaacct

SEQ ID NO: 196221 - DNA, 35 bp, Artificial Sequence
  Synthetic oligonucleotide
gtgcgaccctcactacgggtaacgaaacgcctcct

SEQ ID NO: 196222 - DNA, 35 bp, Artificial Sequence
  Synthetic oligonucleotide
gtgccctccctaattatcgtcctggtccctgtcct

SEQ ID NO: 196223 - DNA, 35 bp, Artificial Sequence
  Synthetic oligonucleotide
ttggtagacccccgcttgtccctctgttcgttcct

SEQ ID NO: 196224 - DNA, 35 bp, Artificial Sequence
  Synthetic oligonucleotide
gatgcccctcgccatctcttgttctatctgttcct

SEQ ID NO: 196225 - DNA, 35 bp, Artificial Sequence
  Synthetic oligonucleotide
acaacagctagcagcataccacctcctctttcgct

SEQ ID NO: 196226 - DNA, 35 bp, Artificial Sequence
  Synthetic oligonucleotide
tagtctcgcggcgagttctgccctccctaaatgct

SEQ ID NO: 196227 - DNA, 35 bp, Artificial Sequence
  Synthetic oligonucleotide
tagcaaccccgcctcttgtatccccatacattgct

SEQ ID NO: 196228 - DNA, 35 bp, Artificial Sequence
  Synthetic oligonucleotide
gttcccgcgggttgccagagctcaccgtttcctct

SEQ ID NO: 196229 - DNA, 35 bp, Artificial Sequence
  Synthetic oligonucleotide
ggatcatcgtacggcctcatagttatccacgctct

SEQ ID NO: 196230 - DNA, 35 bp, Artificial Sequence
  Synthetic oligonucleotide
gccgtaccagcaccccgcagacctgatatcgctct

SEQ ID NO: 196231 - DNA, 35 bp, Artificial Sequence
  Synthetic oligonucleotide
cgatgggactggtaactggttccttgctactctct

SEQ ID NO: 196232 - DNA, 35 bp, Artificial Sequence
  Synthetic oligonucleotide
gagagccatatagcggaagggaagtgcgtgggagt

SEQ ID NO: 196233 - DNA, 35 bp, Artificial Sequence
  Synthetic oligonucleotide
atcggagacctcccgatgcagctattcaccgccgt

SEQ ID NO: 196234 - DNA, 35 bp, Artificial Sequence
  Synthetic oligonucleotide
tacacctcacctatgcccgttcctgcccgccctgt

SEQ ID NO: 196235 - DNA, 35 bp, Artificial Sequence
  Synthetic oligonucleotide
acgtaccggtgctcgttttcatccacatagtcctt

SEQ ID NO: 196236 - DNA, 35 bp, Artificial Sequence
  Synthetic oligonucleotide
tcatcgcaccgctgtcaaccctgaatactcctctt

SEQ ID NO: 196237 - DNA, 35 bp, Artificial Sequence
  Synthetic oligonucleotide
gtcaccccgcaatcccgccctgtagacgcattctt

SEQ ID NO: 196238 - DNA, 35 bp, Artificial Sequence
  Synthetic oligonucleotide
acccagaccctcccactgctttcgtgacagtgaaa

SEQ ID NO: 196239 - DNA, 36 bp, Artificial Sequence
  Synthetic oligonucleotide
gtggagcacaaggaggagaaataaataagagggcaa

SEQ ID NO: 196240 - DNA, 36 bp, Artificial Sequence
  Synthetic oligonucleotide
tagtagagtggagggggctagggttccaggggcgaa

SEQ ID NO: 196241 - DNA, 36 bp, Artificial Sequence
  Synthetic oligonucleotide
tgttgtcgtcgccgtagggaatcgggcgggcgggaa

SEQ ID NO: 196242 - DNA, 35 bp, Artificial Sequence
  Synthetic oligonucleotide
acgatcgccctcttgccgcctatggtctccctgaa

SEQ ID NO: 196243 - DNA, 34 bp, Artificial Sequence
  Synthetic oligonucleotide
gccatccttcccctccagacagcgaataattgaa

SEQ ID NO: 196244 - DNA, 34 bp, Artificial Sequence
  Synthetic oligonucleotide
acagcgcatcccgtccaatcattcccgtcttgaa

SEQ ID NO: 196245 - DNA, 36 bp, Artificial Sequence
  Synthetic oligonucleotide
gtcacagtcgttctctcttcgtactttctccgctaa

SEQ ID NO: 196246 - DNA, 35 bp, Artificial Sequence
  Synthetic oligonucleotide
gaagtagtggtgggtgaggaagatggagcgcgtaa

SEQ ID NO: 196247 - DNA, 36 bp, Artificial Sequence
  Synthetic oligonucleotide
aattgggaggtacggggggacatacgacaggacaca

SEQ ID NO: 196248 - DNA, 35 bp, Artificial Sequence
  Synthetic oligonucleotide
aacaccccggtccctcgtagccatgcgatgtcaca

SEQ ID NO: 196249 - DNA, 35 bp, Artificial Sequence
  Synthetic oligonucleotide
gaccccgtcccacctctctatagaagcacttcaca

SEQ ID NO: 196250 - DNA, 36 bp, Artificial Sequence
  Synthetic oligonucleotide
ttcatgacggcgtccaaggtctcgttcccgttcaca

SEQ ID NO: 196251 - DNA, 35 bp, Artificial Sequence
  Synthetic oligonucleotide
gcacatcacctctgtgtcttggtgccatccctaca

SEQ ID NO: 196252 - DNA, 36 bp, Artificial Sequence
  Synthetic oligonucleotide
tatgaccgccacattgtcttggatcggcccctacca

SEQ ID NO: 196253 - DNA, 36 bp, Artificial Sequence
  Synthetic oligonucleotide
acacgcatcgctatgttcccccgtaaatggccccca

SEQ ID NO: 196254 - DNA, 36 bp, Artificial Sequence
  Synthetic oligonucleotide
tgcccgacgtcgtctccatcgggcgcgctatcccca

SEQ ID NO: 196255 - DNA, 35 bp, Artificial Sequence
  Synthetic oligonucleotide
acccgccggtcgatccttacggcaatccttcccca

SEQ ID NO: 196256 - DNA, 36 bp, Artificial Sequence
  Synthetic oligonucleotide
ttacgtccgccgacgccgaaaccatgcctatagcca

SEQ ID NO: 196257 - DNA, 36 bp, Artificial Sequence
  Synthetic oligonucleotide
tccccaagcgctaaactttatatcgatcctccgcca

SEQ ID NO: 196258 - DNA, 36 bp, Artificial Sequence
  Synthetic oligonucleotide
ttgattgctgatgtgcccttccttcgttgttcgcca

SEQ ID NO: 196259 - DNA, 36 bp, Artificial Sequence
  Synthetic oligonucleotide
aagacggtgagtgggggggacggtctaggttggcca

SEQ ID NO: 196260 - DNA, 36 bp, Artificial Sequence
  Synthetic oligonucleotide
acgcatccctgttgcatcctcgtacttgaaactcca

SEQ ID NO: 196261 - DNA, 35 bp, Artificial Sequence
  Synthetic oligonucleotide
tctgcggcccccgtatccgccccaatagccgcgca

SEQ ID NO: 196262 - DNA, 36 bp, Artificial Sequence
  Synthetic oligonucleotide
actccgcccccgttcgataagatttcttagctcgca

SEQ ID NO: 196263 - DNA, 36 bp, Artificial Sequence
  Synthetic oligonucleotide
actgcctcagcatcggccctccaccactcgtgtgca

SEQ ID NO: 196264 - DNA, 36 bp, Artificial Sequence
  Synthetic oligonucleotide
gaggggaggggggattatgtgtcggaaatgggctca

SEQ ID NO: 196265 - DNA, 36 bp, Artificial Sequence
  Synthetic oligonucleotide
aacggaatatggggaggtggaggtagagtgggttca

SEQ ID NO: 196266 - DNA, 36 bp, Artificial Sequence
  Synthetic oligonucleotide
tgtaggtacgaatgtcgccgctcgcccctggtttca

SEQ ID NO: 196267 - DNA, 35 bp, Artificial Sequence
  Synthetic oligonucleotide
gcccggtccgcccccctgcatggtatcctttttca

SEQ ID NO: 196268 - DNA, 37 bp, Artificial Sequence
  Synthetic oligonucleotide
gaactgggcggatgggagtgagaagaagggaaaaaga

SEQ ID NO: 196269 - DNA, 37 bp, Artificial Sequence
  Synthetic oligonucleotide
ggatgcccggggggagttgggagggaaggcatgaaga

SEQ ID NO: 196270 - DNA, 37 bp, Artificial Sequence
  Synthetic oligonucleotide
agtaacacccgccctccgaccagtccgatatttcaga

SEQ ID NO: 196271 - DNA, 37 bp, Artificial Sequence
  Synthetic oligonucleotide
aacactccgttgtgacaccccatcctcctttccgaga

SEQ ID NO: 196272 - DNA, 37 bp, Artificial Sequence
  Synthetic oligonucleotide
ttatcgcaggggtaccagggaagggcgggaacggaga

SEQ ID NO: 196273 - DNA, 29 bp, Artificial Sequence
  Synthetic oligonucleotide
acaccgacccaccccctacggcggatcga

SEQ ID NO: 196274 - DNA, 37 bp, Artificial Sequence
  Synthetic oligonucleotide
gagggtgggttgggtcgggacaagcgactgtgttcga

SEQ ID NO: 196275 - DNA, 37 bp, Artificial Sequence
  Synthetic oligonucleotide
atgtaggggacgaaggcgagagggttgacggtaagga

SEQ ID NO: 196276 - DNA, 37 bp, Artificial Sequence
  Synthetic oligonucleotide
gaagcaggtgaaagcagggggacgagggaggctagga

SEQ ID NO: 196277 - DNA, 37 bp, Artificial Sequence
  Synthetic oligonucleotide
gtgaacaaggggtgggtggaagacacgcgtacacgga

SEQ ID NO: 196278 - DNA, 35 bp, Artificial Sequence
  Synthetic oligonucleotide
tgccatgccacacaaggcgctacttacactccgga

SEQ ID NO: 196279 - DNA, 37 bp, Artificial Sequence
  Synthetic oligonucleotide
agggtagcggaaagggcaaggtggagcgcgggaggga

SEQ ID NO: 196280 - DNA, 36 bp, Artificial Sequence
  Synthetic oligonucleotide
ggatggggggtcctcgagcggaattgaggggaggga

SEQ ID NO: 196281 - DNA, 37 bp, Artificial Sequence
  Synthetic oligonucleotide
ggtgcggagtgctggggttcgggatgagaggggggga

SEQ ID NO: 196282 - DNA, 37 bp, Artificial Sequence
  Synthetic oligonucleotide
taaggtggaggcggtgttggacggacagcatggtgga

SEQ ID NO: 196283 - DNA, 37 bp, Artificial Sequence
  Synthetic oligonucleotide
tcatgcacatgcctgattgctccccctgctctttgga

SEQ ID NO: 196284 - DNA, 38 bp, Artificial Sequence
  Synthetic oligonucleotide
gtgaccatacccgcctgcccctgacagtctctgaatga

SEQ ID NO: 196285 - DNA, 35 bp, Artificial Sequence
  Synthetic oligonucleotide
gggagcaacggggttgacacgggaggggattatga

SEQ ID NO: 196286 - DNA, 38 bp, Artificial Sequence
  Synthetic oligonucleotide
ttgctccgcagccgcccacaagccttcccctgttatga

SEQ ID NO: 196287 - DNA, 38 bp, Artificial Sequence
  Synthetic oligonucleotide
agatggggtcgagggccgggtacgagcgggaggagtga

SEQ ID NO: 196288 - DNA, 37 bp, Artificial Sequence
  Synthetic oligonucleotide
gtgtcactgggcaaaagggtggaggtgatagtagtga

SEQ ID NO: 196289 - DNA, 38 bp, Artificial Sequence
  Synthetic oligonucleotide
tctatcagccccctcgcactcctcgccgcactacgtga

SEQ ID NO: 196290 - DNA, 38 bp, Artificial Sequence
  Synthetic oligonucleotide
acatcgtcgacgtccatcctgtgctgcccattccgtga

SEQ ID NO: 196291 - DNA, 37 bp, Artificial Sequence
  Synthetic oligonucleotide
tgctagacactcggtagtagggagggcgggcatgtga

SEQ ID NO: 196292 - DNA, 37 bp, Artificial Sequence
  Synthetic oligonucleotide
tgtcgcccactgctctacgctcactcctggcctgtga

SEQ ID NO: 196293 - DNA, 38 bp, Artificial Sequence
  Synthetic oligonucleotide
gttccgcctcaggttccgctttcatccatttcctgtga

SEQ ID NO: 196294 - DNA, 36 bp, Artificial Sequence
  Synthetic oligonucleotide
gagagaatgcggggagggagagagtaggaatcttga

SEQ ID NO: 196295 - DNA, 37 bp, Artificial Sequence
  Synthetic oligonucleotide
tgctgcatcgtttcgccttgtacttcccaccatttga

SEQ ID NO: 196296 - DNA, 35 bp, Artificial Sequence
  Synthetic oligonucleotide
tccaccgcccgaggagctaccagactaccgcacta

SEQ ID NO: 196297 - DNA, 36 bp, Artificial Sequence
  Synthetic oligonucleotide
tacgccctactccgacttttcgcgccgacatggcta

SEQ ID NO: 196298 - DNA, 36 bp, Artificial Sequence
  Synthetic oligonucleotide
gtacgtctattggtaccgccaccccactcgtttcta

SEQ ID NO: 196299 - DNA, 36 bp, Artificial Sequence
  Synthetic oligonucleotide
aagtccggacgggaggctggtggaacagggaaggta

SEQ ID NO: 196300 - DNA, 36 bp, Artificial Sequence
  Synthetic oligonucleotide
accacgacggggggcttataaaggagatggaaggta

SEQ ID NO: 196301 - DNA, 36 bp, Artificial Sequence
  Synthetic oligonucleotide
gacgggaagacatgggcaaagggggcatagtgtgta

SEQ ID NO: 196302 - DNA, 36 bp, Artificial Sequence
  Synthetic oligonucleotide
ggtacaacctctgagttcaatggctccctcccgtta

SEQ ID NO: 196303 - DNA, 35 bp, Artificial Sequence
  Synthetic oligonucleotide
accctacctgatccgtactttacgactgtatacac

SEQ ID NO: 196304 - DNA, 35 bp, Artificial Sequence
  Synthetic oligonucleotide
tgcactgctccatgccaccgaacaccgtcccaacc

SEQ ID NO: 196305 - DNA, 35 bp, Artificial Sequence
  Synthetic oligonucleotide
tacgcattccgtaagctccctccatcggacaaccc

SEQ ID NO: 196306 - DNA, 35 bp, Artificial Sequence
  Synthetic oligonucleotide
tgcggagctgatcgttcgtgccccttctctcgccc

SEQ ID NO: 196307 - DNA, 35 bp, Artificial Sequence
  Synthetic oligonucleotide
gccacacccccatgttatcccgttagtctttggcc

SEQ ID NO: 196308 - DNA, 35 bp, Artificial Sequence
  Synthetic oligonucleotide
acaccgcaaagcctcaccgcgagcccctgatatcc

SEQ ID NO: 196309 - DNA, 35 bp, Artificial Sequence
  Synthetic oligonucleotide
ggtcacctgcctccctgactcgttatcctgcctcc

SEQ ID NO: 196310 - DNA, 34 bp, Artificial Sequence
  Synthetic oligonucleotide
ttcgccgccccattgcttgttccatcagtcttcc

SEQ ID NO: 196311 - DNA, 35 bp, Artificial Sequence
  Synthetic oligonucleotide
atccgtcgcattggcatttggccctgctcctttcc

SEQ ID NO: 196312 - DNA, 32 bp, Artificial Sequence
  Synthetic oligonucleotide
ggagggggggaggaggttaaggcaggctcagc

SEQ ID NO: 196313 - DNA, 35 bp, Artificial Sequence
  Synthetic oligonucleotide
gctacgcctaactataacatccgccgttcctacgc

SEQ ID NO: 196314 - DNA, 35 bp, Artificial Sequence
  Synthetic oligonucleotide
tgtcaccgcttagtttccgagttcccttgcgccgc

SEQ ID NO: 196315 - DNA, 35 bp, Artificial Sequence
  Synthetic oligonucleotide
tcgtcgcccccatcgtgactctagctgttaccatc

SEQ ID NO: 196316 - DNA, 35 bp, Artificial Sequence
  Synthetic oligonucleotide
gtgtccgccgctcaaccggtaagcgcatttacctc

SEQ ID NO: 196317 - DNA, 35 bp, Artificial Sequence
  Synthetic oligonucleotide
tacctgcgccgctaggttatgccggattactcctc

SEQ ID NO: 196318 - DNA, 35 bp, Artificial Sequence
  Synthetic oligonucleotide
tagggcgaagtgtgtaattccccgcgtgcctcctc

SEQ ID NO: 196319 - DNA, 35 bp, Artificial Sequence
  Synthetic oligonucleotide
aattcagccaccctttactatcacctgggcatgtc

SEQ ID NO: 196320 - DNA, 35 bp, Artificial Sequence
  Synthetic oligonucleotide
tacgctgctcagtgttttgtgcccttcgccctgtc

SEQ ID NO: 196321 - DNA, 35 bp, Artificial Sequence
  Synthetic oligonucleotide
taagacagctgccttgttacctgtcccctcaattc

SEQ ID NO: 196322 - DNA, 35 bp, Artificial Sequence
  Synthetic oligonucleotide
taacacccacaactggtccatgtctacttcaattc

SEQ ID NO: 196323 - DNA, 35 bp, Artificial Sequence
  Synthetic oligonucleotide
gtccatcgcgagctttaatcgcttggttgtccttc

SEQ ID NO: 196324 - DNA, 35 bp, Artificial Sequence
  Synthetic oligonucleotide
gagactagtctgcagtgcccatccagttccctttc

SEQ ID NO: 196325 - DNA, 35 bp, Artificial Sequence
  Synthetic oligonucleotide
agtagggagtcgggtgggcgggattctagaacacg

SEQ ID NO: 196326 - DNA, 35 bp, Artificial Sequence
  Synthetic oligonucleotide
gcgaggaggacgaggaaggggcccgtcaggtgacg

SEQ ID NO: 196327 - DNA, 35 bp, Artificial Sequence
  Synthetic oligonucleotide
gaccgcctgccacacatcttccatacgcccctacg

SEQ ID NO: 196328 - DNA, 35 bp, Artificial Sequence
  Synthetic oligonucleotide
agcaaaccgccgccgggcaacaatgccttcctacg

SEQ ID NO: 196329 - DNA, 34 bp, Artificial Sequence
  Synthetic oligonucleotide
gatctcacccgccccctctttggaaccagctacg

SEQ ID NO: 196330 - DNA, 35 bp, Artificial Sequence
  Synthetic oligonucleotide
gtccggcctatctgcatctttcgagcctactaccg

SEQ ID NO: 196331 - DNA, 35 bp, Artificial Sequence
  Synthetic oligonucleotide
gattgcccgccttctgcgtatccacctccccatcg

SEQ ID NO: 196332 - DNA, 35 bp, Artificial Sequence
  Synthetic oligonucleotide
tacacccacctcccctgctggaccacctctaacgg

SEQ ID NO: 196333 - DNA, 35 bp, Artificial Sequence
  Synthetic oligonucleotide
acccaccaatgtgcttccaaacgattccccgccgg

SEQ ID NO: 196334 - DNA, 35 bp, Artificial Sequence
  Synthetic oligonucleotide
tcgacggagggggtacgtaaagaaggggttgccgg

SEQ ID NO: 196335 - DNA, 35 bp, Artificial Sequence
  Synthetic oligonucleotide
gcagacagggaagggtggagggagggacgagtctg

SEQ ID NO: 196336 - DNA, 35 bp, Artificial Sequence
  Synthetic oligonucleotide
gtaagacgaaggtgcggggacggagaggaggggtg

SEQ ID NO: 196337 - DNA, 35 bp, Artificial Sequence
  Synthetic oligonucleotide
gccctccccacaataccatcaccctgagctgtgtg

SEQ ID NO: 196338 - DNA, 35 bp, Artificial Sequence
  Synthetic oligonucleotide
gctcaagcacatggcattcaacggcctatccacct

SEQ ID NO: 196339 - DNA, 35 bp, Artificial Sequence
  Synthetic oligonucleotide
gcaacggaactcattgtcattttgcctcatcgcct

SEQ ID NO: 196340 - DNA, 35 bp, Artificial Sequence
  Synthetic oligonucleotide
tccgccccgagctgttataccgcgattcctactct

SEQ ID NO: 196341 - DNA, 35 bp, Artificial Sequence
  Synthetic oligonucleotide
gctaaacgtactcaacacccaccacggcgctctct

SEQ ID NO: 196342 - DNA, 35 bp, Artificial Sequence
  Synthetic oligonucleotide
tcacaaccgcatccatccatgttcgctgaaggtct

SEQ ID NO: 196343 - DNA, 35 bp, Artificial Sequence
  Synthetic oligonucleotide
atcagcacagctaagtccgtccttccctcccccgt

SEQ ID NO: 196344 - DNA, 35 bp, Artificial Sequence
  Synthetic oligonucleotide
ggtcgccgtcgacgcctttctcgccgtttaacatt

SEQ ID NO: 196345 - DNA, 35 bp, Artificial Sequence
  Synthetic oligonucleotide
gttgtatcagatcgctggtgattcggtccgccctt

SEQ ID NO: 196346 - DNA, 35 bp, Artificial Sequence
  Synthetic oligonucleotide
accgcccacgttgctgaccgttcgatctctatctt

SEQ ID NO: 196347 - DNA, 35 bp, Artificial Sequence
  Synthetic oligonucleotide
tgtgcgccacacatgtcgcctctctccttcgtgtt

SEQ ID NO: 196348 - DNA, 35 bp, Artificial Sequence
  Synthetic oligonucleotide
agccggggccacgctggctgctttgcttatctttt

SEQ ID NO: 196349 - DNA, 36 bp, Artificial Sequence
  Synthetic oligonucleotide
ggacggaatcggaaggagaggggtacggcaggaaaa

SEQ ID NO: 196350 - DNA, 36 bp, Artificial Sequence
  Synthetic oligonucleotide
atggcaaggggggggcgagggagacgctgctggaaa

SEQ ID NO: 196351 - DNA, 36 bp, Artificial Sequence
  Synthetic oligonucleotide
aaacaccgtagccctgcatcgctccctcccgataaa

SEQ ID NO: 196352 - DNA, 36 bp, Artificial Sequence
  Synthetic oligonucleotide
tcagtgcccctccatccgtactgtatccttgataaa

SEQ ID NO: 196353 - DNA, 35 bp, Artificial Sequence
  Synthetic oligonucleotide
taaccgggggtggtacaaagggagttggggcgaca

SEQ ID NO: 196354 - DNA, 35 bp, Artificial Sequence
  Synthetic oligonucleotide
tcagtccgccctctctggctgcgcttatgccagca

SEQ ID NO: 196355 - DNA, 35 bp, Artificial Sequence
  Synthetic oligonucleotide
gtctcacacctgtttaatttgcctcgtctatcgca

SEQ ID NO: 196356 - DNA, 36 bp, Artificial Sequence
  Synthetic oligonucleotide
gatgccgggaaaagggtggggcgactgtgcggggca

SEQ ID NO: 196357 - DNA, 35 bp, Artificial Sequence
  Synthetic oligonucleotide
tacgcctccaccgcccctgctcatttaaccgtgca

SEQ ID NO: 196358 - DNA, 37 bp, Artificial Sequence
  Synthetic oligonucleotide
atgggaagaggggtggaagatggggatgtacgaaaga

SEQ ID NO: 196359 - DNA, 37 bp, Artificial Sequence
  Synthetic oligonucleotide
gcacggtgcgggagtaggggggattgggcgctaaaga

SEQ ID NO: 196360 - DNA, 36 bp, Artificial Sequence
  Synthetic oligonucleotide
gtacgaagagcggaacagtagagggcaagggtaaga

SEQ ID NO: 196361 - DNA, 37 bp, Artificial Sequence
  Synthetic oligonucleotide
agcatcgccccgctgccctactacgttcctgtacaga

SEQ ID NO: 196362 - DNA, 37 bp, Artificial Sequence
  Synthetic oligonucleotide
gatgtgcgacagtggtggaacctgtgaggggggcaga

SEQ ID NO: 196363 - DNA, 37 bp, Artificial Sequence
  Synthetic oligonucleotide
tcacgtaggggcgggtcagggctgggtagtacggaga

SEQ ID NO: 196364 - DNA, 37 bp, Artificial Sequence
  Synthetic oligonucleotide
aagatggaggtagggggcgattcacgaaggggggaga

SEQ ID NO: 196365 - DNA, 37 bp, Artificial Sequence
  Synthetic oligonucleotide
acgagaggagaggggcggtgagaccgtacgtgataga

SEQ ID NO: 196366 - DNA, 37 bp, Artificial Sequence
  Synthetic oligonucleotide
acccccatgccatctgttttacgtccggaatctacga

SEQ ID NO: 196367 - DNA, 37 bp, Artificial Sequence
  Synthetic oligonucleotide
atcgaccacccgcctcattttgtactcggtgcaccga

SEQ ID NO: 196368 - DNA, 37 bp, Artificial Sequence
  Synthetic oligonucleotide
tcacaccgttctgctttcgtttactctgtgcttgcga

SEQ ID NO: 196369 - DNA, 35 bp, Artificial Sequence
  Synthetic oligonucleotide
gacatcccgacttccgcatacgacatctgactcga

SEQ ID NO: 196370 - DNA, 36 bp, Artificial Sequence
  Synthetic oligonucleotide
gacacccttgacgtattagccgtccatccctttcga

SEQ ID NO: 196371 - DNA, 35 bp, Artificial Sequence
  Synthetic oligonucleotide
acggggcaaaggcaggtgggagggctatgggtgga

SEQ ID NO: 196372 - DNA, 37 bp, Artificial Sequence
  Synthetic oligonucleotide
ttcgaccactcactttgcttcagccagctcccttgga

SEQ ID NO: 196373 - DNA, 37 bp, Artificial Sequence
  Synthetic oligonucleotide
gagctggctgcacttgtttccggccccccccacatga

SEQ ID NO: 196374 - DNA, 38 bp, Artificial Sequence
  Synthetic oligonucleotide
ggggtgtgctcctgctgcttttacccacatttccatga

SEQ ID NO: 196375 - DNA, 38 bp, Artificial Sequence
  Synthetic oligonucleotide
gcagatcattatgcatagcccccaccgtgccaccctga

SEQ ID NO: 196376 - DNA, 37 bp, Artificial Sequence
  Synthetic oligonucleotide
acgcgtttgcaactgtaatgccaatcctccccgctga

SEQ ID NO: 196377 - DNA, 37 bp, Artificial Sequence
  Synthetic oligonucleotide
gtctccgtaccgtgcgcgtatattccacacctgctga

SEQ ID NO: 196378 - DNA, 37 bp, Artificial Sequence
  Synthetic oligonucleotide
tacgtcatggccgctatgcccctttaccactctctga

SEQ ID NO: 196379 - DNA, 36 bp, Artificial Sequence
  Synthetic oligonucleotide
aatgcgtagtccacccactcacacacacctgtctga

SEQ ID NO: 196380 - DNA, 37 bp, Artificial Sequence
  Synthetic oligonucleotide
tcgcggcgaacacggaaagcattaggggcgggggtga

SEQ ID NO: 196381 - DNA, 38 bp, Artificial Sequence
  Synthetic oligonucleotide
tcccgtgccgtcctatctgcataccgtttttaccttga

SEQ ID NO: 196382 - DNA, 38 bp, Artificial Sequence
  Synthetic oligonucleotide
gcaacccccaccagctgttcatgtcggtccccccttga

SEQ ID NO: 196383 - DNA, 30 bp, Artificial Sequence
  Synthetic oligonucleotide
attccctcgccaacttgcgaccttatttga

SEQ ID NO: 196384 - DNA, 36 bp, Artificial Sequence
  Synthetic oligonucleotide
gttgcctcggagaatctcgagcctatttcacctata

SEQ ID NO: 196385 - DNA, 35 bp, Artificial Sequence
  Synthetic oligonucleotide
tcccgcactgtgctgtctcatcgcctatccgtata

SEQ ID NO: 196386 - DNA, 35 bp, Artificial Sequence
  Synthetic oligonucleotide
accacgagcaggcttggtcgttctcctgcccacta

SEQ ID NO: 196387 - DNA, 35 bp, Artificial Sequence
  Synthetic oligonucleotide
gttggtccaccctttgcatacgttgtcgtcgccta

SEQ ID NO: 196388 - DNA, 35 bp, Artificial Sequence
  Synthetic oligonucleotide
gcgacacgtccacttccatttgccctacttcgcta

SEQ ID NO: 196389 - DNA, 36 bp, Artificial Sequence
  Synthetic oligonucleotide
gtcgttcgctgctgccacgcgactattttccctcta

SEQ ID NO: 196390 - DNA, 35 bp, Artificial Sequence
  Synthetic oligonucleotide
aaacgcactcctctgctaacgtctaatctgctcta

SEQ ID NO: 196391 - DNA, 36 bp, Artificial Sequence
  Synthetic oligonucleotide
tcaccgtcccagccgtctcccttacattccatagta

SEQ ID NO: 196392 - DNA, 36 bp, Artificial Sequence
  Synthetic oligonucleotide
tcaccctctcctcatctgagcttgacagtgtcctta

SEQ ID NO: 196393 - DNA, 36 bp, Artificial Sequence
  Synthetic oligonucleotide
ttgtccagccactcattacttatatcaccgtgctta

SEQ ID NO: 196394 - DNA, 36 bp, Artificial Sequence
  Synthetic oligonucleotide
gctcccgccaatccacgtacatccggtcacaggtta

SEQ ID NO: 196395 - DNA, 36 bp, Artificial Sequence
  Synthetic oligonucleotide
aaacgggccgggaggggagggtaatattgtatgtta

SEQ ID NO: 196396 - DNA, 35 bp, Artificial Sequence
  Synthetic oligonucleotide
agtctccctgccgttactggccatctggataccac

SEQ ID NO: 196397 - DNA, 36 bp, Artificial Sequence
  Synthetic oligonucleotide
atggccggcatcaaggttgtcttcacccatgcccac

SEQ ID NO: 196398 - DNA, 35 bp, Artificial Sequence
  Synthetic oligonucleotide
tgttacgccaatgagctcctttctttccgtcccac

SEQ ID NO: 196399 - DNA, 34 bp, Artificial Sequence
  Synthetic oligonucleotide
tgcacaaccgcttccaatgctttaccggctccac

SEQ ID NO: 196400 - DNA, 35 bp, Artificial Sequence
  Synthetic oligonucleotide
gggagggtgggagggtactcattgctccgggggac

SEQ ID NO: 196401 - DNA, 35 bp, Artificial Sequence
  Synthetic oligonucleotide
tacgcgcatcgtagaacctggactaccgcccctac

SEQ ID NO: 196402 - DNA, 35 bp, Artificial Sequence
  Synthetic oligonucleotide
tacaccttctgttagccactatcacccaacggtac

SEQ ID NO: 196403 - DNA, 34 bp, Artificial Sequence
  Synthetic oligonucleotide
acacacgccctacctatgttggctgacaaccacc

SEQ ID NO: 196404 - DNA, 35 bp, Artificial Sequence
  Synthetic oligonucleotide
tgcacgttcacatcgcgcccagagttccacctacc

SEQ ID NO: 196405 - DNA, 26 bp, Artificial Sequence
  Synthetic oligonucleotide
gattgcccggtcctcgcatgcttacc

SEQ ID NO: 196406 - DNA, 35 bp, Artificial Sequence
  Synthetic oligonucleotide
tcctacccgaccgcatctgataggcgtgtctcccc

SEQ ID NO: 196407 - DNA, 35 bp, Artificial Sequence
  Synthetic oligonucleotide
tagactggtcactgtcgcaattatacttcgtcccc

SEQ ID NO: 196408 - DNA, 35 bp, Artificial Sequence
  Synthetic oligonucleotide
tacctcaccgtgtcctcgctgactttcaaaggccc

SEQ ID NO: 196409 - DNA, 35 bp, Artificial Sequence
  Synthetic oligonucleotide
ggtacccgccgaagtcgtcccttctcccacctccc

SEQ ID NO: 196410 - DNA, 35 bp, Artificial Sequence
  Synthetic oligonucleotide
gaccagccgtttggcgactgcgccttctatctccc

SEQ ID NO: 196411 - DNA, 35 bp, Artificial Sequence
  Synthetic oligonucleotide
tcaatcacgtgtaaatgcttcccttgccgtacgcc

SEQ ID NO: 196412 - DNA, 35 bp, Artificial Sequence
  Synthetic oligonucleotide
gtagcacatctcattggattctacctgtcactgcc

SEQ ID NO: 196413 - DNA, 35 bp, Artificial Sequence
  Synthetic oligonucleotide
tcccgcccctgttgttgcctcacgatcggtcatcc

SEQ ID NO: 196414 - DNA, 35 bp, Artificial Sequence
  Synthetic oligonucleotide
tcagcatgccgcaaaccaatcctgacccgtgatcc

SEQ ID NO: 196415 - DNA, 35 bp, Artificial Sequence
  Synthetic oligonucleotide
tcccgcatcggtggtaccttgatccctgcacctcc

SEQ ID NO: 196416 - DNA, 35 bp, Artificial Sequence
  Synthetic oligonucleotide
gacgaccgccctccatagttttgttgtcgctgtcc

SEQ ID NO: 196417 - DNA, 35 bp, Artificial Sequence
  Synthetic oligonucleotide
gacagatcactacacgtaccatcatcttattgtcc

SEQ ID NO: 196418 - DNA, 35 bp, Artificial Sequence
  Synthetic oligonucleotide
atcacgcatccttccagtcttattgtaccgcttcc

SEQ ID NO: 196419 - DNA, 35 bp, Artificial Sequence
  Synthetic oligonucleotide
actcctacgcactccatgcctcattgacgcgaagc

SEQ ID NO: 196420 - DNA, 34 bp, Artificial Sequence
  Synthetic oligonucleotide
tcgagaagtagcgcgttttatgctccccccccgc

SEQ ID NO: 196421 - DNA, 35 bp, Artificial Sequence
  Synthetic oligonucleotide
aagccagggggagatcggtaggagggttgggaggc

SEQ ID NO: 196422 - DNA, 35 bp, Artificial Sequence
  Synthetic oligonucleotide
atccctgctccctcagccttgcctacgagtttggc

SEQ ID NO: 196423 - DNA, 35 bp, Artificial Sequence
  Synthetic oligonucleotide
tgtgtgctacatagcttccagagcgccgcccctgc

SEQ ID NO: 196424 - DNA, 35 bp, Artificial Sequence
  Synthetic oligonucleotide
gcccgactctgcctgcctggctatatatacacatc

SEQ ID NO: 196425 - DNA, 35 bp, Artificial Sequence
  Synthetic oligonucleotide
tgacttgtagccgcatatcgggccagcatcccctc

SEQ ID NO: 196426 - DNA, 35 bp, Artificial Sequence
  Synthetic oligonucleotide
atctcaacattcggctactacatgcctggttcctc

SEQ ID NO: 196427 - DNA, 35 bp, Artificial Sequence
  Synthetic oligonucleotide
tgccaccgccccaagggttgacgccgttttatctc

SEQ ID NO: 196428 - DNA, 35 bp, Artificial Sequence
  Synthetic oligonucleotide
gcctgtgtctatgctcgtacgttcttctatctgtc

SEQ ID NO: 196429 - DNA, 35 bp, Artificial Sequence
  Synthetic oligonucleotide
acaacgcgcatgtgggttccgccgccgcctaattc

SEQ ID NO: 196430 - DNA, 34 bp, Artificial Sequence
  Synthetic oligonucleotide
ttcaccgctgctccccgtcgtccctgtggccttc

SEQ ID NO: 196431 - DNA, 35 bp, Artificial Sequence
  Synthetic oligonucleotide
acaccgcccccggcatgccaaatatggccgtgttc

SEQ ID NO: 196432 - DNA, 35 bp, Artificial Sequence
  Synthetic oligonucleotide
tcaccaccggcctattacggacttttcgtcctttc

SEQ ID NO: 196433 - DNA, 36 bp, Artificial Sequence
  Synthetic oligonucleotide
gaaggagtggaggagtagaacgcacgcggtacaaag

SEQ ID NO: 196434 - DNA, 35 bp, Artificial Sequence
  Synthetic oligonucleotide
gacgaacaaggggggaaggggggcggagacgagag

SEQ ID NO: 196435 - DNA, 35 bp, Artificial Sequence
  Synthetic oligonucleotide
ggggatgcaggcgcacgagacggaaggaggtggag

SEQ ID NO: 196436 - DNA, 34 bp, Artificial Sequence
  Synthetic oligonucleotide
tctccacccacttctttgtatagcgcccgcatag

SEQ ID NO: 196437 - DNA, 35 bp, Artificial Sequence
  Synthetic oligonucleotide
tctgagggggggaagttggggcacggtacagttag

SEQ ID NO: 196438 - DNA, 35 bp, Artificial Sequence
  Synthetic oligonucleotide
ttccgcggccgccctgtcccctcgtacctttgccg

SEQ ID NO: 196439 - DNA, 35 bp, Artificial Sequence
  Synthetic oligonucleotide
atggtcctcgtgcgcgttccttgtcttcaactccg

SEQ ID NO: 196440 - DNA, 35 bp, Artificial Sequence
  Synthetic oligonucleotide
gtgccctcccactccatctttagcagcccaacgcg

SEQ ID NO: 196441 - DNA, 35 bp, Artificial Sequence
  Synthetic oligonucleotide
gcagtcccctgtcccctcaaaatgtcatcgtgtcg

SEQ ID NO: 196442 - DNA, 35 bp, Artificial Sequence
  Synthetic oligonucleotide
atgtaggagggtggcgggcgggaaagatgcacagg

SEQ ID NO: 196443 - DNA, 35 bp, Artificial Sequence
  Synthetic oligonucleotide
ttgagaccatgggggcacgagaagggtgaaggagg

SEQ ID NO: 196444 - DNA, 35 bp, Artificial Sequence
  Synthetic oligonucleotide
acataccaactatgcctccatgacaccccgaccgg

SEQ ID NO: 196445 - DNA, 35 bp, Artificial Sequence
  Synthetic oligonucleotide
aagcagggggaaagaatatggggcataacgggcgg

SEQ ID NO: 196446 - DNA, 35 bp, Artificial Sequence
  Synthetic oligonucleotide
gcacccctgcacccgccagacgctatccacatggg

SEQ ID NO: 196447 - DNA, 35 bp, Artificial Sequence
  Synthetic oligonucleotide
atgcccgcagaccgttttttgtcacctccccaatg

SEQ ID NO: 196448 - DNA, 35 bp, Artificial Sequence
  Synthetic oligonucleotide
acgatgggagggtagttggggatagaagttggctg

SEQ ID NO: 196449 - DNA, 35 bp, Artificial Sequence
  Synthetic oligonucleotide
tgccactccccacctttgtaacagccgcccctctg

SEQ ID NO: 196450 - DNA, 34 bp, Artificial Sequence
  Synthetic oligonucleotide
gtcaaggggcgttacatgggaggggcgcagggtg

SEQ ID NO: 196451 - DNA, 35 bp, Artificial Sequence
  Synthetic oligonucleotide
gaccacgcccgttacgcccatttttcattactgtg

SEQ ID NO: 196452 - DNA, 35 bp, Artificial Sequence
  Synthetic oligonucleotide
agagaggggggaggcacaaggggaccatctagttg

SEQ ID NO: 196453 - DNA, 36 bp, Artificial Sequence
  Synthetic oligonucleotide
gcgaggtgctgggagggtctagggcgggccatgtat

SEQ ID NO: 196454 - DNA, 35 bp, Artificial Sequence
  Synthetic oligonucleotide
tgatcccgccaatgctttacactcattgttacact

SEQ ID NO: 196455 - DNA, 35 bp, Artificial Sequence
  Synthetic oligonucleotide
tatcgccgcagtaagtgtcgtgatcctttcgccct

SEQ ID NO: 196456 - DNA, 35 bp, Artificial Sequence
  Synthetic oligonucleotide
tgttctctgcctaacgtgctcgttcataactccct

SEQ ID NO: 196457 - DNA, 35 bp, Artificial Sequence
  Synthetic oligonucleotide
gacgcccgcgcgtcgacttgcaacacatcgatcct

SEQ ID NO: 196458 - DNA, 35 bp, Artificial Sequence
  Synthetic oligonucleotide
tcacctcacgtctccggtctttgcgactctctgct

SEQ ID NO: 196459 - DNA, 35 bp, Artificial Sequence
  Synthetic oligonucleotide
acttgcccttcccgttaagcactcggatacactct

SEQ ID NO: 196460 - DNA, 35 bp, Artificial Sequence
  Synthetic oligonucleotide
ttgacgcagacatctcgcttttactcggactttct

SEQ ID NO: 196461 - DNA, 35 bp, Artificial Sequence
  Synthetic oligonucleotide
gtcccgccttccctgttgctctaacgtccgctggt

SEQ ID NO: 196462 - DNA, 35 bp, Artificial Sequence
  Synthetic oligonucleotide
atcccgtcctgctgtctaactcaatgcgcgctggt

SEQ ID NO: 196463 - DNA, 35 bp, Artificial Sequence
  Synthetic oligonucleotide
gtgcgcccctgcatgctgttattccccgtcactgt

SEQ ID NO: 196464 - DNA, 35 bp, Artificial Sequence
  Synthetic oligonucleotide
gccacgccgccacccgcatccgtcccgtacggtgt

SEQ ID NO: 196465 - DNA, 35 bp, Artificial Sequence
  Synthetic oligonucleotide
acccgccgaatggtgttgcatgcgactcgccactt

SEQ ID NO: 196466 - DNA, 35 bp, Artificial Sequence
  Synthetic oligonucleotide
tctcactcgttctctcgagtgctatacctactctt

SEQ ID NO: 196467 - DNA, 35 bp, Artificial Sequence
  Synthetic oligonucleotide
acccgccccctgccctgtgtgattttacttgtctt

SEQ ID NO: 196468 - DNA, 35 bp, Artificial Sequence
  Synthetic oligonucleotide
ttcacactcctacctgctgtactagcctgcctttt

SEQ ID NO: 196469 - DNA, 36 bp, Artificial Sequence
  Synthetic oligonucleotide
gataacaaaggaggtgggtccagggaatgacggaaa

SEQ ID NO: 196470 - DNA, 35 bp, Artificial Sequence
  Synthetic oligonucleotide
tcaggccttctcacccgtgctactacgtaacccaa

SEQ ID NO: 196471 - DNA, 35 bp, Artificial Sequence
  Synthetic oligonucleotide
accccgcccatcgcgttttaccctgcattagcgaa

SEQ ID NO: 196472 - DNA, 36 bp, Artificial Sequence
  Synthetic oligonucleotide
tgccccgactcgttttctttcatcaccagtggctaa

SEQ ID NO: 196473 - DNA, 35 bp, Artificial Sequence
  Synthetic oligonucleotide
gccagcccgacgcttctccagttctccgctcaaca

SEQ ID NO: 196474 - DNA, 36 bp, Artificial Sequence
  Synthetic oligonucleotide
tacccgacctcatactgcttcgctgacttccgccca

SEQ ID NO: 196475 - DNA, 36 bp, Artificial Sequence
  Synthetic oligonucleotide
aagaggagggggttagcatgagagggagtagggcca

SEQ ID NO: 196476 - DNA, 36 bp, Artificial Sequence
  Synthetic oligonucleotide
gcccgcagaaacttccggtctgacccgttcactcca

SEQ ID NO: 196477 - DNA, 36 bp, Artificial Sequence
  Synthetic oligonucleotide
acgatatgacgtccccctgcctctgtccacgctcca

SEQ ID NO: 196478 - DNA, 36 bp, Artificial Sequence
  Synthetic oligonucleotide
ccccccctccgcaacccgccgcaccattgtggtcca

SEQ ID NO: 196479 - DNA, 36 bp, Artificial Sequence
  Synthetic oligonucleotide
actcgcccccttcacctaagcaggctcattggagca

SEQ ID NO: 196480 - DNA, 36 bp, Artificial Sequence
  Synthetic oligonucleotide
gagctatgcggcatgtcttttattccccgtcccgca

SEQ ID NO: 196481 - DNA, 36 bp, Artificial Sequence
  Synthetic oligonucleotide
tcaatgcaacgggcgctaatgggggtggaaggggca

SEQ ID NO: 196482 - DNA, 36 bp, Artificial Sequence
  Synthetic oligonucleotide
ttcagtagcgccctctccatccgggaccacgctgca

SEQ ID NO: 196483 - DNA, 36 bp, Artificial Sequence
  Synthetic oligonucleotide
tcagctcctgctccatatcctgtacatcctgtatca

SEQ ID NO: 196484 - DNA, 36 bp, Artificial Sequence
  Synthetic oligonucleotide
atggtccgccgcgcgaaagttcctcgtcgttcctca

SEQ ID NO: 196485 - DNA, 36 bp, Artificial Sequence
  Synthetic oligonucleotide
acgacggtgcccaatcatcatgctgtcgctttctca

SEQ ID NO: 196486 - DNA, 36 bp, Artificial Sequence
  Synthetic oligonucleotide
tgtgcccgtaggttcggtaatttgcccactccttca

SEQ ID NO: 196487 - DNA, 36 bp, Artificial Sequence
  Synthetic oligonucleotide
ttcgcccttcctctcattcgttatgccctcgtttca

SEQ ID NO: 196488 - DNA, 35 bp, Artificial Sequence
  Synthetic oligonucleotide
tgggcggaggaggggtggcctaaagtggtggaaga

SEQ ID NO: 196489 - DNA, 37 bp, Artificial Sequence
  Synthetic oligonucleotide
atgggagagcaactgggggagtaattgcaggaggaga

SEQ ID NO: 196490 - DNA, 37 bp, Artificial Sequence
  Synthetic oligonucleotide
ttggtacctaccatgcggtctcacatccatccttcga

SEQ ID NO: 196491 - DNA, 37 bp, Artificial Sequence
  Synthetic oligonucleotide
gaggggccggcggggtggagaggcggagaactcagga

SEQ ID NO: 196492 - DNA, 37 bp, Artificial Sequence
  Synthetic oligonucleotide
ttgagacagacgaaggaagggagcttaacaggaggga

SEQ ID NO: 196493 - DNA, 36 bp, Artificial Sequence
  Synthetic oligonucleotide
atatgtgtgggggagggcggtgaaaagggaacggga

SEQ ID NO: 196494 - DNA, 37 bp, Artificial Sequence
  Synthetic oligonucleotide
tgtgggcgacatataaacgggagggccctttgcggga

SEQ ID NO: 196495 - DNA, 37 bp, Artificial Sequence
  Synthetic oligonucleotide
aagtggggggatcatgaaggtggagcaaagaagggga

SEQ ID NO: 196496 - DNA, 37 bp, Artificial Sequence
  Synthetic oligonucleotide
atgctgggtgggctgagggaagggtcgtggcttggga

SEQ ID NO: 196497 - DNA, 37 bp, Artificial Sequence
  Synthetic oligonucleotide
gagggtagggtagggaagggtgattggagaagctgga

SEQ ID NO: 196498 - DNA, 37 bp, Artificial Sequence
  Synthetic oligonucleotide
gaccccacagggagttaattatctacacccatctgga

SEQ ID NO: 196499 - DNA, 38 bp, Artificial Sequence
  Synthetic oligonucleotide
gactcaccgcttcattcttcatcgcacagtcatcatga

SEQ ID NO: 196500 - DNA, 38 bp, Artificial Sequence
  Synthetic oligonucleotide
gactgggtacacctgcctgagctcgccttcttacctga

SEQ ID NO: 196501 - DNA, 38 bp, Artificial Sequence
  Synthetic oligonucleotide
accacccctcttggctatacgcaactacaacatcctga

SEQ ID NO: 196502 - DNA, 37 bp, Artificial Sequence
  Synthetic oligonucleotide
acccaactgcccatccgtatacgctgctggttcctga

SEQ ID NO: 196503 - DNA, 37 bp, Artificial Sequence
  Synthetic oligonucleotide
taatccgcccctcgatctgttttgcaccactggctga

SEQ ID NO: 196504 - DNA, 38 bp, Artificial Sequence
  Synthetic oligonucleotide
ggaaacatggagaggaggatcgggggaggccgaagtga

SEQ ID NO: 196505 - DNA, 37 bp, Artificial Sequence
  Synthetic oligonucleotide
acgaaaaggaaggaagggggataaagtgtgtgagtga

SEQ ID NO: 196506 - DNA, 38 bp, Artificial Sequence
  Synthetic oligonucleotide
gcacactgccttccgtatcactacccgtcgcatcgtga

SEQ ID NO: 196507 - DNA, 38 bp, Artificial Sequence
  Synthetic oligonucleotide
gatctgaggcgaggtgaaggggggcgggctaagggtga

SEQ ID NO: 196508 - DNA, 37 bp, Artificial Sequence
  Synthetic oligonucleotide
tgcggaagaaaagaagtggggggggcaggggtattga

SEQ ID NO: 196509 - DNA, 37 bp, Artificial Sequence
  Synthetic oligonucleotide
gtggacacccccgcgtgtgtacttgcaccccacttga

SEQ ID NO: 196510 - DNA, 38 bp, Artificial Sequence
  Synthetic oligonucleotide
tgacaggtatcctcatgtctactccacactcttcttga

SEQ ID NO: 196511 - DNA, 37 bp, Artificial Sequence
  Synthetic oligonucleotide
aagcgcatacccgtcccttgcatatccgttcctttga

SEQ ID NO: 196512 - DNA, 36 bp, Artificial Sequence
  Synthetic oligonucleotide
ttaccacgctccttctcccgacccgctcatgtttga

SEQ ID NO: 196513 - DNA, 36 bp, Artificial Sequence
  Synthetic oligonucleotide
acaccatcctctgttcttctaggccattgtaaaata

SEQ ID NO: 196514 - DNA, 36 bp, Artificial Sequence
  Synthetic oligonucleotide
gcccgcctgagcttccctgagccagctccccaccta

SEQ ID NO: 196515 - DNA, 36 bp, Artificial Sequence
  Synthetic oligonucleotide
ttgagcgtcaatcgctactgccccgccttgatcgta

SEQ ID NO: 196516 - DNA, 35 bp, Artificial Sequence
  Synthetic oligonucleotide
tctcagtcctccttggtgttccccttgcctgtgta

SEQ ID NO: 196517 - DNA, 35 bp, Artificial Sequence
  Synthetic oligonucleotide
gtggacgccgctcgatccaaggtccctcttactta

SEQ ID NO: 196518 - DNA, 35 bp, Artificial Sequence
  Synthetic oligonucleotide
taacgcacccgatccacatcctgcctattgggaac

SEQ ID NO: 196519 - DNA, 34 bp, Artificial Sequence
  Synthetic oligonucleotide
tgacgcgccacatacgccaccactcttgtgtaac

SEQ ID NO: 196520 - DNA, 35 bp, Artificial Sequence
  Synthetic oligonucleotide
accaggaccgtcacaccactccccggacacctgac

SEQ ID NO: 196521 - DNA, 35 bp, Artificial Sequence
  Synthetic oligonucleotide
gaccactgcaatatgttttgcgcttgcattattac

SEQ ID NO: 196522 - DNA, 35 bp, Artificial Sequence
  Synthetic oligonucleotide
tccaccaaccgttctatcgatctacgctttagacc

SEQ ID NO: 196523 - DNA, 35 bp, Artificial Sequence
  Synthetic oligonucleotide
tctcctacctcagctactgctggaccccgcttacc

SEQ ID NO: 196524 - DNA, 35 bp, Artificial Sequence
  Synthetic oligonucleotide
gtacgcctgcccgaccgccctgtatctcaccgccc

SEQ ID NO: 196525 - DNA, 27 bp, Artificial Sequence
  Synthetic oligonucleotide
caatcaccgcctcccactccctcgccc

SEQ ID NO: 196526 - DNA, 35 bp, Artificial Sequence
  Synthetic oligonucleotide
ggaccgccacatgctgccacagcactcgaattccc

SEQ ID NO: 196527 - DNA, 35 bp, Artificial Sequence
  Synthetic oligonucleotide
tacgcgccagctattataacggtccaccatttccc

SEQ ID NO: 196528 - DNA, 35 bp, Artificial Sequence
  Synthetic oligonucleotide
tcacaccgaacgattgacatcaatattccgccgcc

SEQ ID NO: 196529 - DNA, 35 bp, Artificial Sequence
  Synthetic oligonucleotide
tggttatgcctgccgcaccgtgacgttcattcgcc

SEQ ID NO: 196530 - DNA, 35 bp, Artificial Sequence
  Synthetic oligonucleotide
tcacgcaggtcttccagttatcctccgtctgggcc

SEQ ID NO: 196531 - DNA, 35 bp, Artificial Sequence
  Synthetic oligonucleotide
tcgctgactccgcatgtctacggctcctgatctcc

SEQ ID NO: 196532 - DNA, 35 bp, Artificial Sequence
  Synthetic oligonucleotide
gtcatggggtgtctctgtgccgatccctcttctcc

SEQ ID NO: 196533 - DNA, 35 bp, Artificial Sequence
  Synthetic oligonucleotide
tcctactgctcactgaccgtctcagaacctagtcc

SEQ ID NO: 196534 - DNA, 35 bp, Artificial Sequence
  Synthetic oligonucleotide
tccacaagcccctcctctgtaaggtgaaccattcc

SEQ ID NO: 196535 - DNA, 35 bp, Artificial Sequence
  Synthetic oligonucleotide
tcacgcgcaccccatctagggtaaatcgttcttcc

SEQ ID NO: 196536 - DNA, 35 bp, Artificial Sequence
  Synthetic oligonucleotide
ttaggccgtctgacttcttttatccgcctgcacgc

SEQ ID NO: 196537 - DNA, 35 bp, Artificial Sequence
  Synthetic oligonucleotide
tcaccgcccactccgctcgactatatcaacaccgc

SEQ ID NO: 196538 - DNA, 35 bp, Artificial Sequence
  Synthetic oligonucleotide
gtgccgtatgctatgtctctagtttccccgctcgc

SEQ ID NO: 196539 - DNA, 35 bp, Artificial Sequence
  Synthetic oligonucleotide
aacatccactctaactgtctttccaggacctaggc

SEQ ID NO: 196540 - DNA, 35 bp, Artificial Sequence
  Synthetic oligonucleotide
gtgccgctgctaccctatcgcgttctcatctgggc

SEQ ID NO: 196541 - DNA, 35 bp, Artificial Sequence
  Synthetic oligonucleotide
tttggctccacacacagtcatctgcactctctggc

SEQ ID NO: 196542 - DNA, 34 bp, Artificial Sequence
  Synthetic oligonucleotide
tatcccgcccccgcattttttagcaagactctgc

SEQ ID NO: 196543 - DNA, 35 bp, Artificial Sequence
  Synthetic oligonucleotide
ttacgctgcctccacgcgactgcacttttgccatc

SEQ ID NO: 196544 - DNA, 35 bp, Artificial Sequence
  Synthetic oligonucleotide
tgaatgcatccatttacatccgtgacctggccctc

SEQ ID NO: 196545 - DNA, 35 bp, Artificial Sequence
  Synthetic oligonucleotide
gtggtgcgttgggtgcgatcttgcttccactcctc

SEQ ID NO: 196546 - DNA, 36 bp, Artificial Sequence
  Synthetic oligonucleotide
gactcgcccctggtctcgtcatatatgactgtcctc

SEQ ID NO: 196547 - DNA, 35 bp, Artificial Sequence
  Synthetic oligonucleotide
tccgtccagccccatcatcggtactatcagcagtc

SEQ ID NO: 196548 - DNA, 34 bp, Artificial Sequence
  Synthetic oligonucleotide
tacgcggagcctgctctaatcgaaatacctggtc

SEQ ID NO: 196549 - DNA, 35 bp, Artificial Sequence
  Synthetic oligonucleotide
tcgaccccctgtcttttcgtcctcaacgtgccttc

SEQ ID NO: 196550 - DNA, 35 bp, Artificial Sequence
  Synthetic oligonucleotide
gaccaccccatgttcgctgtagccctccttggttc

SEQ ID NO: 196551 - DNA, 35 bp, Artificial Sequence
  Synthetic oligonucleotide
tcctgatcccccctcgccgaccaactcgaacagag

SEQ ID NO: 196552 - DNA, 35 bp, Artificial Sequence
  Synthetic oligonucleotide
gctgaaaagggtggagaggccgtgggtccggagag

SEQ ID NO: 196553 - DNA, 35 bp, Artificial Sequence
  Synthetic oligonucleotide
gtcgaacaacagtcgggagggattaggagggaacg

SEQ ID NO: 196554 - DNA, 35 bp, Artificial Sequence
  Synthetic oligonucleotide
gtcccaccccgccgaggctatattctagacctacg

SEQ ID NO: 196555 - DNA, 35 bp, Artificial Sequence
  Synthetic oligonucleotide
gatgggcggtggtgagaatgcgggcgggcgttacg

SEQ ID NO: 196556 - DNA, 35 bp, Artificial Sequence
  Synthetic oligonucleotide
actgatgcgtaccatttttgccatcctcagccccg

SEQ ID NO: 196557 - DNA, 35 bp, Artificial Sequence
  Synthetic oligonucleotide
aggtgcaccgccagtacctcgcctttcactcctcg

SEQ ID NO: 196558 - DNA, 35 bp, Artificial Sequence
  Synthetic oligonucleotide
tcctcctgttccagactctccctgctcctccaggg

SEQ ID NO: 196559 - DNA, 35 bp, Artificial Sequence
  Synthetic oligonucleotide
gatgcgggtgtctaaatgagcaggggcgggggggg

SEQ ID NO: 196560 - DNA, 35 bp, Artificial Sequence
  Synthetic oligonucleotide
gccacccatctcgtttgaaaccgctagccttgggg

SEQ ID NO: 196561 - DNA, 35 bp, Artificial Sequence
  Synthetic oligonucleotide
tcacatggtggacaggggtgggatctgggggttgg

SEQ ID NO: 196562 - DNA, 35 bp, Artificial Sequence
  Synthetic oligonucleotide
attcaccgtacctccgtcttacaagtcctcctctg

SEQ ID NO: 196563 - DNA, 35 bp, Artificial Sequence
  Synthetic oligonucleotide
agcactccaccgcaccatcttacagacttcctctg

SEQ ID NO: 196564 - DNA, 35 bp, Artificial Sequence
  Synthetic oligonucleotide
gcttgcgcctaccgtcaatccgcccccatgttctg

SEQ ID NO: 196565 - DNA, 36 bp, Artificial Sequence
  Synthetic oligonucleotide
agcaacacgcctccacccgcacgtctccccgcagtg

SEQ ID NO: 196566 - DNA, 35 bp, Artificial Sequence
  Synthetic oligonucleotide
aatgcgaagacgggtgggagggctaaagtgtagtg

SEQ ID NO: 196567 - DNA, 35 bp, Artificial Sequence
  Synthetic oligonucleotide
taagacaagagggcagagagtgaaaacggggtcat

SEQ ID NO: 196568 - DNA, 35 bp, Artificial Sequence
  Synthetic oligonucleotide
tagtttcgcctccgtacggactgtagtccttccct

SEQ ID NO: 196569 - DNA, 35 bp, Artificial Sequence
  Synthetic oligonucleotide
gtcaaccttcatgtccgcgatcctaagctactcct

SEQ ID NO: 196570 - DNA, 35 bp, Artificial Sequence
  Synthetic oligonucleotide
gtcggtcaggccgctgtcccctccccggagttcct

SEQ ID NO: 196571 - DNA, 35 bp, Artificial Sequence
  Synthetic oligonucleotide
tcccaccttcatagtgtctttttccatcgatggct

SEQ ID NO: 196572 - DNA, 35 bp, Artificial Sequence
  Synthetic oligonucleotide
gaagcgaagacctccagccgccaccccgcacatct

SEQ ID NO: 196573 - DNA, 35 bp, Artificial Sequence
  Synthetic oligonucleotide
tttcccgcacaggcgcatcgagactcctgccctct

SEQ ID NO: 196574 - DNA, 35 bp, Artificial Sequence
  Synthetic oligonucleotide
tactcaatcgccccgctttaaagttgacgttctct

SEQ ID NO: 196575 - DNA, 34 bp, Artificial Sequence
  Synthetic oligonucleotide
acccccgtagctcctggttcgccccccaaaaagt

SEQ ID NO: 196576 - DNA, 35 bp, Artificial Sequence
  Synthetic oligonucleotide
accgtctcgttccatctgataatgtgcgtttcatt

SEQ ID NO: 196577 - DNA, 35 bp, Artificial Sequence
  Synthetic oligonucleotide
accacggtgattgtctctgcgattccttttccctt

SEQ ID NO: 196578 - DNA, 35 bp, Artificial Sequence
  Synthetic oligonucleotide
tgtaaccctctcgctgttgttcgttcggattcctt

SEQ ID NO: 196579 - DNA, 35 bp, Artificial Sequence
  Synthetic oligonucleotide
tccccctgatcatgcatcgagctccctttactttt

SEQ ID NO: 196580 - DNA, 36 bp, Artificial Sequence
  Synthetic oligonucleotide
gagtcgccgccctgttccccggtgcttctgtaaaaa

SEQ ID NO: 196581 - DNA, 36 bp, Artificial Sequence
  Synthetic oligonucleotide
acatcacgcccatatctctccgtgtaatgtacaaaa

SEQ ID NO: 196582 - DNA, 36 bp, Artificial Sequence
  Synthetic oligonucleotide
accatgcctcggcctccaagtgcacctgcctttaaa

SEQ ID NO: 196583 - DNA, 36 bp, Artificial Sequence
  Synthetic oligonucleotide
tgacagtgctggtcctcgttcaatcgccgcatacaa

SEQ ID NO: 196584 - DNA, 36 bp, Artificial Sequence
  Synthetic oligonucleotide
tcccgcccttgcctgtgttttgtatacctgccgcaa

SEQ ID NO: 196585 - DNA, 36 bp, Artificial Sequence
  Synthetic oligonucleotide
gacgtcacctccggccttgctttcaagtcactcgaa

SEQ ID NO: 196586 - DNA, 35 bp, Artificial Sequence
  Synthetic oligonucleotide
atggtggagggggagggaggtacgggctagagaca

SEQ ID NO: 196587 - DNA, 36 bp, Artificial Sequence
  Synthetic oligonucleotide
accacaccaggtcttctctgtcatttggtctttaca

SEQ ID NO: 196588 - DNA, 35 bp, Artificial Sequence
  Synthetic oligonucleotide
gcgcccccgcctcgtgtgcataacttcgctcccca

SEQ ID NO: 196589 - DNA, 36 bp, Artificial Sequence
  Synthetic oligonucleotide
atcatgccctttgctcactaagacgtatccctgcca

SEQ ID NO: 196590 - DNA, 35 bp, Artificial Sequence
  Synthetic oligonucleotide
ttgagtcgcgtatgtcctacatttgcctccttcca

SEQ ID NO: 196591 - DNA, 35 bp, Artificial Sequence
  Synthetic oligonucleotide
gctgccctcctgttctctgttccgcgcccccagca

SEQ ID NO: 196592 - DNA, 36 bp, Artificial Sequence
  Synthetic oligonucleotide
attgggagggggggatgtgggtgcgttgtttgagca

SEQ ID NO: 196593 - DNA, 36 bp, Artificial Sequence
  Synthetic oligonucleotide
atgcgccctacgcgtatcattaacatttcccttgca

SEQ ID NO: 196594 - DNA, 36 bp, Artificial Sequence
  Synthetic oligonucleotide
acctccatgcgctggcatgcatgaatcacccgttca

SEQ ID NO: 196595 - DNA, 37 bp, Artificial Sequence
  Synthetic oligonucleotide
gggtggggaggataaagcaagcagaagggcagaaaga

SEQ ID NO: 196596 - DNA, 37 bp, Artificial Sequence
  Synthetic oligonucleotide
gtgagggcgggtgggatgcgcaataggtgggcgaaga

SEQ ID NO: 196597 - DNA, 36 bp, Artificial Sequence
  Synthetic oligonucleotide
ggagcaacctcttctgctatgacccttcccctaaga

SEQ ID NO: 196598 - DNA, 36 bp, Artificial Sequence
  Synthetic oligonucleotide
attgggatggaggaggggaaaacgggcacagccaga

SEQ ID NO: 196599 - DNA, 37 bp, Artificial Sequence
  Synthetic oligonucleotide
aatgggaggggcggtatagcacgggccgggacgcaga

SEQ ID NO: 196600 - DNA, 37 bp, Artificial Sequence
  Synthetic oligonucleotide
gccttcgtacgcgtacctccgcccgccctgcttacga

SEQ ID NO: 196601 - DNA, 37 bp, Artificial Sequence
  Synthetic oligonucleotide
ttgacagcgccaaacttcgctttcacgacctccccga

SEQ ID NO: 196602 - DNA, 36 bp, Artificial Sequence
  Synthetic oligonucleotide
gttatcccgctcccgtcttaggtcacgtacttccga

SEQ ID NO: 196603 - DNA, 37 bp, Artificial Sequence
  Synthetic oligonucleotide
ttgagcggagccctgttcccctacccgtcccagtcga

SEQ ID NO: 196604 - DNA, 37 bp, Artificial Sequence
  Synthetic oligonucleotide
tcgcacgtcacactcgttcattgataccactcgtcga

SEQ ID NO: 196605 - DNA, 37 bp, Artificial Sequence
  Synthetic oligonucleotide
agtgatggtgagacggacggacgaagagggacgagga

SEQ ID NO: 196606 - DNA, 37 bp, Artificial Sequence
  Synthetic oligonucleotide
agtgagcatgggggggagagcaggtcaggagagcgga

SEQ ID NO: 196607 - DNA, 35 bp, Artificial Sequence
  Synthetic oligonucleotide
gtaggatgaaacggggcagaagtgatagtgtggga

SEQ ID NO: 196608 - DNA, 38 bp, Artificial Sequence
  Synthetic oligonucleotide
agaatcgcaggatggggggcgggggagaaggtcaatga

SEQ ID NO: 196609 - DNA, 37 bp, Artificial Sequence
  Synthetic oligonucleotide
aggaaaggacgggggggattaggaagcactggaatga

SEQ ID NO: 196610 - DNA, 37 bp, Artificial Sequence
  Synthetic oligonucleotide
gcatcatcagtgggaagggaggcgggggttgtaatga

SEQ ID NO: 196611 - DNA, 38 bp, Artificial Sequence
  Synthetic oligonucleotide
tgtccacctacaccctgttcagcatcatacacatatga

SEQ ID NO: 196612 - DNA, 38 bp, Artificial Sequence
  Synthetic oligonucleotide
ttggccggtctgttcctatcgtccgttccattctatga

SEQ ID NO: 196613 - DNA, 37 bp, Artificial Sequence
  Synthetic oligonucleotide
acgccccgccccacttgttcaccggtccctgttatga

SEQ ID NO: 196614 - DNA, 38 bp, Artificial Sequence
  Synthetic oligonucleotide
tcccaccccttccttgttgtctgtcactctacgactga

SEQ ID NO: 196615 - DNA, 38 bp, Artificial Sequence
  Synthetic oligonucleotide
ttgagaccgcgccctattctgccacatgccaaccctga

SEQ ID NO: 196616 - DNA, 38 bp, Artificial Sequence
  Synthetic oligonucleotide
acttcctcacacgagttgcgagtggttgtccttcctga

SEQ ID NO: 196617 - DNA, 38 bp, Artificial Sequence
  Synthetic oligonucleotide
ataacgagcggacaaacgagcgggagggtggggagtga

SEQ ID NO: 196618 - DNA, 36 bp, Artificial Sequence
  Synthetic oligonucleotide
gtcaccttcccgccacccctcaacagcgttgagtga

SEQ ID NO: 196619 - DNA, 36 bp, Artificial Sequence
  Synthetic oligonucleotide
ggaccgacggccgctttacgctctatccctctgtga

SEQ ID NO: 196620 - DNA, 36 bp, Artificial Sequence
  Synthetic oligonucleotide
gatacagtgcgctcgggtcggggagggtgggattga

SEQ ID NO: 196621 - DNA, 38 bp, Artificial Sequence
  Synthetic oligonucleotide
acagggtgcggtcacatccctatcacactcccacttga

SEQ ID NO: 196622 - DNA, 38 bp, Artificial Sequence
  Synthetic oligonucleotide
gatccgcctcggacgaggcccttaaaacactctcttga

SEQ ID NO: 196623 - DNA, 37 bp, Artificial Sequence
  Synthetic oligonucleotide
ttagatcgagacaaagagagggggtgggagacgttga

SEQ ID NO: 196624 - DNA, 38 bp, Artificial Sequence
  Synthetic oligonucleotide
acgccgtgcacaccgttctaaccaccagcccatgttga

SEQ ID NO: 196625 - DNA, 38 bp, Artificial Sequence
  Synthetic oligonucleotide
taaatcggagggggggcattgagggcatgcagctttga

SEQ ID NO: 196626 - DNA, 38 bp, Artificial Sequence
  Synthetic oligonucleotide
tcaacccccaagtggcacgtgaccatctttctctttga

SEQ ID NO: 196627 - DNA, 36 bp, Artificial Sequence
  Synthetic oligonucleotide
ggactcccaccgatctgtctttcttttctctagcta

SEQ ID NO: 196628 - DNA, 36 bp, Artificial Sequence
  Synthetic oligonucleotide
gagatggaggtaagggaagaggatccagggggagta

SEQ ID NO: 196629 - DNA, 36 bp, Artificial Sequence
  Synthetic oligonucleotide
accagatggagacgggggtggtatggggctgtggta

SEQ ID NO: 196630 - DNA, 36 bp, Artificial Sequence
  Synthetic oligonucleotide
tgccatcgtccgctgcttccgcccttccaaccatta

SEQ ID NO: 196631 - DNA, 35 bp, Artificial Sequence
  Synthetic oligonucleotide
actggctctgcctcctttgaagtcgctacccgtac

SEQ ID NO: 196632 - DNA, 35 bp, Artificial Sequence
  Synthetic oligonucleotide
atggcgccggtttatgtgcaaaccacgccgccacc

SEQ ID NO: 196633 - DNA, 35 bp, Artificial Sequence
  Synthetic oligonucleotide
gacccgtccgatttgccgtaaggcacgtcaccccc

SEQ ID NO: 196634 - DNA, 35 bp, Artificial Sequence
  Synthetic oligonucleotide
gtgtcacaccgattctaagtaccgcttgccctccc

SEQ ID NO: 196635 - DNA, 35 bp, Artificial Sequence
  Synthetic oligonucleotide
gacctgtcgccctgggatggttgccgatcgctccc

SEQ ID NO: 196636 - DNA, 35 bp, Artificial Sequence
  Synthetic oligonucleotide
tgtggctccggtgccgacgctgaccattgcttccc

SEQ ID NO: 196637 - DNA, 35 bp, Artificial Sequence
  Synthetic oligonucleotide
taacaccgtttgcatcccgattctctcctacggcc

SEQ ID NO: 196638 - DNA, 35 bp, Artificial Sequence
  Synthetic oligonucleotide
tatatccgctgccacccctcggtcgacgcactgcc

SEQ ID NO: 196639 - DNA, 35 bp, Artificial Sequence
  Synthetic oligonucleotide
gctgacccccgccccttgaaataacgtggcttgcc

SEQ ID NO: 196640 - DNA, 35 bp, Artificial Sequence
  Synthetic oligonucleotide
actccagcctgcgcgcgttcgcctactcgggatcc

SEQ ID NO: 196641 - DNA, 35 bp, Artificial Sequence
  Synthetic oligonucleotide
atgccgacgatcaagtcctatccctccgttgctcc

SEQ ID NO: 196642 - DNA, 35 bp, Artificial Sequence
  Synthetic oligonucleotide
taccctgcccctgttcttcgtgaccggcattccgc

SEQ ID NO: 196643 - DNA, 35 bp, Artificial Sequence
  Synthetic oligonucleotide
tagctcgcatcctcgtaacttgaacctgaccgcgc

SEQ ID NO: 196644 - DNA, 35 bp, Artificial Sequence
  Synthetic oligonucleotide
gcttcgcccccatggcttatacttagttcccgcgc

SEQ ID NO: 196645 - DNA, 35 bp, Artificial Sequence
  Synthetic oligonucleotide
agcaaaactaaggctaagggcggggggtggtgggc

SEQ ID NO: 196646 - DNA, 35 bp, Artificial Sequence
  Synthetic oligonucleotide
gaatgcgtatgtgctagtctcgtcgtttctgctgc

SEQ ID NO: 196647 - DNA, 35 bp, Artificial Sequence
  Synthetic oligonucleotide
gctgtaagctgccacgtttcgcctcctcaatgatc

SEQ ID NO: 196648 - DNA, 35 bp, Artificial Sequence
  Synthetic oligonucleotide
gagattgccacacatatacttcgagtttccctatc

SEQ ID NO: 196649 - DNA, 35 bp, Artificial Sequence
  Synthetic oligonucleotide
tgcgcacctcactatcgtactgaaaattcgcactc

SEQ ID NO: 196650 - DNA, 35 bp, Artificial Sequence
  Synthetic oligonucleotide
tcacgcatgtcaccggtaaccttcctccatacctc

SEQ ID NO: 196651 - DNA, 35 bp, Artificial Sequence
  Synthetic oligonucleotide
tgcgttctgtccgtttaacccgactgcatgccctc

SEQ ID NO: 196652 - DNA, 35 bp, Artificial Sequence
  Synthetic oligonucleotide
gcgatgcgcattgatcagaaatccgtccttcgctc

SEQ ID NO: 196653 - DNA, 35 bp, Artificial Sequence
  Synthetic oligonucleotide
tccctatgcccccatccgttgcaccgaggtctctc

SEQ ID NO: 196654 - DNA, 35 bp, Artificial Sequence
  Synthetic oligonucleotide
tcactctggcgctccctttatttaccagacccgtc

SEQ ID NO: 196655 - DNA, 35 bp, Artificial Sequence
  Synthetic oligonucleotide
tctgcaagtgctctttcgtcctcgtccggtaggtc

SEQ ID NO: 196656 - DNA, 35 bp, Artificial Sequence
  Synthetic oligonucleotide
gtggcactcgtcacccgcgtctcgcccgtcctgtc

SEQ ID NO: 196657 - DNA, 35 bp, Artificial Sequence
  Synthetic oligonucleotide
gccgatcgccgtgcacctcttccaatcgcaggttc

SEQ ID NO: 196658 - DNA, 35 bp, Artificial Sequence
  Synthetic oligonucleotide
taacacccagcgcatgcgtcacgtaccacttgttc

SEQ ID NO: 196659 - DNA, 35 bp, Artificial Sequence
  Synthetic oligonucleotide
gtccagatgcagtctatctcaagcgccctcctttc

SEQ ID NO: 196660 - DNA, 35 bp, Artificial Sequence
  Synthetic oligonucleotide
gagtcaccatccaccttgacacccactgttaccag

SEQ ID NO: 196661 - DNA, 36 bp, Artificial Sequence
  Synthetic oligonucleotide
gccacgctctgcccctgcctacgcactaacagctag

SEQ ID NO: 196662 - DNA, 35 bp, Artificial Sequence
  Synthetic oligonucleotide
acttcaccccatccaatgccagtagatgcctcccg

SEQ ID NO: 196663 - DNA, 35 bp, Artificial Sequence
  Synthetic oligonucleotide
gttctagccctcgttttattgcccccgtgtagccg

SEQ ID NO: 196664 - DNA, 35 bp, Artificial Sequence
  Synthetic oligonucleotide
tccttatgccgtcccatctccgactcccaagtccg

SEQ ID NO: 196665 - DNA, 35 bp, Artificial Sequence
  Synthetic oligonucleotide
gcaacgcgcaggtctacaccaagcacctgttttcg

SEQ ID NO: 196666 - DNA, 37 bp, Artificial Sequence
  Synthetic oligonucleotide
accacgggcggggttgtgttttgttggggagaggggg

SEQ ID NO: 196667 - DNA, 35 bp, Artificial Sequence
  Synthetic oligonucleotide
gagggggactgataggggaataagggcggacgtgg

SEQ ID NO: 196668 - DNA, 35 bp, Artificial Sequence
  Synthetic oligonucleotide
gattccccagctggtctgttccggtcccctccctg

SEQ ID NO: 196669 - DNA, 35 bp, Artificial Sequence
  Synthetic oligonucleotide
tcacgtgcttataccgatgcttgtctccccctgtg

SEQ ID NO: 196670 - DNA, 35 bp, Artificial Sequence
  Synthetic oligonucleotide
accaccgccctcgccaaagacagctgcaccttaat

SEQ ID NO: 196671 - DNA, 35 bp, Artificial Sequence
  Synthetic oligonucleotide
tccgaatccgcatcttctttaatactgtttaccat

SEQ ID NO: 196672 - DNA, 35 bp, Artificial Sequence
  Synthetic oligonucleotide
gaacgtgcctccccgcctccctcaattggagtgat

SEQ ID NO: 196673 - DNA, 35 bp, Artificial Sequence
  Synthetic oligonucleotide
tcccatcccgcctcgatgcaccacgagtaccaact

SEQ ID NO: 196674 - DNA, 35 bp, Artificial Sequence
  Synthetic oligonucleotide
tgtttacagctcagggactacttcctgcctccact

SEQ ID NO: 196675 - DNA, 35 bp, Artificial Sequence
  Synthetic oligonucleotide
tccagcgtagcatagtcatccaacgcaccctacct

SEQ ID NO: 196676 - DNA, 35 bp, Artificial Sequence
  Synthetic oligonucleotide
gtgcgatcctggcaggtgtgatcttcttcgtccct

SEQ ID NO: 196677 - DNA, 34 bp, Artificial Sequence
  Synthetic oligonucleotide
gctgacttttccgcccgtatcgaggctccctcct

SEQ ID NO: 196678 - DNA, 35 bp, Artificial Sequence
  Synthetic oligonucleotide
tagcaccgttttcgccgcggacttaccgacttcct

SEQ ID NO: 196679 - DNA, 34 bp, Artificial Sequence
  Synthetic oligonucleotide
gattagccacaggtctctgcctgcaatacttcct

SEQ ID NO: 196680 - DNA, 35 bp, Artificial Sequence
  Synthetic oligonucleotide
taagcaaccgctgccctcctagtgccacaccatct

SEQ ID NO: 196681 - DNA, 35 bp, Artificial Sequence
  Synthetic oligonucleotide
agtgtagccgctcttgaaggcccatttcaccctct

SEQ ID NO: 196682 - DNA, 35 bp, Artificial Sequence
  Synthetic oligonucleotide
gccgcaacctctagttatacatatccgggctctct

SEQ ID NO: 196683 - DNA, 35 bp, Artificial Sequence
  Synthetic oligonucleotide
gtgcacgtgtcaccatcgccgccttccgtgtctct

SEQ ID NO: 196684 - DNA, 34 bp, Artificial Sequence
  Synthetic oligonucleotide
tcactgcgtgccaccatcattgttcatcctatgt

SEQ ID NO: 196685 - DNA, 35 bp, Artificial Sequence
  Synthetic oligonucleotide
agtagtcgggtagggcgcgtaacgggagggactgt

SEQ ID NO: 196686 - DNA, 35 bp, Artificial Sequence
  Synthetic oligonucleotide
agagtgcatcctccgtgtccttgtccccctgttgt

SEQ ID NO: 196687 - DNA, 35 bp, Artificial Sequence
  Synthetic oligonucleotide
gccgcaccttaccgttcttcgctaacattgccatt

SEQ ID NO: 196688 - DNA, 35 bp, Artificial Sequence
  Synthetic oligonucleotide
gtagcgacgagtctacttgcggccactaacctctt

SEQ ID NO: 196689 - DNA, 35 bp, Artificial Sequence
  Synthetic oligonucleotide
acagcgcgcacatctgtcacatcggtctcgctctt

SEQ ID NO: 196690 - DNA, 35 bp, Artificial Sequence
  Synthetic oligonucleotide
aacatggcgagcgaactcccgtgccgccttccttt

SEQ ID NO: 196691 - DNA, 36 bp, Artificial Sequence
  Synthetic oligonucleotide
gacggacgatacagacatggatgggggtgggataaa

SEQ ID NO: 196692 - DNA, 36 bp, Artificial Sequence
  Synthetic oligonucleotide
gggaaacggaatggggggatagatcgggtggaacaa

SEQ ID NO: 196693 - DNA, 36 bp, Artificial Sequence
  Synthetic oligonucleotide
accaacaaagggggtgggaaacggttggacaacgaa

SEQ ID NO: 196694 - DNA, 36 bp, Artificial Sequence
  Synthetic oligonucleotide
atcctcatcaccttgttcgcctagcggtcctgtgaa

SEQ ID NO: 196695 - DNA, 35 bp, Artificial Sequence
  Synthetic oligonucleotide
accacctgccacgctgtccgagcgccttacttgaa

SEQ ID NO: 196696 - DNA, 36 bp, Artificial Sequence
  Synthetic oligonucleotide
ttagcgaagaagacgctttatcctgtccgttccaca

SEQ ID NO: 196697 - DNA, 36 bp, Artificial Sequence
  Synthetic oligonucleotide
tacccatctgttgtgcagctacgactactatcacca

SEQ ID NO: 196698 - DNA, 35 bp, Artificial Sequence
  Synthetic oligonucleotide
gcgccaccatcgctctgcctctcgatcacgcccca

SEQ ID NO: 196699 - DNA, 36 bp, Artificial Sequence
  Synthetic oligonucleotide
accttgccgtccatacgtacttcattgttctgccca

SEQ ID NO: 196700 - DNA, 36 bp, Artificial Sequence
  Synthetic oligonucleotide
tccggtcaccactgcctgttatcgtaacggctccca

SEQ ID NO: 196701 - DNA, 36 bp, Artificial Sequence
  Synthetic oligonucleotide
gccaacctgtttaactcgagtcctgctcttttccca

SEQ ID NO: 196702 - DNA, 35 bp, Artificial Sequence
  Synthetic oligonucleotide
acgcaagcatcctcctcgttgcgaaatccggtcca

SEQ ID NO: 196703 - DNA, 36 bp, Artificial Sequence
  Synthetic oligonucleotide
gtaagctactgccgccgtttctccgaccatttagca

SEQ ID NO: 196704 - DNA, 36 bp, Artificial Sequence
  Synthetic oligonucleotide
attacgctgtctgccggtcttccctgttcgcgcgca

SEQ ID NO: 196705 - DNA, 36 bp, Artificial Sequence
  Synthetic oligonucleotide
gtcaaccctccgttgcgtctccaaatcacattctca

SEQ ID NO: 196706 - DNA, 35 bp, Artificial Sequence
  Synthetic oligonucleotide
atccgccggtccctgagcagcctcgtctttcgtca

SEQ ID NO: 196707 - DNA, 35 bp, Artificial Sequence
  Synthetic oligonucleotide
atcggaggtcacggtggggctgaggacggatgtca

SEQ ID NO: 196708 - DNA, 36 bp, Artificial Sequence
  Synthetic oligonucleotide
gcagttgacatagcgcattcgtccccccgcctttca

SEQ ID NO: 196709 - DNA, 35 bp, Artificial Sequence
  Synthetic oligonucleotide
gttccccatccatcttgatcaagttgcaattttca

SEQ ID NO: 196710 - DNA, 37 bp, Artificial Sequence
  Synthetic oligonucleotide
aacgggatgagtgggggaacgggcataaggtccacga

SEQ ID NO: 196711 - DNA, 37 bp, Artificial Sequence
  Synthetic oligonucleotide
aggagggagggagcggagggactgcttgtgcctacga

SEQ ID NO: 196712 - DNA, 36 bp, Artificial Sequence
  Synthetic oligonucleotide
acccgtagccatgcctctctctcgtacacattccga

SEQ ID NO: 196713 - DNA, 37 bp, Artificial Sequence
  Synthetic oligonucleotide
ttcacccgtaacttcacctcgtgcgcaatcctttcga

SEQ ID NO: 196714 - DNA, 37 bp, Artificial Sequence
  Synthetic oligonucleotide
gcctcccatcccgccgactacaagacggtcgttagga

SEQ ID NO: 196715 - DNA, 36 bp, Artificial Sequence
  Synthetic oligonucleotide
ttagtagcgagtggatggtggttgggggcgggcgga

SEQ ID NO: 196716 - DNA, 37 bp, Artificial Sequence
  Synthetic oligonucleotide
ttcgcccgtactgacgcgctctttccatccttgggga

SEQ ID NO: 196717 - DNA, 38 bp, Artificial Sequence
  Synthetic oligonucleotide
gccgtgtagagggaaaggaggcgaggtggggtgactga

SEQ ID NO: 196718 - DNA, 38 bp, Artificial Sequence
  Synthetic oligonucleotide
acgtacggtcagccccgatcgcccctgccacgccctga

SEQ ID NO: 196719 - DNA, 38 bp, Artificial Sequence
  Synthetic oligonucleotide
gactgccttagacctttaatttacacactggttcctga

SEQ ID NO: 196720 - DNA, 38 bp, Artificial Sequence
  Synthetic oligonucleotide
gcacagtagatgttttgaaccctcctactcttcgctga

SEQ ID NO: 196721 - DNA, 36 bp, Artificial Sequence
  Synthetic oligonucleotide
aactccactcagctcgacctaatgtaccgcctctga

SEQ ID NO: 196722 - DNA, 38 bp, Artificial Sequence
  Synthetic oligonucleotide
tgctacccttccgccgattccgccacgccacggagtga

SEQ ID NO: 196723 - DNA, 38 bp, Artificial Sequence
  Synthetic oligonucleotide
gatctcgcgcccgcttgttcaccttttcgtccccgtga

SEQ ID NO: 196724 - DNA, 37 bp, Artificial Sequence
  Synthetic oligonucleotide
gggatcgggggcaaggagggcatgtaaggagtggtga

SEQ ID NO: 196725 - DNA, 38 bp, Artificial Sequence
  Synthetic oligonucleotide
tagacgccccatcgcgtggatcatctcgcccaaattga

SEQ ID NO: 196726 - DNA, 38 bp, Artificial Sequence
  Synthetic oligonucleotide
gggatgggtggagggcgggtgtcgtcgctttatattga

SEQ ID NO: 196727 - DNA, 36 bp, Artificial Sequence
  Synthetic oligonucleotide
accgcctcaggtctctatttacctgaccacacttga

SEQ ID NO: 196728 - DNA, 38 bp, Artificial Sequence
  Synthetic oligonucleotide
tagcacaccgtacttgcttccttcctgtctttggttga

SEQ ID NO: 196729 - DNA, 36 bp, Artificial Sequence
  Synthetic oligonucleotide
tgtaaaggggcggggggaacagagaacgtttgaata

SEQ ID NO: 196730 - DNA, 35 bp, Artificial Sequence
  Synthetic oligonucleotide
acgccgtcctcagcatcatccacttgccagcacta

SEQ ID NO: 196731 - DNA, 35 bp, Artificial Sequence
  Synthetic oligonucleotide
tttccaccgcacacttcatttacccgttcgtacta

SEQ ID NO: 196732 - DNA, 35 bp, Artificial Sequence
  Synthetic oligonucleotide
tccaccgcggcccgtgtaatgcgtcccacccccta

SEQ ID NO: 196733 - DNA, 36 bp, Artificial Sequence
  Synthetic oligonucleotide
gattactcccccattcgtgccgagccgacgattcta

SEQ ID NO: 196734 - DNA, 36 bp, Artificial Sequence
  Synthetic oligonucleotide
tgctgcctccgctcctccttccaacgtgcacttcta

SEQ ID NO: 196735 - DNA, 36 bp, Artificial Sequence
  Synthetic oligonucleotide
gaaactagggctggcacgtcacgggggggaggggta

SEQ ID NO: 196736 - DNA, 36 bp, Artificial Sequence
  Synthetic oligonucleotide
attgacagccccttctcggttatgctctacgttgta

SEQ ID NO: 196737 - DNA, 36 bp, Artificial Sequence
  Synthetic oligonucleotide
tcccaccgcttgttcatttcgccggttactctctta

SEQ ID NO: 196738 - DNA, 36 bp, Artificial Sequence
  Synthetic oligonucleotide
gttgatgtcaaggggggaggcgatagggtgcggtta

SEQ ID NO: 196739 - DNA, 35 bp, Artificial Sequence
  Synthetic oligonucleotide
tattcccccctcatgtttcgtgcactagacattta

SEQ ID NO: 196740 - DNA, 33 bp, Artificial Sequence
  Synthetic oligonucleotide
gaagccctatccctctcttcgcgccgttaccac

SEQ ID NO: 196741 - DNA, 35 bp, Artificial Sequence
  Synthetic oligonucleotide
tctcaccgagaccccgtaattcaccgcttgtccac

SEQ ID NO: 196742 - DNA, 35 bp, Artificial Sequence
  Synthetic oligonucleotide
tccgcgagctggcccctggtatatacgcccctcac

SEQ ID NO: 196743 - DNA, 35 bp, Artificial Sequence
  Synthetic oligonucleotide
accgtccatacagtctccacgccacatctactgac

SEQ ID NO: 196744 - DNA, 35 bp, Artificial Sequence
  Synthetic oligonucleotide
aactcccgctccatgcgtctcccagcccctctgac

SEQ ID NO: 196745 - DNA, 35 bp, Artificial Sequence
  Synthetic oligonucleotide
tgccgaagggagggaaaaacagcgggagtcggtac

SEQ ID NO: 196746 - DNA, 35 bp, Artificial Sequence
  Synthetic oligonucleotide
atgaaccgcccccaaaggtcatacatgactccacc

SEQ ID NO: 196747 - DNA, 35 bp, Artificial Sequence
  Synthetic oligonucleotide
gttcgctcccctgctcatccaggaactccagtacc

SEQ ID NO: 196748 - DNA, 35 bp, Artificial Sequence
  Synthetic oligonucleotide
atcaggtcccatgccgattcgccgtaatatgcccc

SEQ ID NO: 196749 - DNA, 35 bp, Artificial Sequence
  Synthetic oligonucleotide
aacagccggccgagtagtttcggcttcatatcccc

SEQ ID NO: 196750 - DNA, 35 bp, Artificial Sequence
  Synthetic oligonucleotide
tgtgaacaacgagaacttgagtcccttcgctcccc

SEQ ID NO: 196751 - DNA, 35 bp, Artificial Sequence
  Synthetic oligonucleotide
gacggtcctgattattgcgactagcttccatgccc

SEQ ID NO: 196752 - DNA, 35 bp, Artificial Sequence
  Synthetic oligonucleotide
tcatcgggaggtgtgacccgtgcgcttcatttccc

SEQ ID NO: 196753 - DNA, 35 bp, Artificial Sequence
  Synthetic oligonucleotide
ttcatgggtcaaacgctatccatcttgcttccgcc

SEQ ID NO: 196754 - DNA, 35 bp, Artificial Sequence
  Synthetic oligonucleotide
ttgggcaatctcgtcgccgtccctttactcctgcc

SEQ ID NO: 196755 - DNA, 35 bp, Artificial Sequence
  Synthetic oligonucleotide
ttcgctgcctccacttcgcagccgccccagctgcc

SEQ ID NO: 196756 - DNA, 35 bp, Artificial Sequence
  Synthetic oligonucleotide
accgtatacctccgttcatgtcgctaagcccatcc

SEQ ID NO: 196757 - DNA, 35 bp, Artificial Sequence
  Synthetic oligonucleotide
gtggggcaaccacgttagtttcaatttgtccgtcc

SEQ ID NO: 196758 - DNA, 35 bp, Artificial Sequence
  Synthetic oligonucleotide
tacctcctgaacgccgctgtagctatctttaacgc

SEQ ID NO: 196759 - DNA, 35 bp, Artificial Sequence
  Synthetic oligonucleotide
tcacgggagctgctacaaagcgccgcactctccgc

SEQ ID NO: 196760 - DNA, 35 bp, Artificial Sequence
  Synthetic oligonucleotide
gtaggtggtgcggcatggggggggcggattggcgc

SEQ ID NO: 196761 - DNA, 35 bp, Artificial Sequence
  Synthetic oligonucleotide
ttactcgcacatgcatagccacatccccacagggc

SEQ ID NO: 196762 - DNA, 35 bp, Artificial Sequence
  Synthetic oligonucleotide
atcactcgccgaatttgcactgtgtgccaccctgc

SEQ ID NO: 196763 - DNA, 35 bp, Artificial Sequence
  Synthetic oligonucleotide
aagtcatactccgcttctatctgttcaacctctgc

SEQ ID NO: 196764 - DNA, 35 bp, Artificial Sequence
  Synthetic oligonucleotide
gccgacgcccaaatctctcgcatgtttccacgtgc

SEQ ID NO: 196765 - DNA, 35 bp, Artificial Sequence
  Synthetic oligonucleotide
tgcgaaaaccgccccactgttcatacatgatttgc

SEQ ID NO: 196766 - DNA, 35 bp, Artificial Sequence
  Synthetic oligonucleotide
ttcgaccccactccgtgccgccggagatcctaatc

SEQ ID NO: 196767 - DNA, 35 bp, Artificial Sequence
  Synthetic oligonucleotide
ttggtaatcaccaggcaggcgctccctgtactatc

SEQ ID NO: 196768 - DNA, 35 bp, Artificial Sequence
  Synthetic oligonucleotide
gacccttcacagacgacagtcgagcatcccacctc

SEQ ID NO: 196769 - DNA, 35 bp, Artificial Sequence
  Synthetic oligonucleotide
gcttgctccagccctctgttcgctcattacgcctc

SEQ ID NO: 196770 - DNA, 35 bp, Artificial Sequence
  Synthetic oligonucleotide
agacctgtctccactatgttcatggcgtgctcctc

SEQ ID NO: 196771 - DNA, 35 bp, Artificial Sequence
  Synthetic oligonucleotide
accaaaaccggtcaactggccgtccgaacactctc

SEQ ID NO: 196772 - DNA, 34 bp, Artificial Sequence
  Synthetic oligonucleotide
aagactccctcagtccgtaagttaatcccttgtc

SEQ ID NO: 196773 - DNA, 35 bp, Artificial Sequence
  Synthetic oligonucleotide
gaagagtgacgagaagagagagaacttgcgagcag

SEQ ID NO: 196774 - DNA, 35 bp, Artificial Sequence
  Synthetic oligonucleotide
accccccaccgcctcgatagtgtgttccgaatcag

SEQ ID NO: 196775 - DNA, 35 bp, Artificial Sequence
  Synthetic oligonucleotide
aagggacagggagcatgcgaatagaatgggagtag

SEQ ID NO: 196776 - DNA, 35 bp, Artificial Sequence
  Synthetic oligonucleotide
gacctgatcagccgcttttcctagcatttcactcg

SEQ ID NO: 196777 - DNA, 35 bp, Artificial Sequence
  Synthetic oligonucleotide
acaccacttcgcccctgtttcatcactgcctaggg

SEQ ID NO: 196778 - DNA, 35 bp, Artificial Sequence
  Synthetic oligonucleotide
agtaggggggtggtcacagggcgaggcatgggggg

SEQ ID NO: 196779 - DNA, 35 bp, Artificial Sequence
  Synthetic oligonucleotide
gccaactgggatgtatgggaggatgggggtgaatg

SEQ ID NO: 196780 - DNA, 35 bp, Artificial Sequence
  Synthetic oligonucleotide
tggggggtgggaggcgtaggggtgccgcagtgatg

SEQ ID NO: 196781 - DNA, 35 bp, Artificial Sequence
  Synthetic oligonucleotide
gatgcacacatcgcgcgtacacccttccattcctg

SEQ ID NO: 196782 - DNA, 35 bp, Artificial Sequence
  Synthetic oligonucleotide
agccgggtgggagcctgtaagggtagggaactctg

SEQ ID NO: 196783 - DNA, 35 bp, Artificial Sequence
  Synthetic oligonucleotide
tgttccatccgtgccgtattgccatagttcctctg

SEQ ID NO: 196784 - DNA, 35 bp, Artificial Sequence
  Synthetic oligonucleotide
gtcgtgtgcatccggctattcttttctacctcgtg

SEQ ID NO: 196785 - DNA, 30 bp, Artificial Sequence
  Synthetic oligonucleotide
gtgtggtcagctctagctcaccccctcttg

SEQ ID NO: 196786 - DNA, 35 bp, Artificial Sequence
  Synthetic oligonucleotide
tcacagcccatgcctctccacctgctcagctgttg

SEQ ID NO: 196787 - DNA, 35 bp, Artificial Sequence
  Synthetic oligonucleotide
aatgcaaacccattgcgtgagcactatcttaccat

SEQ ID NO: 196788 - DNA, 35 bp, Artificial Sequence
  Synthetic oligonucleotide
tcagggtgggtcgggtgtacgttctaggggggcat

SEQ ID NO: 196789 - DNA, 35 bp, Artificial Sequence
  Synthetic oligonucleotide
atccaccatcatccggctgaacttgcagaactcat

SEQ ID NO: 196790 - DNA, 35 bp, Artificial Sequence
  Synthetic oligonucleotide
tgatgcctccccagtcgtcaataggcctccaatat

SEQ ID NO: 196791 - DNA, 35 bp, Artificial Sequence
  Synthetic oligonucleotide
ttcgtatccccgaccttccatctgtagacctgtat

SEQ ID NO: 196792 - DNA, 35 bp, Artificial Sequence
  Synthetic oligonucleotide
tcatcagtctcgcacgttgaaatacttgtcaccct

SEQ ID NO: 196793 - DNA, 35 bp, Artificial Sequence
  Synthetic oligonucleotide
gatcctccacccaatgcccttgtgccatatgatct

SEQ ID NO: 196794 - DNA, 35 bp, Artificial Sequence
  Synthetic oligonucleotide
accacggcccacgtgatttactgtccctgccctct

SEQ ID NO: 196795 - DNA, 35 bp, Artificial Sequence
  Synthetic oligonucleotide
gacgctctccctgagtatttttcttcccccggtct

SEQ ID NO: 196796 - DNA, 35 bp, Artificial Sequence
  Synthetic oligonucleotide
gacagatccctagcagtgcccatagctcctcttct

SEQ ID NO: 196797 - DNA, 35 bp, Artificial Sequence
  Synthetic oligonucleotide
tctgtagcccgccgtgtttacctcccccccccagt

SEQ ID NO: 196798 - DNA, 35 bp, Artificial Sequence
  Synthetic oligonucleotide
ttgatccgtatctaggcagtaccgcccatccccgt

SEQ ID NO: 196799 - DNA, 35 bp, Artificial Sequence
  Synthetic oligonucleotide
aaagggcgcgcccattagccaagttccatctccgt

SEQ ID NO: 196800 - DNA, 35 bp, Artificial Sequence
  Synthetic oligonucleotide
gagacagagtgaaggagcgagcgagattcgagggt

SEQ ID NO: 196801 - DNA, 35 bp, Artificial Sequence
  Synthetic oligonucleotide
gtacagtctgatcaccggcgctctatccatcctgt

SEQ ID NO: 196802 - DNA, 35 bp, Artificial Sequence
  Synthetic oligonucleotide
attccaccgctacatccccagtgtcatggggactt

SEQ ID NO: 196803 - DNA, 36 bp, Artificial Sequence
  Synthetic oligonucleotide
agttcgcctcaccggtcatcagttcttgtctgccaa

SEQ ID NO: 196804 - DNA, 36 bp, Artificial Sequence
  Synthetic oligonucleotide
gttatcgaacgggagggagggggcggatattgagaa

SEQ ID NO: 196805 - DNA, 36 bp, Artificial Sequence
  Synthetic oligonucleotide
atcgatccaccaatgtctctctgccttccttgagaa

SEQ ID NO: 196806 - DNA, 36 bp, Artificial Sequence
  Synthetic oligonucleotide
gagagggagtcgagacaaagagatagggtggatgaa

SEQ ID NO: 196807 - DNA, 36 bp, Artificial Sequence
  Synthetic oligonucleotide
tcttccaccgccatctgtctctccgtcactcgcaca

SEQ ID NO: 196808 - DNA, 30 bp, Artificial Sequence
  Synthetic oligonucleotide
gcccacccgctcctgctccgaactctcaca

SEQ ID NO: 196809 - DNA, 35 bp, Artificial Sequence
  Synthetic oligonucleotide
tctaaccgcatcaattgcgtcttattcttcaccca

SEQ ID NO: 196810 - DNA, 36 bp, Artificial Sequence
  Synthetic oligonucleotide
actcgcaacgggtgggagggtgcgcgcggggcgcca

SEQ ID NO: 196811 - DNA, 36 bp, Artificial Sequence
  Synthetic oligonucleotide
gaacgccagtctacaccgtcccccaacatcgggcca

SEQ ID NO: 196812 - DNA, 36 bp, Artificial Sequence
  Synthetic oligonucleotide
gtataccccgtcacccctgcatgccttcgtgatcca

SEQ ID NO: 196813 - DNA, 35 bp, Artificial Sequence
  Synthetic oligonucleotide
tatgtccacgcggtctcttacctgccatccttcca

SEQ ID NO: 196814 - DNA, 36 bp, Artificial Sequence
  Synthetic oligonucleotide
gccacgcaggagagggttcggggactgcgagtggca

SEQ ID NO: 196815 - DNA, 35 bp, Artificial Sequence
  Synthetic oligonucleotide
gtacgtcgaactcccttctggcactgggcccatca

SEQ ID NO: 196816 - DNA, 37 bp, Artificial Sequence
  Synthetic oligonucleotide
tggtgggagggaacggaaatccgggacgggacgaaga

SEQ ID NO: 196817 - DNA, 35 bp, Artificial Sequence
  Synthetic oligonucleotide
gagggggcgtagtgaatgggggaaggtagcccaga

SEQ ID NO: 196818 - DNA, 36 bp, Artificial Sequence
  Synthetic oligonucleotide
tgaccaccctcatcgtattacccgtccacttgcaga

SEQ ID NO: 196819 - DNA, 37 bp, Artificial Sequence
  Synthetic oligonucleotide
gccagacgaaggagcgaacgggagagagggacagaga

SEQ ID NO: 196820 - DNA, 35 bp, Artificial Sequence
  Synthetic oligonucleotide
ggcgtggtgaggggaaaaaggacgaaggggcgaga

SEQ ID NO: 196821 - DNA, 36 bp, Artificial Sequence
  Synthetic oligonucleotide
ggtgggaggggactggacaagtgggcagacgtacga

SEQ ID NO: 196822 - DNA, 36 bp, Artificial Sequence
  Synthetic oligonucleotide
acagcaggggacagcagggacgggagggggtcccga

SEQ ID NO: 196823 - DNA, 37 bp, Artificial Sequence
  Synthetic oligonucleotide
tctcctacccgttacgcatgctatcgccatttcccga

SEQ ID NO: 196824 - DNA, 35 bp, Artificial Sequence
  Synthetic oligonucleotide
tgccctaccactatgctcgctaccgagtactccga

SEQ ID NO: 196825 - DNA, 37 bp, Artificial Sequence
  Synthetic oligonucleotide
tgggtggaaggtttggcaaaaggcagagagggagcga

SEQ ID NO: 196826 - DNA, 37 bp, Artificial Sequence
  Synthetic oligonucleotide
ttcaccccctgcgcctatcttactgcatacatctcga

SEQ ID NO: 196827 - DNA, 37 bp, Artificial Sequence
  Synthetic oligonucleotide
acactcaccgcctttcattcgaccacaccctaacgga

SEQ ID NO: 196828 - DNA, 37 bp, Artificial Sequence
  Synthetic oligonucleotide
ggaacggggggggtaagggcatcaccgttgccaggga

SEQ ID NO: 196829 - DNA, 37 bp, Artificial Sequence
  Synthetic oligonucleotide
tacaaggagtagagggtgaggaagcggaaaagaggga

SEQ ID NO: 196830 - DNA, 37 bp, Artificial Sequence
  Synthetic oligonucleotide
gaggggggtggagcattgcatagggcgcatagaggga

SEQ ID NO: 196831 - DNA, 37 bp, Artificial Sequence
  Synthetic oligonucleotide
acgtgaccagaggggggggaggtacacgatgactgga

SEQ ID NO: 196832 - DNA, 37 bp, Artificial Sequence
  Synthetic oligonucleotide
tgtcgcacaccttggtttctcatccacatctcctgga

SEQ ID NO: 196833 - DNA, 37 bp, Artificial Sequence
  Synthetic oligonucleotide
ttgtcgcccccaccttgatcctgctcgccgatttgga

SEQ ID NO: 196834 - DNA, 37 bp, Artificial Sequence
  Synthetic oligonucleotide
tgtgaggtgggtagggatgtaaggggcggaggaatga

SEQ ID NO: 196835 - DNA, 37 bp, Artificial Sequence
  Synthetic oligonucleotide
gtgccagtcgacacgagcctcactaccccgcccatga

SEQ ID NO: 196836 - DNA, 37 bp, Artificial Sequence
  Synthetic oligonucleotide
ttggagaggcgggcatcgagaaaggggcgggcgatga

SEQ ID NO: 196837 - DNA, 38 bp, Artificial Sequence
  Synthetic oligonucleotide
taccacgtcaggatcatgaagcctgaccacctacctga

SEQ ID NO: 196838 - DNA, 38 bp, Artificial Sequence
  Synthetic oligonucleotide
tgatccacagactgtttccaacgcgctatcatccctga

SEQ ID NO: 196839 - DNA, 37 bp, Artificial Sequence
  Synthetic oligonucleotide
accgccgcagtcgctcaggtatacctccatcccgtga

SEQ ID NO: 196840 - DNA, 38 bp, Artificial Sequence
  Synthetic oligonucleotide
tgcatcctcgctggcctctctcctgaaacgtttcgtga

SEQ ID NO: 196841 - DNA, 38 bp, Artificial Sequence
  Synthetic oligonucleotide
gtcgaggctgagcaagggggggcaaggttataaggtga

SEQ ID NO: 196842 - DNA, 36 bp, Artificial Sequence
  Synthetic oligonucleotide
tgatggagaggggaagacgaagggagggttgggtga

SEQ ID NO: 196843 - DNA, 37 bp, Artificial Sequence
  Synthetic oligonucleotide
gcacgcccaccatccgcatttgttggcccaccattga

SEQ ID NO: 196844 - DNA, 38 bp, Artificial Sequence
  Synthetic oligonucleotide
acaggaggcggatgggacttggtgtgggcggatcttga

SEQ ID NO: 196845 - DNA, 36 bp, Artificial Sequence
  Synthetic oligonucleotide
tccgaccgaccacaaggataatttctgccttcccta

SEQ ID NO: 196846 - DNA, 35 bp, Artificial Sequence
  Synthetic oligonucleotide
gtcaccgaccgccttcgagtgattctccgttccta

SEQ ID NO: 196847 - DNA, 36 bp, Artificial Sequence
  Synthetic oligonucleotide
tgagaggtcaacgagctgctacttccacttcctcta

SEQ ID NO: 196848 - DNA, 36 bp, Artificial Sequence
  Synthetic oligonucleotide
gccccgcccgggtaggtcttttcgttgctccttgta

SEQ ID NO: 196849 - DNA, 35 bp, Artificial Sequence
  Synthetic oligonucleotide
gtgtccgaccatcacgcctcatcattgactcttta

SEQ ID NO: 196850 - DNA, 35 bp, Artificial Sequence
  Synthetic oligonucleotide
gactcgctccgattctttcttgtgcgcctttccac

SEQ ID NO: 196851 - DNA, 35 bp, Artificial Sequence
  Synthetic oligonucleotide
gacagtgacaactgtgcacctccgtcacgcattac

SEQ ID NO: 196852 - DNA, 35 bp, Artificial Sequence
  Synthetic oligonucleotide
tcaagagcgcgcccttctctgcttttttcgccacc

SEQ ID NO: 196853 - DNA, 35 bp, Artificial Sequence
  Synthetic oligonucleotide
tcacccctcattatgcacccgtaccgaaagggacc

SEQ ID NO: 196854 - DNA, 35 bp, Artificial Sequence
  Synthetic oligonucleotide
gaccctgccatatgacgctcgctctttacgctccc

SEQ ID NO: 196855 - DNA, 35 bp, Artificial Sequence
  Synthetic oligonucleotide
tcgtaaccgccaaccagcaacgcctcagttccgcc

SEQ ID NO: 196856 - DNA, 35 bp, Artificial Sequence
  Synthetic oligonucleotide
agtaccacccgcatggtctcttctttagcactgcc

SEQ ID NO: 196857 - DNA, 35 bp, Artificial Sequence
  Synthetic oligonucleotide
atgcgaccctggatccctctaacgcggtacttgcc

SEQ ID NO: 196858 - DNA, 35 bp, Artificial Sequence
  Synthetic oligonucleotide
tcccgcaacctccctcccgcttacgtgtactatcc

SEQ ID NO: 196859 - DNA, 35 bp, Artificial Sequence
  Synthetic oligonucleotide
gccaccgtccttgcctatggcctattgctcagtcc

SEQ ID NO: 196860 - DNA, 35 bp, Artificial Sequence
  Synthetic oligonucleotide
aatgtaccgtaggcttgtcaaacttcacatcttcc

SEQ ID NO: 196861 - DNA, 35 bp, Artificial Sequence
  Synthetic oligonucleotide
tcgacgcccatgctgacgcatactggtccccacgc

SEQ ID NO: 196862 - DNA, 35 bp, Artificial Sequence
  Synthetic oligonucleotide
accgtgcactagcacctgatcgctctgagccccgc

SEQ ID NO: 196863 - DNA, 35 bp, Artificial Sequence
  Synthetic oligonucleotide
tacgtacccactgcctgtatgttgacctgtcatgc

SEQ ID NO: 196864 - DNA, 35 bp, Artificial Sequence
  Synthetic oligonucleotide
gccgccgtcgcaccgtttcttccctgttatgctgc

SEQ ID NO: 196865 - DNA, 35 bp, Artificial Sequence
  Synthetic oligonucleotide
gacaagcaaccctgccatcacaaccgttcccttgc

SEQ ID NO: 196866 - DNA, 35 bp, Artificial Sequence
  Synthetic oligonucleotide
ggaccgtcgcaccttgttttgtgccactaccgatc

SEQ ID NO: 196867 - DNA, 35 bp, Artificial Sequence
  Synthetic oligonucleotide
tcccatcgtttacctgcttctctctcagggtactc

SEQ ID NO: 196868 - DNA, 35 bp, Artificial Sequence
  Synthetic oligonucleotide
accactccgctcaccaactggtcaccatgaggctc

SEQ ID NO: 196869 - DNA, 35 bp, Artificial Sequence
  Synthetic oligonucleotide
ttgcaacgccccccgacgtaaggtaccatgctctc

SEQ ID NO: 196870 - DNA, 35 bp, Artificial Sequence
  Synthetic oligonucleotide
aatccctctggctgcattttgcgctggtctttctc

SEQ ID NO: 196871 - DNA, 35 bp, Artificial Sequence
  Synthetic oligonucleotide
gcacgtcgccagttgagcccaagtcctgctccgtc

SEQ ID NO: 196872 - DNA, 35 bp, Artificial Sequence
  Synthetic oligonucleotide
tgccccctcaccgccctcctacgtagtaggcgttc

SEQ ID NO: 196873 - DNA, 35 bp, Artificial Sequence
  Synthetic oligonucleotide
gacaactctgctcccctccgaacatgtataggttc

SEQ ID NO: 196874 - DNA, 35 bp, Artificial Sequence
  Synthetic oligonucleotide
ttgacacgtacaatagtttgtcaccactgcctttc

SEQ ID NO: 196875 - DNA, 35 bp, Artificial Sequence
  Synthetic oligonucleotide
acgcctccgttgccctggttaatattgtcctacag

SEQ ID NO: 196876 - DNA, 35 bp, Artificial Sequence
  Synthetic oligonucleotide
gttgtctcccacatgtatctccccgttatctatag

SEQ ID NO: 196877 - DNA, 35 bp, Artificial Sequence
  Synthetic oligonucleotide
tacgatgtcacacttcacctccgtctttcactacg

SEQ ID NO: 196878 - DNA, 35 bp, Artificial Sequence
  Synthetic oligonucleotide
gcatcccctccacctgtctgttctccgtttctacg

SEQ ID NO: 196879 - DNA, 35 bp, Artificial Sequence
  Synthetic oligonucleotide
ttcgcaacatcacctgtctcgacttccatcttccg

SEQ ID NO: 196880 - DNA, 35 bp, Artificial Sequence
  Synthetic oligonucleotide
gacgaggaggagtacgagggcggtgggtagaagcg

SEQ ID NO: 196881 - DNA, 35 bp, Artificial Sequence
  Synthetic oligonucleotide
acccctgcctctgacacctcttgccaccctcaagg

SEQ ID NO: 196882 - DNA, 35 bp, Artificial Sequence
  Synthetic oligonucleotide
ttgactacctccctgtacgcgttttatgctcccgg

SEQ ID NO: 196883 - DNA, 35 bp, Artificial Sequence
  Synthetic oligonucleotide
agagcagggagccgtgacgggcggaatggggaggg

SEQ ID NO: 196884 - DNA, 35 bp, Artificial Sequence
  Synthetic oligonucleotide
ggatgagggcatgataacaaggggcgatgaacggg

SEQ ID NO: 196885 - DNA, 35 bp, Artificial Sequence
  Synthetic oligonucleotide
gaagaggagtaggagcgggtggagcactttggatg

SEQ ID NO: 196886 - DNA, 35 bp, Artificial Sequence
  Synthetic oligonucleotide
gatgagccgcccccttgcgtacatttttccacctg

SEQ ID NO: 196887 - DNA, 35 bp, Artificial Sequence
  Synthetic oligonucleotide
tgctcgccatgagaggtatatccgtctcccccctg

SEQ ID NO: 196888 - DNA, 35 bp, Artificial Sequence
  Synthetic oligonucleotide
gctgttgagcgccactcgtccgtaccccacgcctg

SEQ ID NO: 196889 - DNA, 35 bp, Artificial Sequence
  Synthetic oligonucleotide
accatcaccccgacgactgttctcttcactgcttg

SEQ ID NO: 196890 - DNA, 35 bp, Artificial Sequence
  Synthetic oligonucleotide
acacgctgatgttccggttccttgtcctcccgttg

SEQ ID NO: 196891 - DNA, 35 bp, Artificial Sequence
  Synthetic oligonucleotide
tcctaccacctgcgcgagcatatccaacttctttg

SEQ ID NO: 196892 - DNA, 35 bp, Artificial Sequence
  Synthetic oligonucleotide
gtggtaacatccaggctatttttgcgcccgcccat

SEQ ID NO: 196893 - DNA, 35 bp, Artificial Sequence
  Synthetic oligonucleotide
agcgccctggttgtcccctatgctcccttctttat

SEQ ID NO: 196894 - DNA, 35 bp, Artificial Sequence
  Synthetic oligonucleotide
accatcactcgtgttctgcctcccaaggtcgtact

SEQ ID NO: 196895 - DNA, 35 bp, Artificial Sequence
  Synthetic oligonucleotide
aaccgaagcgggatggtgtcatgccactccgccct

SEQ ID NO: 196896 - DNA, 35 bp, Artificial Sequence
  Synthetic oligonucleotide
gccctgccagtaggtcgctccagccatcgttccct

SEQ ID NO: 196897 - DNA, 35 bp, Artificial Sequence
  Synthetic oligonucleotide
gaatgcacctctattaagtataccggccccttcct

SEQ ID NO: 196898 - DNA, 35 bp, Artificial Sequence
  Synthetic oligonucleotide
tgagccctgcccgagtttgcactaatccccttgct

SEQ ID NO: 196899 - DNA, 35 bp, Artificial Sequence
  Synthetic oligonucleotide
tcactccccctaggcctgtttaacggtacccatct

SEQ ID NO: 196900 - DNA, 35 bp, Artificial Sequence
  Synthetic oligonucleotide
tgacgtgcatcttggatcacgtttagataacctct

SEQ ID NO: 196901 - DNA, 35 bp, Artificial Sequence
  Synthetic oligonucleotide
gcccgacgtgtgtcctttaaactgttactacctct

SEQ ID NO: 196902 - DNA, 35 bp, Artificial Sequence
  Synthetic oligonucleotide
tcccggtacgcataccttattgattccgtgcctct

SEQ ID NO: 196903 - DNA, 35 bp, Artificial Sequence
  Synthetic oligonucleotide
gtccaagtcctcagttccatagtctccaccgctgt

SEQ ID NO: 196904 - DNA, 35 bp, Artificial Sequence
  Synthetic oligonucleotide
gccgaggtcctcagagcgcacgccacttccctctt

SEQ ID NO: 196905 - DNA, 35 bp, Artificial Sequence
  Synthetic oligonucleotide
gagacgaggatcgcgggagtaaaaacgggagggtt

SEQ ID NO: 196906 - DNA, 35 bp, Artificial Sequence
  Synthetic oligonucleotide
attcagtgccctctgttacgaatttttgcccattt

SEQ ID NO: 196907 - DNA, 36 bp, Artificial Sequence
  Synthetic oligonucleotide
gtccacggaggatggtggggtcggacggtggagaaa

SEQ ID NO: 196908 - DNA, 36 bp, Artificial Sequence
  Synthetic oligonucleotide
gttgccaccatctctctcggtcagttggacatacaa

SEQ ID NO: 196909 - DNA, 36 bp, Artificial Sequence
  Synthetic oligonucleotide
atcccattccctcccatgctgcacgtagtcacccaa

SEQ ID NO: 196910 - DNA, 36 bp, Artificial Sequence
  Synthetic oligonucleotide
gttgaccctcccgttgttgtaccaacagaccttgaa

SEQ ID NO: 196911 - DNA, 36 bp, Artificial Sequence
  Synthetic oligonucleotide
agcaaccccacaccgccaatagctcgtgtacccaca

SEQ ID NO: 196912 - DNA, 36 bp, Artificial Sequence
  Synthetic oligonucleotide
actgacaaacgcactttgtcctcacgccattcccca

SEQ ID NO: 196913 - DNA, 36 bp, Artificial Sequence
  Synthetic oligonucleotide
atgtaggcaccattcatgtctttgtcctctcgccca

SEQ ID NO: 196914 - DNA, 35 bp, Artificial Sequence
  Synthetic oligonucleotide
gtccaccatcgaatgtatcactaacgcctaatcca

SEQ ID NO: 196915 - DNA, 36 bp, Artificial Sequence
  Synthetic oligonucleotide
tagcacttgcccagccaagtggctttcctgactcca

SEQ ID NO: 196916 - DNA, 35 bp, Artificial Sequence
  Synthetic oligonucleotide
tacgcacaccctgctgctctacatcacctgctcca

SEQ ID NO: 196917 - DNA, 35 bp, Artificial Sequence
  Synthetic oligonucleotide
tagtcactgccacgcaggtctcagaccacattcca

SEQ ID NO: 196918 - DNA, 36 bp, Artificial Sequence
  Synthetic oligonucleotide
tccctcggagggtaacggcttcatctcacctttcca

SEQ ID NO: 196919 - DNA, 36 bp, Artificial Sequence
  Synthetic oligonucleotide
gcaaacggctccagagctgccacaacacgcccctca

SEQ ID NO: 196920 - DNA, 36 bp, Artificial Sequence
  Synthetic oligonucleotide
gtacgccgagatgccgcctcccattcgcctagctca

SEQ ID NO: 196921 - DNA, 35 bp, Artificial Sequence
  Synthetic oligonucleotide
ttcgccccgcacatttccgatccgtttttctgtca

SEQ ID NO: 196922 - DNA, 35 bp, Artificial Sequence
  Synthetic oligonucleotide
gcagggctcgaatgggcgggcgggaaagcctttca

SEQ ID NO: 196923 - DNA, 37 bp, Artificial Sequence
  Synthetic oligonucleotide
ggggggcggggcggggggggccaagacaaaacacaga

SEQ ID NO: 196924 - DNA, 36 bp, Artificial Sequence
  Synthetic oligonucleotide
tgctccaccttacagtatgtcccttgtcgccccaga

SEQ ID NO: 196925 - DNA, 37 bp, Artificial Sequence
  Synthetic oligonucleotide
gacgtgtgagcaaggggaggaaagggccatcgccaga

SEQ ID NO: 196926 - DNA, 37 bp, Artificial Sequence
  Synthetic oligonucleotide
gccacatcagggggaagagggcggagggacgatcaga

SEQ ID NO: 196927 - DNA, 36 bp, Artificial Sequence
  Synthetic oligonucleotide
gtaacgcacaatatgcctgctccacctgttcgtaga

SEQ ID NO: 196928 - DNA, 37 bp, Artificial Sequence
  Synthetic oligonucleotide
gcaagggcacaagtagaaagggaaagggcggacacga

SEQ ID NO: 196929 - DNA, 37 bp, Artificial Sequence
  Synthetic oligonucleotide
tcacctcgtcacatgcgcctccatcctcttggtacga

SEQ ID NO: 196930 - DNA, 37 bp, Artificial Sequence
  Synthetic oligonucleotide
cggtcaccggtcctccctctctcataggcgcttacga

SEQ ID NO: 196931 - DNA, 35 bp, Artificial Sequence
  Synthetic oligonucleotide
gttgcctgcgggcctctctcgcctttttctgccga

SEQ ID NO: 196932 - DNA, 37 bp, Artificial Sequence
  Synthetic oligonucleotide
aaagtcatcggtggggggctggaggagagaggggcga

SEQ ID NO: 196933 - DNA, 37 bp, Artificial Sequence
  Synthetic oligonucleotide
gtcaggaagatggaggaggaggggtgatcggcatcga

SEQ ID NO: 196934 - DNA, 37 bp, Artificial Sequence
  Synthetic oligonucleotide
tagtgcttgcctactgtgattcctcctccgctatcga

SEQ ID NO: 196935 - DNA, 37 bp, Artificial Sequence
  Synthetic oligonucleotide
taccacacctgctcccgttgccgattacgatgctcga

SEQ ID NO: 196936 - DNA, 37 bp, Artificial Sequence
  Synthetic oligonucleotide
gtcccgccccacatcgctaaagttgatttcttaagga

SEQ ID NO: 196937 - DNA, 37 bp, Artificial Sequence
  Synthetic oligonucleotide
atacgggagtcgggtcgggagggtactaagtacagga

SEQ ID NO: 196938 - DNA, 37 bp, Artificial Sequence
  Synthetic oligonucleotide
acgagacagggacgggaggggtttacgaataggagga

SEQ ID NO: 196939 - DNA, 35 bp, Artificial Sequence
  Synthetic oligonucleotide
gaccaatcgccatagacgggaggggggaggaggga

SEQ ID NO: 196940 - DNA, 37 bp, Artificial Sequence
  Synthetic oligonucleotide
tgatcaccttagcgggatgtattcgggggggttggga

SEQ ID NO: 196941 - DNA, 38 bp, Artificial Sequence
  Synthetic oligonucleotide
gactccgcctcatggacaatgacgccatcttcccatga

SEQ ID NO: 196942 - DNA, 38 bp, Artificial Sequence
  Synthetic oligonucleotide
gccacaacgcactgacgtttcctgttctattcttatga

SEQ ID NO: 196943 - DNA, 38 bp, Artificial Sequence
  Synthetic oligonucleotide
aacagggatgggacaggtggaacgaagcggcagactga

SEQ ID NO: 196944 - DNA, 37 bp, Artificial Sequence
  Synthetic oligonucleotide
gttaacgccgatgtttctcacccccgctgtggcctga

SEQ ID NO: 196945 - DNA, 37 bp, Artificial Sequence
  Synthetic oligonucleotide
gcccagcataggggttgtatgggtacgggtgggctga

SEQ ID NO: 196946 - DNA, 38 bp, Artificial Sequence
  Synthetic oligonucleotide
atgctccctgtcatgtgtccgctctcttcctatcgtga

SEQ ID NO: 196947 - DNA, 38 bp, Artificial Sequence
  Synthetic oligonucleotide
gagggagtgcaggtggagaggaggcaaaatgagggtga

SEQ ID NO: 196948 - DNA, 38 bp, Artificial Sequence
  Synthetic oligonucleotide
gacgacgcccaccctttctaaggccgccctgcttttga

SEQ ID NO: 196949 - DNA, 36 bp, Artificial Sequence
  Synthetic oligonucleotide
aatgaccgtcgctcttgttatcacctcccgctcata

SEQ ID NO: 196950 - DNA, 36 bp, Artificial Sequence
  Synthetic oligonucleotide
aacaggtgacgttgaggtaggggggagtgagggata

SEQ ID NO: 196951 - DNA, 36 bp, Artificial Sequence
  Synthetic oligonucleotide
acgagggagggctggaggaagggcctaagagaggta

SEQ ID NO: 196952 - DNA, 35 bp, Artificial Sequence
  Synthetic oligonucleotide
attctcgcctcccttcaccatactaaagcctggta

SEQ ID NO: 196953 - DNA, 36 bp, Artificial Sequence
  Synthetic oligonucleotide
gccaccctcgactcaagttttcacaacccgctggta

SEQ ID NO: 196954 - DNA, 36 bp, Artificial Sequence
  Synthetic oligonucleotide
tgatctgccaccactggtccctcacctgtaacctta

SEQ ID NO: 196955 - DNA, 34 bp, Artificial Sequence
  Synthetic oligonucleotide
gttcaccaacagcggtatggtcgcgtttccctta

SEQ ID NO: 196956 - DNA, 35 bp, Artificial Sequence
  Synthetic oligonucleotide
tagccgtacctcatgtttctgtctctccgtaccac

SEQ ID NO: 196957 - DNA, 35 bp, Artificial Sequence
  Synthetic oligonucleotide
tcctcccgccatttggaatagctgcggtatcccac

SEQ ID NO: 196958 - DNA, 35 bp, Artificial Sequence
  Synthetic oligonucleotide
tgactccgtagctagacggagttatccaattccac

SEQ ID NO: 196959 - DNA, 35 bp, Artificial Sequence
  Synthetic oligonucleotide
atcccccagacagagcgtgccgacttctcttccac

SEQ ID NO: 196960 - DNA, 36 bp, Artificial Sequence
  Synthetic oligonucleotide
acgaccgtcacaaccatctattgaaacccctggcac

SEQ ID NO: 196961 - DNA, 35 bp, Artificial Sequence
  Synthetic oligonucleotide
tttgccctccagcccggacaacgatactgcaatac

SEQ ID NO: 196962 - DNA, 35 bp, Artificial Sequence
  Synthetic oligonucleotide
gcaaaccacctgcctgaacgtgccgtacgtactac

SEQ ID NO: 196963 - DNA, 35 bp, Artificial Sequence
  Synthetic oligonucleotide
acttccgtgcccctgccaactacaggcgttcctac

SEQ ID NO: 196964 - DNA, 35 bp, Artificial Sequence
  Synthetic oligonucleotide
tcatcggagccactggatagctctcacgcctttac

SEQ ID NO: 196965 - DNA, 35 bp, Artificial Sequence
  Synthetic oligonucleotide
tgcacctgtaggctgtatgctctccatcattttac

SEQ ID NO: 196966 - DNA, 35 bp, Artificial Sequence
  Synthetic oligonucleotide
tcgttcccccgacctgttcaccatttcagagcccc

SEQ ID NO: 196967 - DNA, 35 bp, Artificial Sequence
  Synthetic oligonucleotide
tagacgtcatcagagcaattatgcgcggcctcccc

SEQ ID NO: 196968 - DNA, 35 bp, Artificial Sequence
  Synthetic oligonucleotide
ttgcactcagcaccaacctcgtaacgagccttccc

SEQ ID NO: 196969 - DNA, 33 bp, Artificial Sequence
  Synthetic oligonucleotide
gcgacgaatcatcctggtcgttcacttgttccc

SEQ ID NO: 196970 - DNA, 35 bp, Artificial Sequence
  Synthetic oligonucleotide
gccgcacggagtggaatcgcgcggctctcccatcc

SEQ ID NO: 196971 - DNA, 35 bp, Artificial Sequence
  Synthetic oligonucleotide
ggttacccagccctgtctcactttagttacactcc

SEQ ID NO: 196972 - DNA, 35 bp, Artificial Sequence
  Synthetic oligonucleotide
tcacccgccgtctttagcactcacatacgctgtcc

SEQ ID NO: 196973 - DNA, 35 bp, Artificial Sequence
  Synthetic oligonucleotide
acattcagccacacattgcactggtgtcttgttcc

SEQ ID NO: 196974 - DNA, 35 bp, Artificial Sequence
  Synthetic oligonucleotide
tcaggatcacattctgcgtttaacaccacgcgcgc

SEQ ID NO: 196975 - DNA, 35 bp, Artificial Sequence
  Synthetic oligonucleotide
ttcctcccaccacggactcgattgcgggctttcgc

SEQ ID NO: 196976 - DNA, 35 bp, Artificial Sequence
  Synthetic oligonucleotide
tccatccttagtgttgctccgacctcccgtttcgc

SEQ ID NO: 196977 - DNA, 35 bp, Artificial Sequence
  Synthetic oligonucleotide
atctgcccccactcacctaaaggattcaagcctgc

SEQ ID NO: 196978 - DNA, 35 bp, Artificial Sequence
  Synthetic oligonucleotide
acggaacgcatagttgctcttctcatcataccatc

SEQ ID NO: 196979 - DNA, 35 bp, Artificial Sequence
  Synthetic oligonucleotide
taaccgacgcttccctgggtccactctattcgatc

SEQ ID NO: 196980 - DNA, 35 bp, Artificial Sequence
  Synthetic oligonucleotide
atccacctgcctccacactgtgccctacgattatc

SEQ ID NO: 196981 - DNA, 35 bp, Artificial Sequence
  Synthetic oligonucleotide
aacacccatgacgatgtatccagcattttccggtc

SEQ ID NO: 196982 - DNA, 35 bp, Artificial Sequence
  Synthetic oligonucleotide
atagcccaaccggcatcggtatcttcccccttgtc

SEQ ID NO: 196983 - DNA, 35 bp, Artificial Sequence
  Synthetic oligonucleotide
acttaccgccgccccctgttctatcaagccagcag

SEQ ID NO: 196984 - DNA, 35 bp, Artificial Sequence
  Synthetic oligonucleotide
tgcaaccgcctgcatactacatctgagtctcaccg

SEQ ID NO: 196985 - DNA, 35 bp, Artificial Sequence
  Synthetic oligonucleotide
gtgaatgacgcaggaagggacggggagaagccgcg

SEQ ID NO: 196986 - DNA, 35 bp, Artificial Sequence
  Synthetic oligonucleotide
tactggcaacgggcggtgagggtcgggaggaggcg

SEQ ID NO: 196987 - DNA, 35 bp, Artificial Sequence
  Synthetic oligonucleotide
tgcccctgccgctgctatgaacgcctgcccatgcg

SEQ ID NO: 196988 - DNA, 35 bp, Artificial Sequence
  Synthetic oligonucleotide
atcaccctcgaatctgtactccgccccccacgtgg

SEQ ID NO: 196989 - DNA, 35 bp, Artificial Sequence
  Synthetic oligonucleotide
ggacgagggatcagggctggggggctaacaaaatg

SEQ ID NO: 196990 - DNA, 35 bp, Artificial Sequence
  Synthetic oligonucleotide
atgctcctccaactgggttctgtacactcgccatg

SEQ ID NO: 196991 - DNA, 35 bp, Artificial Sequence
  Synthetic oligonucleotide
tagttcacccgccattgctcataagcccttctctg

SEQ ID NO: 196992 - DNA, 35 bp, Artificial Sequence
  Synthetic oligonucleotide
accgagcggggaggagtggagggaaggtgtgtgtg

SEQ ID NO: 196993 - DNA, 35 bp, Artificial Sequence
  Synthetic oligonucleotide
tccagcctcatactccgggcaatccgccatccttg

SEQ ID NO: 196994 - DNA, 35 bp, Artificial Sequence
  Synthetic oligonucleotide
tagcgacgcgacacgtcccataggtctatctccat

SEQ ID NO: 196995 - DNA, 35 bp, Artificial Sequence
  Synthetic oligonucleotide
tccggtgcgtagagattggcccccctcccgatcat

SEQ ID NO: 196996 - DNA, 35 bp, Artificial Sequence
  Synthetic oligonucleotide
aataagggggaggtggtgacaatgcggcatgggat

SEQ ID NO: 196997 - DNA, 35 bp, Artificial Sequence
  Synthetic oligonucleotide
tcgtgacgcctcctgttccgtgttagttctcccct

SEQ ID NO: 196998 - DNA, 35 bp, Artificial Sequence
  Synthetic oligonucleotide
gcccccttccgtgctggttccgcgtacttagccct

SEQ ID NO: 196999 - DNA, 35 bp, Artificial Sequence
  Synthetic oligonucleotide
accacatctacacctgcccacgtacgagggagcct

SEQ ID NO: 197000 - DNA, 35 bp, Artificial Sequence
  Synthetic oligonucleotide
agcattgccgtgatctggttctatctccatcgcct

SEQ ID NO: 197001 - DNA, 35 bp, Artificial Sequence
  Synthetic oligonucleotide
gaacccccaaccgttcttatcgcctacgctcgcct

SEQ ID NO: 197002 - DNA, 35 bp, Artificial Sequence
  Synthetic oligonucleotide
atgtcccctctctgccctgttatcatatatctcct

SEQ ID NO: 197003 - DNA, 35 bp, Artificial Sequence
  Synthetic oligonucleotide
gaaccctcaccgtccttccgccctggtatggtcct

SEQ ID NO: 197004 - DNA, 35 bp, Artificial Sequence
  Synthetic oligonucleotide
atccacggctcatattgccgatcttccctttagct

SEQ ID NO: 197005 - DNA, 35 bp, Artificial Sequence
  Synthetic oligonucleotide
tgcatgttacagacttgcgctccctccggtcatct

SEQ ID NO: 197006 - DNA, 35 bp, Artificial Sequence
  Synthetic oligonucleotide
gtctgcccgcaccttgtatgccgcgtccttgctct

SEQ ID NO: 197007 - DNA, 35 bp, Artificial Sequence
  Synthetic oligonucleotide
gtcacggccctccgttcctcagtagctcccattct

SEQ ID NO: 197008 - DNA, 35 bp, Artificial Sequence
  Synthetic oligonucleotide
atcccgtcccaccgctgccttacagccacaacagt

SEQ ID NO: 197009 - DNA, 35 bp, Artificial Sequence
  Synthetic oligonucleotide
tcacgtccacgcactccctcgcccctcaaccgggt

SEQ ID NO: 197010 - DNA, 35 bp, Artificial Sequence
  Synthetic oligonucleotide
tacatcacctccgccaaggttcaaggaacccaatt

SEQ ID NO: 197011 - DNA, 35 bp, Artificial Sequence
  Synthetic oligonucleotide
gcctccaacacgtgtttggtcaccgccttctcctt

SEQ ID NO: 197012 - DNA, 34 bp, Artificial Sequence
  Synthetic oligonucleotide
gttaccccacttggcatgatgccccttctttctt

SEQ ID NO: 197013 - DNA, 35 bp, Artificial Sequence
  Synthetic oligonucleotide
tgaccccctatatgtcgtaggtcctattttctgtt

SEQ ID NO: 197014 - DNA, 35 bp, Artificial Sequence
  Synthetic oligonucleotide
tgatgtgatccgcggtttaccacaacccccttgtt

SEQ ID NO: 197015 - DNA, 35 bp, Artificial Sequence
  Synthetic oligonucleotide
aacgcagggcgtactgccggaatcctttacccttt

SEQ ID NO: 197016 - DNA, 34 bp, Artificial Sequence
  Synthetic oligonucleotide
gccatcgcccatgctgctattacgcccaccgaaa

SEQ ID NO: 197017 - DNA, 36 bp, Artificial Sequence
  Synthetic oligonucleotide
ttgacaggccccactgccttttacgctttcactaaa

SEQ ID NO: 197018 - DNA, 35 bp, Artificial Sequence
  Synthetic oligonucleotide
taacaatgaggggggggggcgacgggatatggcaa

SEQ ID NO: 197019 - DNA, 36 bp, Artificial Sequence
  Synthetic oligonucleotide
tccccacgctgtgcaagcgccattgtccccatggaa

SEQ ID NO: 197020 - DNA, 35 bp, Artificial Sequence
  Synthetic oligonucleotide
ggtacgacgggaggagagggctggacatcgaataa

SEQ ID NO: 197021 - DNA, 35 bp, Artificial Sequence
  Synthetic oligonucleotide
tgacatagaagtagggggggaaggaaaagggttaa

SEQ ID NO: 197022 - DNA, 35 bp, Artificial Sequence
  Synthetic oligonucleotide
tcacacaggaggggcgggttgggatagatcagaca

SEQ ID NO: 197023 - DNA, 36 bp, Artificial Sequence
  Synthetic oligonucleotide
ggtctgcacatgccgcgtacaaccacctcttcgaca

SEQ ID NO: 197024 - DNA, 35 bp, Artificial Sequence
  Synthetic oligonucleotide
gcgaacgtcgcgagtccattccaccgttcttccca

SEQ ID NO: 197025 - DNA, 36 bp, Artificial Sequence
  Synthetic oligonucleotide
attgtacctgacccgttttcgcattgcacagttcca

SEQ ID NO: 197026 - DNA, 36 bp, Artificial Sequence
  Synthetic oligonucleotide
tgcaacacctggccgttacagcggatgcccctcgca

SEQ ID NO: 197027 - DNA, 32 bp, Artificial Sequence
  Synthetic oligonucleotide
agccacatcgcatcgcatttccattgttcgca

SEQ ID NO: 197028 - DNA, 36 bp, Artificial Sequence
  Synthetic oligonucleotide
agctgaggaggaaagtggaggcatgaagagacggca

SEQ ID NO: 197029 - DNA, 36 bp, Artificial Sequence
  Synthetic oligonucleotide
agacaaaggtacaggtcagagatgaaggggggggca

SEQ ID NO: 197030 - DNA, 36 bp, Artificial Sequence
  Synthetic oligonucleotide
gtactaccgcccattgcgtgccagtttgcttatgca

SEQ ID NO: 197031 - DNA, 35 bp, Artificial Sequence
  Synthetic oligonucleotide
tcgcacttacatcccgtctatccttcgcctgttca

SEQ ID NO: 197032 - DNA, 36 bp, Artificial Sequence
  Synthetic oligonucleotide
atctggagcaaggggaagggatgcgggggggtttca

SEQ ID NO: 197033 - DNA, 36 bp, Artificial Sequence
  Synthetic oligonucleotide
gtgccccgcaattgttgctctctccgttttatcaga

SEQ ID NO: 197034 - DNA, 37 bp, Artificial Sequence
  Synthetic oligonucleotide
tgaggagtgaacaaggctatggaaggggggcatgaga

SEQ ID NO: 197035 - DNA, 36 bp, Artificial Sequence
  Synthetic oligonucleotide
gacccacgctttattgtaagctccacttccttgaga

SEQ ID NO: 197036 - DNA, 37 bp, Artificial Sequence
  Synthetic oligonucleotide
ggtgcaaggtcagtcagtttatccctgcccctcacga

SEQ ID NO: 197037 - DNA, 36 bp, Artificial Sequence
  Synthetic oligonucleotide
gccgagggatgggagggagtaagggcataccgacga

SEQ ID NO: 197038 - DNA, 37 bp, Artificial Sequence
  Synthetic oligonucleotide
agcctccctacgtctgtctccgccgtccctgaaccga

SEQ ID NO: 197039 - DNA, 37 bp, Artificial Sequence
  Synthetic oligonucleotide
ttacgcgcccgttgacgctcatcttgttctccaccga

SEQ ID NO: 197040 - DNA, 37 bp, Artificial Sequence
  Synthetic oligonucleotide
acgagtagacgggggcatgggtgatacggaggtccga

SEQ ID NO: 197041 - DNA, 37 bp, Artificial Sequence
  Synthetic oligonucleotide
actgtcccggtcactgcatccatctctttcctagcga

SEQ ID NO: 197042 - DNA, 37 bp, Artificial Sequence
  Synthetic oligonucleotide
tgttagcctccgccctctctgccctgatcatggtcga

SEQ ID NO: 197043 - DNA, 35 bp, Artificial Sequence
  Synthetic oligonucleotide
gactccctgcccttgcatctgtccgcccgtaagga

SEQ ID NO: 197044 - DNA, 37 bp, Artificial Sequence
  Synthetic oligonucleotide
gtcgcaagaagagggcaagggggataatgagagagga

SEQ ID NO: 197045 - DNA, 35 bp, Artificial Sequence
  Synthetic oligonucleotide
ggttgggcggagggaagagcaggataaggagagga

SEQ ID NO: 197046 - DNA, 36 bp, Artificial Sequence
  Synthetic oligonucleotide
tttgtccccctgagctactcatgacagtttcccgga

SEQ ID NO: 197047 - DNA, 35 bp, Artificial Sequence
  Synthetic oligonucleotide
agttaagcaggatcggcaaataggggtgggcggga

SEQ ID NO: 197048 - DNA, 36 bp, Artificial Sequence
  Synthetic oligonucleotide
aactggggcgggagggaatctaagtgaggccgggga

SEQ ID NO: 197049 - DNA, 36 bp, Artificial Sequence
  Synthetic oligonucleotide
agacggagcgctgagagctgggtaggggatggggga

SEQ ID NO: 197050 - DNA, 37 bp, Artificial Sequence
  Synthetic oligonucleotide
tctgtccccgctctggcactagggctactcctctgga

SEQ ID NO: 197051 - DNA, 37 bp, Artificial Sequence
  Synthetic oligonucleotide
gcgagacgagagagtaggttgagggctagtgggtgga

SEQ ID NO: 197052 - DNA, 37 bp, Artificial Sequence
  Synthetic oligonucleotide
taaggtggaggcggggttggacgtacagcatggtgga

SEQ ID NO: 197053 - DNA, 37 bp, Artificial Sequence
  Synthetic oligonucleotide
tagctacgcaggcttggcatactccccctcgcttgga

SEQ ID NO: 197054 - DNA, 35 bp, Artificial Sequence
  Synthetic oligonucleotide
gtgtcacctcggcttgtaccacctccactcttgga

SEQ ID NO: 197055 - DNA, 35 bp, Artificial Sequence
  Synthetic oligonucleotide
gtactcgccatacttccccccccctgttggttgga

SEQ ID NO: 197056 - DNA, 38 bp, Artificial Sequence
  Synthetic oligonucleotide
ttgtcccatccgcttttatcaccactgcttggtgatga

SEQ ID NO: 197057 - DNA, 37 bp, Artificial Sequence
  Synthetic oligonucleotide
ggtgcgacgtcccgcgatatgccccccgatttactga

SEQ ID NO: 197058 - DNA, 37 bp, Artificial Sequence
  Synthetic oligonucleotide
attgcacgcgttaccattttgcgcacgtactccctga

SEQ ID NO: 197059 - DNA, 37 bp, Artificial Sequence
  Synthetic oligonucleotide
gagcaaccagtggctcctatagctcccgtttccctga

SEQ ID NO: 197060 - DNA, 38 bp, Artificial Sequence
  Synthetic oligonucleotide
tagtcagttctgcctgcgtcgtttgctacacctcctga

SEQ ID NO: 197061 - DNA, 37 bp, Artificial Sequence
  Synthetic oligonucleotide
atggaagcccctcatagttcttgtcacccgctcctga

SEQ ID NO: 197062 - DNA, 38 bp, Artificial Sequence
  Synthetic oligonucleotide
gccgttctgcgtgacagagttttcgttccatcatctga

SEQ ID NO: 197063 - DNA, 38 bp, Artificial Sequence
  Synthetic oligonucleotide
ttcatgctcagcagtatctcgccactccttatctctga

SEQ ID NO: 197064 - DNA, 37 bp, Artificial Sequence
  Synthetic oligonucleotide
ggatagtggagcaggggagacgagggggtcaaagtga

SEQ ID NO: 197065 - DNA, 38 bp, Artificial Sequence
  Synthetic oligonucleotide
taggaggggctggaggcggcggggaaggacgtacgtga

SEQ ID NO: 197066 - DNA, 38 bp, Artificial Sequence
  Synthetic oligonucleotide
atacctcccatgccaaactgcagtcagccctgccgtga

SEQ ID NO: 197067 - DNA, 38 bp, Artificial Sequence
  Synthetic oligonucleotide
agcgggaggagttgaagggagcgaaggcaggaatgtga

SEQ ID NO: 197068 - DNA, 35 bp, Artificial Sequence
  Synthetic oligonucleotide
tggacggggaaggaggagaaaataagataatgtga

SEQ ID NO: 197069 - DNA, 38 bp, Artificial Sequence
  Synthetic oligonucleotide
gtccacaccctctcagtcgcacagtcggtccctattga

SEQ ID NO: 197070 - DNA, 38 bp, Artificial Sequence
  Synthetic oligonucleotide
tgtcacagcatagtcgcacactgccggttccctcttga

SEQ ID NO: 197071 - DNA, 37 bp, Artificial Sequence
  Synthetic oligonucleotide
tgctgcccctcccctcactttccggtcagtcggttga

SEQ ID NO: 197072 - DNA, 38 bp, Artificial Sequence
  Synthetic oligonucleotide
tacatgcgccgtcctataagcctacgccgccactttga

SEQ ID NO: 197073 - DNA, 38 bp, Artificial Sequence
  Synthetic oligonucleotide
acagctcagtgccggtttgaacttcgccccttctttga

SEQ ID NO: 197074 - DNA, 36 bp, Artificial Sequence
  Synthetic oligonucleotide
gacaagggatcaggggggtggacgggaggggaaata

SEQ ID NO: 197075 - DNA, 36 bp, Artificial Sequence
  Synthetic oligonucleotide
accggtgagggacgacgaagggaggagtagctgata

SEQ ID NO: 197076 - DNA, 36 bp, Artificial Sequence
  Synthetic oligonucleotide
tgcacacatcgcctcctctggtctattatcgtacta

SEQ ID NO: 197077 - DNA, 36 bp, Artificial Sequence
  Synthetic oligonucleotide
gtgattgcgacagattcggcccagctcaccgtccta

SEQ ID NO: 197078 - DNA, 37 bp, Artificial Sequence
  Synthetic oligonucleotide
gtgccgtactgcctctcacccagactcgtttggagta

SEQ ID NO: 197079 - DNA, 35 bp, Artificial Sequence
  Synthetic oligonucleotide
gaccatcctccctcgtatacgcttaccgccaatta

SEQ ID NO: 197080 - DNA, 35 bp, Artificial Sequence
  Synthetic oligonucleotide
gactcaaccgtacgtccggatctatctttgcatta

SEQ ID NO: 197081 - DNA, 35 bp, Artificial Sequence
  Synthetic oligonucleotide
gcgccctcatgccctgtcctgcaaactgagcctta

SEQ ID NO: 197082 - DNA, 36 bp, Artificial Sequence
  Synthetic oligonucleotide
gtgcctccgaataggtctaactcacacacactctta

SEQ ID NO: 197083 - DNA, 35 bp, Artificial Sequence
  Synthetic oligonucleotide
tcagcaccgccctgtcgtctttacatgattccaac

SEQ ID NO: 197084 - DNA, 35 bp, Artificial Sequence
  Synthetic oligonucleotide
gtcgatcgcgcttgtgctcagccttctttttccac

SEQ ID NO: 197085 - DNA, 35 bp, Artificial Sequence
  Synthetic oligonucleotide
tccccgcttaactgttttgccccagcttgtttcac

SEQ ID NO: 197086 - DNA, 35 bp, Artificial Sequence
  Synthetic oligonucleotide
accggggtgcacaccttctctcctctgttgccgac

SEQ ID NO: 197087 - DNA, 35 bp, Artificial Sequence
  Synthetic oligonucleotide
acgcgcacatcccatagtttacgactactgcttac

SEQ ID NO: 197088 - DNA, 35 bp, Artificial Sequence
  Synthetic oligonucleotide
tagcgccgacccaccccggaatgtgcctccgcacc

SEQ ID NO: 197089 - DNA, 35 bp, Artificial Sequence
  Synthetic oligonucleotide
atcatccccggtcacaatctgctacggtctacccc

SEQ ID NO: 197090 - DNA, 35 bp, Artificial Sequence
  Synthetic oligonucleotide
tgtcgatcgtcacccatgcgtgcaccacatccccc

SEQ ID NO: 197091 - DNA, 35 bp, Artificial Sequence
  Synthetic oligonucleotide
tgccccctcctcgaatgggtccttcgatttcgccc

SEQ ID NO: 197092 - DNA, 35 bp, Artificial Sequence
  Synthetic oligonucleotide
gatcgtccacggccacgtagctccacttattgccc

SEQ ID NO: 197093 - DNA, 32 bp, Artificial Sequence
  Synthetic oligonucleotide
aagaccgaccggggagggacgagcagaaggcc

SEQ ID NO: 197094 - DNA, 35 bp, Artificial Sequence
  Synthetic oligonucleotide
tgctgttcgcgcctgctacatgactctcctcggcc

SEQ ID NO: 197095 - DNA, 35 bp, Artificial Sequence
  Synthetic oligonucleotide
tgtcacgggaagggcgggtcatgggtcatatggcc

SEQ ID NO: 197096 - DNA, 35 bp, Artificial Sequence
  Synthetic oligonucleotide
tgccggagccttgttgctagccccactgccctgcc

SEQ ID NO: 197097 - DNA, 35 bp, Artificial Sequence
  Synthetic oligonucleotide
tctgtaccgcctatgccgtttccactacgcttgcc

SEQ ID NO: 197098 - DNA, 35 bp, Artificial Sequence
  Synthetic oligonucleotide
gcttcagcccattgtggtcccacaccttcattcgc

SEQ ID NO: 197099 - DNA, 35 bp, Artificial Sequence
  Synthetic oligonucleotide
atagcgagaaggcgcatggggggaagaggaggggc

SEQ ID NO: 197100 - DNA, 35 bp, Artificial Sequence
  Synthetic oligonucleotide
aacacgcgcgcaggctttaatgcgccttctcttgc

SEQ ID NO: 197101 - DNA, 35 bp, Artificial Sequence
  Synthetic oligonucleotide
aagtccgcactcggcttgctgtccttcccctgatc

SEQ ID NO: 197102 - DNA, 35 bp, Artificial Sequence
  Synthetic oligonucleotide
gtagcctgcggaaagcgccttacgaaccgcacctc

SEQ ID NO: 197103 - DNA, 35 bp, Artificial Sequence
  Synthetic oligonucleotide
atcactcccattactgtccccctcgcatggtgctc

SEQ ID NO: 197104 - DNA, 35 bp, Artificial Sequence
  Synthetic oligonucleotide
gtccgactttctgcctaacgacgtatacccatctc

SEQ ID NO: 197105 - DNA, 35 bp, Artificial Sequence
  Synthetic oligonucleotide
ttgttccatccgctgtgctgggctggtttgctctc

SEQ ID NO: 197106 - DNA, 35 bp, Artificial Sequence
  Synthetic oligonucleotide
gtccgcctctcttgctcgctcagttaccatccgtc

SEQ ID NO: 197107 - DNA, 35 bp, Artificial Sequence
  Synthetic oligonucleotide
accgaccccgtcccataatgcgcactcaaaaggtc

SEQ ID NO: 197108 - DNA, 35 bp, Artificial Sequence
  Synthetic oligonucleotide
gcataccacccctgacgctgacacacgtattggtc

SEQ ID NO: 197109 - DNA, 35 bp, Artificial Sequence
  Synthetic oligonucleotide
tttgcctccgttcgcccttgtattacgtattattc

SEQ ID NO: 197110 - DNA, 35 bp, Artificial Sequence
  Synthetic oligonucleotide
ggtgtcgcaccatgcctcgaatcttcctcccgttc

SEQ ID NO: 197111 - DNA, 35 bp, Artificial Sequence
  Synthetic oligonucleotide
ggatgcgctcgtctccctccatctttcggtgtttc

SEQ ID NO: 197112 - DNA, 35 bp, Artificial Sequence
  Synthetic oligonucleotide
gacccgcgctcctctctatcgacctggttgaacag

SEQ ID NO: 197113 - DNA, 35 bp, Artificial Sequence
  Synthetic oligonucleotide
ggagaacgtgggagcgagaggacaacataggtcag

SEQ ID NO: 197114 - DNA, 35 bp, Artificial Sequence
  Synthetic oligonucleotide
gtctagggggctatgcggcatgggaggggcgggag

SEQ ID NO: 197115 - DNA, 35 bp, Artificial Sequence
  Synthetic oligonucleotide
agatgctcccctcctgtcgtacctcctttgttgag

SEQ ID NO: 197116 - DNA, 35 bp, Artificial Sequence
  Synthetic oligonucleotide
cacatccccctccgctgcaactgtgttgcataacg

SEQ ID NO: 197117 - DNA, 35 bp, Artificial Sequence
  Synthetic oligonucleotide
gagatcagctccacgtttatggctcacttcccccg

SEQ ID NO: 197118 - DNA, 35 bp, Artificial Sequence
  Synthetic oligonucleotide
gaatcgctaggccatgtttagctcccccctccgcg

SEQ ID NO: 197119 - DNA, 35 bp, Artificial Sequence
  Synthetic oligonucleotide
gggtggcgggggggttttgcggattgcacatcgcg

SEQ ID NO: 197120 - DNA, 35 bp, Artificial Sequence
  Synthetic oligonucleotide
gtgtcccctcacattccgttatgttatccacctcg

SEQ ID NO: 197121 - DNA, 36 bp, Artificial Sequence
  Synthetic oligonucleotide
ggattgcctctttcccctgccatccctgtcttccgg

SEQ ID NO: 197122 - DNA, 35 bp, Artificial Sequence
  Synthetic oligonucleotide
tcagtgctgctttcttgtcctaacgcccgcccatg

SEQ ID NO: 197123 - DNA, 35 bp, Artificial Sequence
  Synthetic oligonucleotide
gaggggtgaagtggatgggacgatggtaacgcttg

SEQ ID NO: 197124 - DNA, 35 bp, Artificial Sequence
  Synthetic oligonucleotide
atcaccacctgttttcctttatgcactttgcgttg

SEQ ID NO: 197125 - DNA, 35 bp, Artificial Sequence
  Synthetic oligonucleotide
gagctcccgccgccgtattgtcctcccgctttttg

SEQ ID NO: 197126 - DNA, 35 bp, Artificial Sequence
  Synthetic oligonucleotide
tcacctaccgaccctgactctgtgcctatagcaat

SEQ ID NO: 197127 - DNA, 35 bp, Artificial Sequence
  Synthetic oligonucleotide
tatgcagaccagccctatacgtgtttcgcttacat

SEQ ID NO: 197128 - DNA, 35 bp, Artificial Sequence
  Synthetic oligonucleotide
acatcgccccatacccgccgtgagttccgttacat

SEQ ID NO: 197129 - DNA, 35 bp, Artificial Sequence
  Synthetic oligonucleotide
atcacagtagccccttgacgtgccacatgttccat

SEQ ID NO: 197130 - DNA, 35 bp, Artificial Sequence
  Synthetic oligonucleotide
accaacaggcgccttccgcagcgataacctttcat

SEQ ID NO: 197131 - DNA, 35 bp, Artificial Sequence
  Synthetic oligonucleotide
agaggacgggggggctgggagagtagcatgccgat

SEQ ID NO: 197132 - DNA, 35 bp, Artificial Sequence
  Synthetic oligonucleotide
gtcccgctgatcgccacatgccctatgatccctat

SEQ ID NO: 197133 - DNA, 35 bp, Artificial Sequence
  Synthetic oligonucleotide
tgcctcctccgtcccctgaacttgggcgcataact

SEQ ID NO: 197134 - DNA, 35 bp, Artificial Sequence
  Synthetic oligonucleotide
taaccgcacatcccaggtccctcaccgctttccct

SEQ ID NO: 197135 - DNA, 35 bp, Artificial Sequence
  Synthetic oligonucleotide
ccccatccatgcgcctcatcctgtgtcagcggcct

SEQ ID NO: 197136 - DNA, 35 bp, Artificial Sequence
  Synthetic oligonucleotide
acgaggccacagatcacaaagtgagccttcctcct

SEQ ID NO: 197137 - DNA, 35 bp, Artificial Sequence
  Synthetic oligonucleotide
gttcgactcgccgatatccacccgctttactagct

SEQ ID NO: 197138 - DNA, 35 bp, Artificial Sequence
  Synthetic oligonucleotide
ggggaggttggggagtacttggaagggagtgggct

SEQ ID NO: 197139 - DNA, 35 bp, Artificial Sequence
  Synthetic oligonucleotide
tcatgacagcctatatctctatctatttggcctct

SEQ ID NO: 197140 - DNA, 35 bp, Artificial Sequence
  Synthetic oligonucleotide
tttccctccatcagctgtctatcggctcattgtct

SEQ ID NO: 197141 - DNA, 35 bp, Artificial Sequence
  Synthetic oligonucleotide
tcagacgacggtcagtaatgagggggggggccggt

SEQ ID NO: 197142 - DNA, 35 bp, Artificial Sequence
  Synthetic oligonucleotide
gtgcatgctcatgtcttcccatcacgtcctctggt

SEQ ID NO: 197143 - DNA, 35 bp, Artificial Sequence
  Synthetic oligonucleotide
ggaggacggcaggaggaacggagtggggtattggt

SEQ ID NO: 197144 - DNA, 35 bp, Artificial Sequence
  Synthetic oligonucleotide
taagtgcataccacccgtctcctccccgtgtctgt

SEQ ID NO: 197145 - DNA, 35 bp, Artificial Sequence
  Synthetic oligonucleotide
gatgcggcctcatcttccacgccgaccatgaactt

SEQ ID NO: 197146 - DNA, 35 bp, Artificial Sequence
  Synthetic oligonucleotide
gatcctgcctcgatctggttacgttgcatctcctt

SEQ ID NO: 197147 - DNA, 35 bp, Artificial Sequence
  Synthetic oligonucleotide
gacctgtgacaataggtccaatgtacgcctctctt

SEQ ID NO: 197148 - DNA, 36 bp, Artificial Sequence
  Synthetic oligonucleotide
aagagggtggacgaacatcgaggcggggaatgagaa

SEQ ID NO: 197149 - DNA, 36 bp, Artificial Sequence
  Synthetic oligonucleotide
aacactcaccggtatcacagccagcccgcctccgaa

SEQ ID NO: 197150 - DNA, 36 bp, Artificial Sequence
  Synthetic oligonucleotide
gacagacacccacatgtctaccttatgcctgcctaa

SEQ ID NO: 197151 - DNA, 36 bp, Artificial Sequence
  Synthetic oligonucleotide
tttggcgtgtcgctcgcgtctcaccaccattcctaa

SEQ ID NO: 197152 - DNA, 36 bp, Artificial Sequence
  Synthetic oligonucleotide
tacgccatacgcccatcttggcactgaaacttctaa

SEQ ID NO: 197153 - DNA, 36 bp, Artificial Sequence
  Synthetic oligonucleotide
taactgatagggggagggttgaagggcgggcacaca

SEQ ID NO: 197154 - DNA, 36 bp, Artificial Sequence
  Synthetic oligonucleotide
gtctggccggcttagagtctcgttccctgcatccca

SEQ ID NO: 197155 - DNA, 36 bp, Artificial Sequence
  Synthetic oligonucleotide
tccactcgccccgcaggtacacgctaatgcggtcca

SEQ ID NO: 197156 - DNA, 36 bp, Artificial Sequence
  Synthetic oligonucleotide
tgtcctctccagtgtcctcttccacaacatcgcgca

SEQ ID NO: 197157 - DNA, 35 bp, Artificial Sequence
  Synthetic oligonucleotide
aacgacggcggtctcacaataggagggggagggca

SEQ ID NO: 197158 - DNA, 35 bp, Artificial Sequence
  Synthetic oligonucleotide
accaaccctgtagctgttctatcgccccacttgca

SEQ ID NO: 197159 - DNA, 36 bp, Artificial Sequence
  Synthetic oligonucleotide
gccgcacgtgtcccgccgtgtccacgagtgccatca

SEQ ID NO: 197160 - DNA, 36 bp, Artificial Sequence
  Synthetic oligonucleotide
tgtaagcgccacgaagctcacctctacgtcatctca

SEQ ID NO: 197161 - DNA, 36 bp, Artificial Sequence
  Synthetic oligonucleotide
actctacctcggtccgtgccttcgtgcccactttca

SEQ ID NO: 197162 - DNA, 35 bp, Artificial Sequence
  Synthetic oligonucleotide
gtcccctttcctgcacttataggagttgcctttca

SEQ ID NO: 197163 - DNA, 37 bp, Artificial Sequence
  Synthetic oligonucleotide
gaactggaccaggggaggggaagggtaactgtgtaga

SEQ ID NO: 197164 - DNA, 37 bp, Artificial Sequence
  Synthetic oligonucleotide
gagaggtcaggcggggggacacaggaaagggtgacga

SEQ ID NO: 197165 - DNA, 36 bp, Artificial Sequence
  Synthetic oligonucleotide
gcgcacccccgccatcgtaatgtcggtacttcccga

SEQ ID NO: 197166 - DNA, 37 bp, Artificial Sequence
  Synthetic oligonucleotide
actgcacccgtaccggcccttaacgctcgccctccga

SEQ ID NO: 197167 - DNA, 36 bp, Artificial Sequence
  Synthetic oligonucleotide
tgtggccgtatacgtcctgcttgttctatttcgcga

SEQ ID NO: 197168 - DNA, 37 bp, Artificial Sequence
  Synthetic oligonucleotide
ttggtagccattgcacgtttacatccactccctgcga

SEQ ID NO: 197169 - DNA, 36 bp, Artificial Sequence
  Synthetic oligonucleotide
gcaaccgcagccgcccctgctcccagcgattatcga

SEQ ID NO: 197170 - DNA, 36 bp, Artificial Sequence
  Synthetic oligonucleotide
tcagccgccctatattcgcagcaatgactacctcga

SEQ ID NO: 197171 - DNA, 36 bp, Artificial Sequence
  Synthetic oligonucleotide
tgatatgcctcccccggcctcacgacgttccctcga

SEQ ID NO: 197172 - DNA, 37 bp, Artificial Sequence
  Synthetic oligonucleotide
ttccacgccacggaagctctcgactctcctccttcga

SEQ ID NO: 197173 - DNA, 36 bp, Artificial Sequence
  Synthetic oligonucleotide
tccgggtaggaaagtaatggtgggcgcagggaagga

SEQ ID NO: 197174 - DNA, 37 bp, Artificial Sequence
  Synthetic oligonucleotide
gcgaggagggaggagcatgcggatcaaggcaacagga

SEQ ID NO: 197175 - DNA, 37 bp, Artificial Sequence
  Synthetic oligonucleotide
gtagatgggcggaccgatggaggggtctgaggacgga

SEQ ID NO: 197176 - DNA, 37 bp, Artificial Sequence
  Synthetic oligonucleotide
gaccggggcgggagctgggaggcgagtggagggcgga

SEQ ID NO: 197177 - DNA, 37 bp, Artificial Sequence
  Synthetic oligonucleotide
agacggcggaggtgggggtgcagaggataggcaggga

SEQ ID NO: 197178 - DNA, 37 bp, Artificial Sequence
  Synthetic oligonucleotide
tacggagggtgaatgcagaacgttagcgggggtggga

SEQ ID NO: 197179 - DNA, 37 bp, Artificial Sequence
  Synthetic oligonucleotide
acgatctgcgtgtagggaggatacgggcggggatgga

SEQ ID NO: 197180 - DNA, 37 bp, Artificial Sequence
  Synthetic oligonucleotide
gacccccgactgttgttttccccccgcatcctatgga

SEQ ID NO: 197181 - DNA, 37 bp, Artificial Sequence
  Synthetic oligonucleotide
aagggggaatgcagagctacggagggaggcgagtgga

SEQ ID NO: 197182 - DNA, 35 bp, Artificial Sequence
  Synthetic oligonucleotide
tgcaactggtcaattctgttctgctacctacatga

SEQ ID NO: 197183 - DNA, 38 bp, Artificial Sequence
  Synthetic oligonucleotide
ggttgagccacggtagcttttacgccactctccactga

SEQ ID NO: 197184 - DNA, 38 bp, Artificial Sequence
  Synthetic oligonucleotide
aagacagccaacatgttcatctcgctcgtattccctga

SEQ ID NO: 197185 - DNA, 37 bp, Artificial Sequence
  Synthetic oligonucleotide
tcatgtcaccggggggagggggttacgggaaagctga

SEQ ID NO: 197186 - DNA, 37 bp, Artificial Sequence
  Synthetic oligonucleotide
tccccacgccctcaaactgcaccaggcaggtcgctga

SEQ ID NO: 197187 - DNA, 35 bp, Artificial Sequence
  Synthetic oligonucleotide
gtacgagtggaatggcgggggggtagtactgctga

SEQ ID NO: 197188 - DNA, 37 bp, Artificial Sequence
  Synthetic oligonucleotide
tcaccacacttgttgtaacggtcccacttctctctga

SEQ ID NO: 197189 - DNA, 38 bp, Artificial Sequence
  Synthetic oligonucleotide
gagggaacgtgaggcgggggaagaagcacgagtagtga

SEQ ID NO: 197190 - DNA, 38 bp, Artificial Sequence
  Synthetic oligonucleotide
ttcgcaggcggagaagggacggggggggagacacgtga

SEQ ID NO: 197191 - DNA, 37 bp, Artificial Sequence
  Synthetic oligonucleotide
gaaaaggggaaggatcaaaggagggtcgcaagcgtga

SEQ ID NO: 197192 - DNA, 38 bp, Artificial Sequence
  Synthetic oligonucleotide
gagtagagggtgaacaggggagggaagtcgtgtggtga

SEQ ID NO: 197193 - DNA, 37 bp, Artificial Sequence
  Synthetic oligonucleotide
gaagagaccattgggtaataggggagcggggaattga

SEQ ID NO: 197194 - DNA, 37 bp, Artificial Sequence
  Synthetic oligonucleotide
gacaccttgccactttgtattacttcgcttatcttga

SEQ ID NO: 197195 - DNA, 36 bp, Artificial Sequence
  Synthetic oligonucleotide
tcttgcatccacgcccgtttgtctacactcgccata

SEQ ID NO: 197196 - DNA, 36 bp, Artificial Sequence
  Synthetic oligonucleotide
aacggtgcgtatccggttatccgtgcgccctaccta

SEQ ID NO: 197197 - DNA, 36 bp, Artificial Sequence
  Synthetic oligonucleotide
tacgacctcaggcggtatacgttctttctgccccta

SEQ ID NO: 197198 - DNA, 36 bp, Artificial Sequence
  Synthetic oligonucleotide
acgaccttgccaatcgtgccgccctgttcaccgcta

SEQ ID NO: 197199 - DNA, 36 bp, Artificial Sequence
  Synthetic oligonucleotide
gtacgtacctgccgccacctgagtattccaccctta

SEQ ID NO: 197200 - DNA, 35 bp, Artificial Sequence
  Synthetic oligonucleotide
agatggggactgggcgggtcaatagggtgtttaac

SEQ ID NO: 197201 - DNA, 35 bp, Artificial Sequence
  Synthetic oligonucleotide
tcctgacttgctcatctctgtcacatcccgatcac

SEQ ID NO: 197202 - DNA, 35 bp, Artificial Sequence
  Synthetic oligonucleotide
gtaccatcccactgacgctattgaaccaagcctac

SEQ ID NO: 197203 - DNA, 35 bp, Artificial Sequence
  Synthetic oligonucleotide
tccagtcccagttccggattcatgcactactaacc

SEQ ID NO: 197204 - DNA, 35 bp, Artificial Sequence
  Synthetic oligonucleotide
tacatacccctgattcgtcaggtttcgctttcccc

SEQ ID NO: 197205 - DNA, 35 bp, Artificial Sequence
  Synthetic oligonucleotide
ggggggtgggggggcacacacgggggttatcgccc

SEQ ID NO: 197206 - DNA, 35 bp, Artificial Sequence
  Synthetic oligonucleotide
gaccgaggccctgcgtttggaactagccccttccc

SEQ ID NO: 197207 - DNA, 35 bp, Artificial Sequence
  Synthetic oligonucleotide
tcgctcacctcaatgcaagctgcccgccctttccc

SEQ ID NO: 197208 - DNA, 35 bp, Artificial Sequence
  Synthetic oligonucleotide
gaccaacgtccgccacgttacatctctcatgagcc

SEQ ID NO: 197209 - DNA, 35 bp, Artificial Sequence
  Synthetic oligonucleotide
tcagacgctcaactgtccaccttacgtcccccgcc

SEQ ID NO: 197210 - DNA, 35 bp, Artificial Sequence
  Synthetic oligonucleotide
tgaccattcgttcaactgaattcgtactccttgcc

SEQ ID NO: 197211 - DNA, 35 bp, Artificial Sequence
  Synthetic oligonucleotide
tgcacccacggttacctatacctttgcactttgcc

SEQ ID NO: 197212 - DNA, 35 bp, Artificial Sequence
  Synthetic oligonucleotide
tctgcctgactccgcctcgcgtctcacaggactcc

SEQ ID NO: 197213 - DNA, 35 bp, Artificial Sequence
  Synthetic oligonucleotide
tttcgcctccatcgtaatataccttaactagctcc

SEQ ID NO: 197214 - DNA, 35 bp, Artificial Sequence
  Synthetic oligonucleotide
tgatagcacggtccgctgcccccattacgttgtcc

SEQ ID NO: 197215 - DNA, 35 bp, Artificial Sequence
  Synthetic oligonucleotide
tgccttccgcccgctgtcctggatatcgatttcgc

SEQ ID NO: 197216 - DNA, 35 bp, Artificial Sequence
  Synthetic oligonucleotide
acctggcaggggactgaacgaacgggagggagggc

SEQ ID NO: 197217 - DNA, 35 bp, Artificial Sequence
  Synthetic oligonucleotide
gcaacccgggaacgtgccatttcgacctcttatgc

SEQ ID NO: 197218 - DNA, 35 bp, Artificial Sequence
  Synthetic oligonucleotide
gtcacacgtactcgcttataaacgtgattgccatc

SEQ ID NO: 197219 - DNA, 35 bp, Artificial Sequence
  Synthetic oligonucleotide
gccatcctccgcttgttccggtgccctgtttactc

SEQ ID NO: 197220 - DNA, 35 bp, Artificial Sequence
  Synthetic oligonucleotide
ggtcaatgccgcgcgctgtacacactattctcctc

SEQ ID NO: 197221 - DNA, 35 bp, Artificial Sequence
  Synthetic oligonucleotide
gcgaagcgcatttgatttttgccgctgaaccgctc

SEQ ID NO: 197222 - DNA, 35 bp, Artificial Sequence
  Synthetic oligonucleotide
tactcaggccagatgtcccctacacgctccttctc

SEQ ID NO: 197223 - DNA, 35 bp, Artificial Sequence
  Synthetic oligonucleotide
tgcgattcctccgacgagcatcttgtttggttctc

SEQ ID NO: 197224 - DNA, 35 bp, Artificial Sequence
  Synthetic oligonucleotide
atccgctccggtctgtcctccttgctaaatgggtc

SEQ ID NO: 197225 - DNA, 35 bp, Artificial Sequence
  Synthetic oligonucleotide
tggacgctgactccgcttcgttgcatgcccccttc

SEQ ID NO: 197226 - DNA, 35 bp, Artificial Sequence
  Synthetic oligonucleotide
agcatcatcggacctggtattccgctgctgccttc

SEQ ID NO: 197227 - DNA, 35 bp, Artificial Sequence
  Synthetic oligonucleotide
aagcccaacgcatcttcctctgttcaaggatcttc

SEQ ID NO: 197228 - DNA, 34 bp, Artificial Sequence
  Synthetic oligonucleotide
gctaggatctccgcgcgtgcctccttactgtttc

SEQ ID NO: 197229 - DNA, 35 bp, Artificial Sequence
  Synthetic oligonucleotide
tatcccaccgcccaccagtagctgaccccaccgag

SEQ ID NO: 197230 - DNA, 35 bp, Artificial Sequence
  Synthetic oligonucleotide
ggtgatggcgagggggaatgcgacgggatagcgag

SEQ ID NO: 197231 - DNA, 35 bp, Artificial Sequence
  Synthetic oligonucleotide
agatccccccaccagatcatctacacctcatttag

SEQ ID NO: 197232 - DNA, 35 bp, Artificial Sequence
  Synthetic oligonucleotide
attcagagcagatatctcgtcttgccccctttgcg

SEQ ID NO: 197233 - DNA, 35 bp, Artificial Sequence
  Synthetic oligonucleotide
acacgaccgcgcgaaatgtttcgccctttccttcg

SEQ ID NO: 197234 - DNA, 35 bp, Artificial Sequence
  Synthetic oligonucleotide
gatacggtcatatatcacacgtgcccctcttttcg

SEQ ID NO: 197235 - DNA, 36 bp, Artificial Sequence
  Synthetic oligonucleotide
gcacgggggaggggcgagaacagatcagtcgggcgg

SEQ ID NO: 197236 - DNA, 35 bp, Artificial Sequence
  Synthetic oligonucleotide
tggatgtcacagtacttcgcgcttaccttcccatg

SEQ ID NO: 197237 - DNA, 35 bp, Artificial Sequence
  Synthetic oligonucleotide
gaactataacggccctcacttcctcttctgccatg

SEQ ID NO: 197238 - DNA, 35 bp, Artificial Sequence
  Synthetic oligonucleotide
acccgaccacattcgagcgttctatgaaacccctg

SEQ ID NO: 197239 - DNA, 35 bp, Artificial Sequence
  Synthetic oligonucleotide
actgatggtcccctgcctctttcattcctcccctg

SEQ ID NO: 197240 - DNA, 35 bp, Artificial Sequence
  Synthetic oligonucleotide
tcaactgcgttgccagattaccgccctatttcctg

SEQ ID NO: 197241 - DNA, 35 bp, Artificial Sequence
  Synthetic oligonucleotide
acccgttcagaagtcattccctgtttcctggccat

SEQ ID NO: 197242 - DNA, 35 bp, Artificial Sequence
  Synthetic oligonucleotide
actttccgctccattgacatagttctacgctccat

SEQ ID NO: 197243 - DNA, 35 bp, Artificial Sequence
  Synthetic oligonucleotide
atgcaccaccccgacggcacaagaatactcctcat

SEQ ID NO: 197244 - DNA, 35 bp, Artificial Sequence
  Synthetic oligonucleotide
ttagtaaccgcccctgtgatcatttgcccgagtat

SEQ ID NO: 197245 - DNA, 35 bp, Artificial Sequence
  Synthetic oligonucleotide
agccctgcgacggtcccttttgttgctcagctcct

SEQ ID NO: 197246 - DNA, 35 bp, Artificial Sequence
  Synthetic oligonucleotide
tatactcccggcacctgcgccacgcatcttttcct

SEQ ID NO: 197247 - DNA, 35 bp, Artificial Sequence
  Synthetic oligonucleotide
gatggaagtggctcggagaatggggatgaaaggct

SEQ ID NO: 197248 - DNA, 35 bp, Artificial Sequence
  Synthetic oligonucleotide
agcaaaggcgaagtgggaggggggtggattttgct

SEQ ID NO: 197249 - DNA, 35 bp, Artificial Sequence
  Synthetic oligonucleotide
tcccactcccgtgacgttctcctttgacgacctct

SEQ ID NO: 197250 - DNA, 35 bp, Artificial Sequence
  Synthetic oligonucleotide
tttgcctaccgctctagatcgcgatgcgttcctct

SEQ ID NO: 197251 - DNA, 35 bp, Artificial Sequence
  Synthetic oligonucleotide
ggtgagggggtagagggataggcggacgctgtggt

SEQ ID NO: 197252 - DNA, 35 bp, Artificial Sequence
  Synthetic oligonucleotide
acacatccatcacatggcagtaagccggcttcctt

SEQ ID NO: 197253 - DNA, 35 bp, Artificial Sequence
  Synthetic oligonucleotide
gacggtacagaggaagtcatagcacacctcctctt

SEQ ID NO: 197254 - DNA, 35 bp, Artificial Sequence
  Synthetic oligonucleotide
acccgtccatcagtacatgatattgttccatcgtt

SEQ ID NO: 197255 - DNA, 35 bp, Artificial Sequence
  Synthetic oligonucleotide
tcccgcccccgtagctgtatagcccgcctaccttt

SEQ ID NO: 197256 - DNA, 35 bp, Artificial Sequence
  Synthetic oligonucleotide
tctaactccgctactcatcatgccgttcccgcttt

SEQ ID NO: 197257 - DNA, 35 bp, Artificial Sequence
  Synthetic oligonucleotide
gtgctcacgagggggggaagtagggtgacaggttt

SEQ ID NO: 197258 - DNA, 36 bp, Artificial Sequence
  Synthetic oligonucleotide
ggtcgaggtgggggtagggaagaagctcagcagaaa

SEQ ID NO: 197259 - DNA, 36 bp, Artificial Sequence
  Synthetic oligonucleotide
gcgacgcacgatattatcaccactgcccttccggaa

SEQ ID NO: 197260 - DNA, 35 bp, Artificial Sequence
  Synthetic oligonucleotide
gcctcacttgagcccctcctgttccatcttgttaa

SEQ ID NO: 197261 - DNA, 36 bp, Artificial Sequence
  Synthetic oligonucleotide
accagccgcatcggtctctatcgcgtttcatccaca

SEQ ID NO: 197262 - DNA, 36 bp, Artificial Sequence
  Synthetic oligonucleotide
ggtgggcggtggagcgggacggatagggtgggtaca

SEQ ID NO: 197263 - DNA, 36 bp, Artificial Sequence
  Synthetic oligonucleotide
aagtatgccccagccgctgtcgaagccccaattaca

SEQ ID NO: 197264 - DNA, 35 bp, Artificial Sequence
  Synthetic oligonucleotide
tagacggtcggccctgactcgcgctccttttacca

SEQ ID NO: 197265 - DNA, 36 bp, Artificial Sequence
  Synthetic oligonucleotide
aacctagccccaacgtgcacttctgaccctgcccca

SEQ ID NO: 197266 - DNA, 35 bp, Artificial Sequence
  Synthetic oligonucleotide
ttactcccgacccatgacttgtagcctgttcccca

SEQ ID NO: 197267 - DNA, 35 bp, Artificial Sequence
  Synthetic oligonucleotide
aaaagggtgggggtgatcgtacggggaaagagcca

SEQ ID NO: 197268 - DNA, 36 bp, Artificial Sequence
  Synthetic oligonucleotide
tacgcgacgaagttgtttcactcccctttactgcca

SEQ ID NO: 197269 - DNA, 36 bp, Artificial Sequence
  Synthetic oligonucleotide
ttcacccactatttattaacatcgccgctcctgcca

SEQ ID NO: 197270 - DNA, 35 bp, Artificial Sequence
  Synthetic oligonucleotide
tcaccattgccatttctgtcgcttcgcttattcca

SEQ ID NO: 197271 - DNA, 36 bp, Artificial Sequence
  Synthetic oligonucleotide
attccatccgtcggcctgggcctcagtaaccttcca

SEQ ID NO: 197272 - DNA, 36 bp, Artificial Sequence
  Synthetic oligonucleotide
agacgcacagtacatatattgtcccccttcctagca

SEQ ID NO: 197273 - DNA, 35 bp, Artificial Sequence
  Synthetic oligonucleotide
agcccgtctagtattatccgctccaccattttgca

SEQ ID NO: 197274 - DNA, 35 bp, Artificial Sequence
  Synthetic oligonucleotide
gtctatgccgtcccgccaccatctgttccatctca

SEQ ID NO: 197275 - DNA, 35 bp, Artificial Sequence
  Synthetic oligonucleotide
acaacccgaattgtgctcgtaacgtgttcctctca

SEQ ID NO: 197276 - DNA, 36 bp, Artificial Sequence
  Synthetic oligonucleotide
ggacaccaccctaactgcgtatcgatccatctctca

SEQ ID NO: 197277 - DNA, 36 bp, Artificial Sequence
  Synthetic oligonucleotide
tgcatgccaacagtcatttgcatactgcccttctca

SEQ ID NO: 197278 - DNA, 36 bp, Artificial Sequence
  Synthetic oligonucleotide
gttgacgtaggcttcttgaccctgttttcgttctca

SEQ ID NO: 197279 - DNA, 37 bp, Artificial Sequence
  Synthetic oligonucleotide
tcatagcacgtggagaagggggagggcgcatgggaga

SEQ ID NO: 197280 - DNA, 37 bp, Artificial Sequence
  Synthetic oligonucleotide
tacacctgcagtcgcccccaccgtgctccgccctaga

SEQ ID NO: 197281 - DNA, 37 bp, Artificial Sequence
  Synthetic oligonucleotide
tacgtgagggggagttagggaggaggcgattgttaga

SEQ ID NO: 197282 - DNA, 37 bp, Artificial Sequence
  Synthetic oligonucleotide
tgccgatgcaagtgcagtggagagaggggggggacga

SEQ ID NO: 197283 - DNA, 37 bp, Artificial Sequence
  Synthetic oligonucleotide
agacggaggtgggaaggagatgatggcggatggacga

SEQ ID NO: 197284 - DNA, 35 bp, Artificial Sequence
  Synthetic oligonucleotide
gttgctgggtgggcgggtcaagattggggatacga

SEQ ID NO: 197285 - DNA, 37 bp, Artificial Sequence
  Synthetic oligonucleotide
tgccccggtctttgttcacgctgcattgttccatcga

SEQ ID NO: 197286 - DNA, 37 bp, Artificial Sequence
  Synthetic oligonucleotide
gacacccgccactcgccccccgcagtcattaacagga

SEQ ID NO: 197287 - DNA, 37 bp, Artificial Sequence
  Synthetic oligonucleotide
tgactgacggtacgctataaagcacgggggaggggga

SEQ ID NO: 197288 - DNA, 37 bp, Artificial Sequence
  Synthetic oligonucleotide
gaccccgccattggcctcaagttcgtaatcccatgga

SEQ ID NO: 197289 - DNA, 36 bp, Artificial Sequence
  Synthetic oligonucleotide
ggtgccatctctgttccctgtcgaacccttcctgga

SEQ ID NO: 197290 - DNA, 37 bp, Artificial Sequence
  Synthetic oligonucleotide
acaagggtgacgataagggagggaagtgactggtgga

SEQ ID NO: 197291 - DNA, 37 bp, Artificial Sequence
  Synthetic oligonucleotide
aatgcccctctgccatgctatacagcatcctcttgga

SEQ ID NO: 197292 - DNA, 37 bp, Artificial Sequence
  Synthetic oligonucleotide
gaaagtggaggaaaggggtgggtagggagcctaatga

SEQ ID NO: 197293 - DNA, 36 bp, Artificial Sequence
  Synthetic oligonucleotide
gttacccctagctgaactctcttgctcttcacatga

SEQ ID NO: 197294 - DNA, 38 bp, Artificial Sequence
  Synthetic oligonucleotide
ggagatgtagggtgaggagggagggcacggtttgctga

SEQ ID NO: 197295 - DNA, 38 bp, Artificial Sequence
  Synthetic oligonucleotide
aactggtggagtggtaaagggcaaaggggggcatctga

SEQ ID NO: 197296 - DNA, 38 bp, Artificial Sequence
  Synthetic oligonucleotide
gcgtaaggggggggagggtgtaggcgcagtgaaagtga

SEQ ID NO: 197297 - DNA, 38 bp, Artificial Sequence
  Synthetic oligonucleotide
agacagggggatggggcggagtggggccgagtcagtga

SEQ ID NO: 197298 - DNA, 38 bp, Artificial Sequence
  Synthetic oligonucleotide
tagtccatgcctcgcttgttatacccctcccttagtga

SEQ ID NO: 197299 - DNA, 37 bp, Artificial Sequence
  Synthetic oligonucleotide
gcatccgctatcgtatcatcgccttccttttacgtga

SEQ ID NO: 197300 - DNA, 38 bp, Artificial Sequence
  Synthetic oligonucleotide
tgccacatcctccggtccaaacctgcctattatattga

SEQ ID NO: 197301 - DNA, 37 bp, Artificial Sequence
  Synthetic oligonucleotide
gttaacgtcgagcgtgtccctccctcttcttacttga

SEQ ID NO: 197302 - DNA, 38 bp, Artificial Sequence
  Synthetic oligonucleotide
acgagccctgtacatgcggtcctgttacattgccttga

SEQ ID NO: 197303 - DNA, 38 bp, Artificial Sequence
  Synthetic oligonucleotide
agccacccatatcgctatctcatcaacagccctcttga

SEQ ID NO: 197304 - DNA, 36 bp, Artificial Sequence
  Synthetic oligonucleotide
acgagagaggggggggttagaagccggtgaggttga

SEQ ID NO: 197305 - DNA, 36 bp, Artificial Sequence
  Synthetic oligonucleotide
gtcaccccccgtcgtacatagcaattgcaactttga

SEQ ID NO: 197306 - DNA, 35 bp, Artificial Sequence
  Synthetic oligonucleotide
gttacacgtccaccaatttcttcgtccgtctcata

SEQ ID NO: 197307 - DNA, 36 bp, Artificial Sequence
  Synthetic oligonucleotide
tctgcctctatccacactcgctgcagttctgcccta

SEQ ID NO: 197308 - DNA, 36 bp, Artificial Sequence
  Synthetic oligonucleotide
acctgtgggcacgtaccattgtccgatcatctccta

SEQ ID NO: 197309 - DNA, 36 bp, Artificial Sequence
  Synthetic oligonucleotide
actcatgtacgcccacatttacccaccagtatgcta

SEQ ID NO: 197310 - DNA, 35 bp, Artificial Sequence
  Synthetic oligonucleotide
gcaccggggggggagtaagtagggctaagtcggta

SEQ ID NO: 197311 - DNA, 35 bp, Artificial Sequence
  Synthetic oligonucleotide
tgccgtcacctgtcactgtcctggcgccccctgta

SEQ ID NO: 197312 - DNA, 34 bp, Artificial Sequence
  Synthetic oligonucleotide
acgccccttccatctgtatttttttttccttgta

SEQ ID NO: 197313 - DNA, 35 bp, Artificial Sequence
  Synthetic oligonucleotide
aatggagagggggggcggggagttgtgtaacctta

SEQ ID NO: 197314 - DNA, 36 bp, Artificial Sequence
  Synthetic oligonucleotide
agcacgccatctcctccgctgccaacccttggctta

SEQ ID NO: 197315 - DNA, 35 bp, Artificial Sequence
  Synthetic oligonucleotide
tctggacgacgggttaggcgggcaaggggaaggac

SEQ ID NO: 197316 - DNA, 35 bp, Artificial Sequence
  Synthetic oligonucleotide
gtagcgcctcctgctaacgacccgttttttattac

SEQ ID NO: 197317 - DNA, 35 bp, Artificial Sequence
  Synthetic oligonucleotide
acctcggctccaatgcctcctaatccgccagcacc

SEQ ID NO: 197318 - DNA, 35 bp, Artificial Sequence
  Synthetic oligonucleotide
tcactcctcgccctttgactatgacctgcccgacc

SEQ ID NO: 197319 - DNA, 35 bp, Artificial Sequence
  Synthetic oligonucleotide
aatcacgccactgagcactcttctcgaccaatacc

SEQ ID NO: 197320 - DNA, 35 bp, Artificial Sequence
  Synthetic oligonucleotide
gccgtcgcccccgttttggctattgctgatgtacc

SEQ ID NO: 197321 - DNA, 35 bp, Artificial Sequence
  Synthetic oligonucleotide
acacctgacgcccaatcctcaggatctttctaccc

SEQ ID NO: 197322 - DNA, 35 bp, Artificial Sequence
  Synthetic oligonucleotide
gcactgtagctctatttcacgggccgcgctccccc

SEQ ID NO: 197323 - DNA, 35 bp, Artificial Sequence
  Synthetic oligonucleotide
gctcgcgcagtagcaattaggcccctttgatcccc

SEQ ID NO: 197324 - DNA, 35 bp, Artificial Sequence
  Synthetic oligonucleotide
gcgccccccccagaaaacgtctaagtccaatgccc

SEQ ID NO: 197325 - DNA, 35 bp, Artificial Sequence
  Synthetic oligonucleotide
acgtatcgtgcggtgccttattatcgtcctttccc

SEQ ID NO: 197326 - DNA, 35 bp, Artificial Sequence
  Synthetic oligonucleotide
gcgtgcaccgggcagtactatgctcacacacctcc

SEQ ID NO: 197327 - DNA, 35 bp, Artificial Sequence
  Synthetic oligonucleotide
tcatccttccgtagttgccgtacgactgcccctcc

SEQ ID NO: 197328 - DNA, 35 bp, Artificial Sequence
  Synthetic oligonucleotide
tagccaggatgtcagtgcctcttgcccagtcctcc

SEQ ID NO: 197329 - DNA, 35 bp, Artificial Sequence
  Synthetic oligonucleotide
actccgccagacctcgcctctcatgtatgttctcc

SEQ ID NO: 197330 - DNA, 35 bp, Artificial Sequence
  Synthetic oligonucleotide
tcagcgcatgcaccctcctttcgtcgcggttgtcc

SEQ ID NO: 197331 - DNA, 35 bp, Artificial Sequence
  Synthetic oligonucleotide
tccatcccataatgtttccgaagtcctctccatgc

SEQ ID NO: 197332 - DNA, 35 bp, Artificial Sequence
  Synthetic oligonucleotide
atttcaccgcctatacgactttgacacagccctgc

SEQ ID NO: 197333 - DNA, 35 bp, Artificial Sequence
  Synthetic oligonucleotide
aacgacgaaagtacgccgacctctatcctgtcatc

SEQ ID NO: 197334 - DNA, 35 bp, Artificial Sequence
  Synthetic oligonucleotide
gtctgacactccgccttgtattccgactgccgatc

SEQ ID NO: 197335 - DNA, 35 bp, Artificial Sequence
  Synthetic oligonucleotide
ttgtcctgtgcccctcatgatccacgtgaatcctc

SEQ ID NO: 197336 - DNA, 35 bp, Artificial Sequence
  Synthetic oligonucleotide
agcgcacttgagccagagctccctcgctttctctc

SEQ ID NO: 197337 - DNA, 35 bp, Artificial Sequence
  Synthetic oligonucleotide
tgtggtcgctgtgtagtgctccttttcccgtagtc

SEQ ID NO: 197338 - DNA, 35 bp, Artificial Sequence
  Synthetic oligonucleotide
tcaaggagggttgggcgggaagcggaacaagggtc

SEQ ID NO: 197339 - DNA, 35 bp, Artificial Sequence
  Synthetic oligonucleotide
tagccatccatcttcctacgatcgtacctcctgtc

SEQ ID NO: 197340 - DNA, 35 bp, Artificial Sequence
  Synthetic oligonucleotide
gtgacgcatggtgttggcaccggtctacatctttc

SEQ ID NO: 197341 - DNA, 35 bp, Artificial Sequence
  Synthetic oligonucleotide
ttaccgtgcacagtacttggcctcattcacgtttc

SEQ ID NO: 197342 - DNA, 36 bp, Artificial Sequence
  Synthetic oligonucleotide
agtgcatgccatatatacttctgccgcccggttttc

SEQ ID NO: 197343 - DNA, 35 bp, Artificial Sequence
  Synthetic oligonucleotide
gtagggaacgagagaaagacgcaaggggcggacag

SEQ ID NO: 197344 - DNA, 36 bp, Artificial Sequence
  Synthetic oligonucleotide
atatgcgcataggtagggaggggggtcttgcctcag

SEQ ID NO: 197345 - DNA, 35 bp, Artificial Sequence
  Synthetic oligonucleotide
gagaccaggaggccggagaaaggcgggaatgcgag

SEQ ID NO: 197346 - DNA, 35 bp, Artificial Sequence
  Synthetic oligonucleotide
tccttgcactcccccatcttcgtactactgtaacg

SEQ ID NO: 197347 - DNA, 35 bp, Artificial Sequence
  Synthetic oligonucleotide
gaatcgacggataaggacaaaaagagagggacacg

SEQ ID NO: 197348 - DNA, 35 bp, Artificial Sequence
  Synthetic oligonucleotide
tagtgccccccgctgctatctctacgcgtcctacg

SEQ ID NO: 197349 - DNA, 35 bp, Artificial Sequence
  Synthetic oligonucleotide
gacgcgatcaccgtgtttcctcttactcctcgccg

SEQ ID NO: 197350 - DNA, 35 bp, Artificial Sequence
  Synthetic oligonucleotide
tgtcggtactgagctgttcttcctccttgtttgcg

SEQ ID NO: 197351 - DNA, 35 bp, Artificial Sequence
  Synthetic oligonucleotide
gaatggcgtagcggcggggataggtggtggaatcg

SEQ ID NO: 197352 - DNA, 35 bp, Artificial Sequence
  Synthetic oligonucleotide
gcgaacgccactaatctgttgtctcctcaatctcg

SEQ ID NO: 197353 - DNA, 35 bp, Artificial Sequence
  Synthetic oligonucleotide
ttataccgtcgcccggatcctagcccccgttctcg

SEQ ID NO: 197354 - DNA, 35 bp, Artificial Sequence
  Synthetic oligonucleotide
tcactagagggacagtgcaggagtggggggagggg

SEQ ID NO: 197355 - DNA, 35 bp, Artificial Sequence
  Synthetic oligonucleotide
ggagcatctgggagtggtaactgggggggatgggg

SEQ ID NO: 197356 - DNA, 35 bp, Artificial Sequence
  Synthetic oligonucleotide
gactaaggggctgcactgggagggctggactgggg

SEQ ID NO: 197357 - DNA, 35 bp, Artificial Sequence
  Synthetic oligonucleotide
gccccgcctcccttgtggttttatctcgccccgtg

SEQ ID NO: 197358 - DNA, 35 bp, Artificial Sequence
  Synthetic oligonucleotide
gatggttgaagtggggagatggaggggcaagcgat

SEQ ID NO: 197359 - DNA, 35 bp, Artificial Sequence
  Synthetic oligonucleotide
gccctcgcactttccgtgacctagccacattctat

SEQ ID NO: 197360 - DNA, 35 bp, Artificial Sequence
  Synthetic oligonucleotide
tcccccctcccggttaacaaagagtgaaaaacact

SEQ ID NO: 197361 - DNA, 35 bp, Artificial Sequence
  Synthetic oligonucleotide
agatcatccccgcctgctaagccactgctctacct

SEQ ID NO: 197362 - DNA, 35 bp, Artificial Sequence
  Synthetic oligonucleotide
gacgcctgactgcggattcctattttgatgcccct

SEQ ID NO: 197363 - DNA, 35 bp, Artificial Sequence
  Synthetic oligonucleotide
attcgcaagccatatcagtcctagccctgttccct

SEQ ID NO: 197364 - DNA, 35 bp, Artificial Sequence
  Synthetic oligonucleotide
agacgtgtccctccgcatatcatctgggcccgcct

SEQ ID NO: 197365 - DNA, 35 bp, Artificial Sequence
  Synthetic oligonucleotide
tacgcaccgcgagtttctgtccgctattacctcct

SEQ ID NO: 197366 - DNA, 35 bp, Artificial Sequence
  Synthetic oligonucleotide
tatgcaaacgcagctcttaattttcgggttccgct

SEQ ID NO: 197367 - DNA, 35 bp, Artificial Sequence
  Synthetic oligonucleotide
tatgttacgcgctccacctgcagttaaccgtatct

SEQ ID NO: 197368 - DNA, 35 bp, Artificial Sequence
  Synthetic oligonucleotide
gaccgcccacaatcaaagcacaacatcccttccgt

SEQ ID NO: 197369 - DNA, 35 bp, Artificial Sequence
  Synthetic oligonucleotide
tagcgcccatcggttcaggtttcatcatctcgggt

SEQ ID NO: 197370 - DNA, 33 bp, Artificial Sequence
  Synthetic oligonucleotide
atgaaaggggtagtggaggagtgggtccatggt

SEQ ID NO: 197371 - DNA, 35 bp, Artificial Sequence
  Synthetic oligonucleotide
gaaccctcgcgtctacggctcacacccattcttgt

SEQ ID NO: 197372 - DNA, 35 bp, Artificial Sequence
  Synthetic oligonucleotide
tttggcaccgctagtctggtaccatctgccaaatt

SEQ ID NO: 197373 - DNA, 35 bp, Artificial Sequence
  Synthetic oligonucleotide
atcgccatcctccatccgttttacatctcgcaatt

SEQ ID NO: 197374 - DNA, 31 bp, Artificial Sequence
  Synthetic oligonucleotide
agtgtccctccgtacggccccaaataacctt

SEQ ID NO: 197375 - DNA, 35 bp, Artificial Sequence
  Synthetic oligonucleotide
acccccgcgtaacagtcgttcccttcagtatcctt

SEQ ID NO: 197376 - DNA, 35 bp, Artificial Sequence
  Synthetic oligonucleotide
atgccacgcacctcccatgctgtccacttttcctt

SEQ ID NO: 197377 - DNA, 35 bp, Artificial Sequence
  Synthetic oligonucleotide
aagaaggagggcggccggggatggcgtggggagtt

SEQ ID NO: 197378 - DNA, 35 bp, Artificial Sequence
  Synthetic oligonucleotide
atacccccgccgtagaaactgttcacacttgattt

SEQ ID NO: 197379 - DNA, 35 bp, Artificial Sequence
  Synthetic oligonucleotide
acgcatggcatggcgttcagactcgcccttccttt

SEQ ID NO: 197380 - DNA, 36 bp, Artificial Sequence
  Synthetic oligonucleotide
tccacgcacagtctcggcacctctttgcatggcaaa

SEQ ID NO: 197381 - DNA, 36 bp, Artificial Sequence
  Synthetic oligonucleotide
gcatccccccagcgagtcgtcttgccacactttaaa

SEQ ID NO: 197382 - DNA, 36 bp, Artificial Sequence
  Synthetic oligonucleotide
tctacacctgcccagctctctactccatgtacccaa

SEQ ID NO: 197383 - DNA, 36 bp, Artificial Sequence
  Synthetic oligonucleotide
ttgggtaaccgaaggggggaggggagctcgcgagaa

SEQ ID NO: 197384 - DNA, 35 bp, Artificial Sequence
  Synthetic oligonucleotide
tgtcaagcccgtggggggaatgggggacgggttaa

SEQ ID NO: 197385 - DNA, 35 bp, Artificial Sequence
  Synthetic oligonucleotide
acaacgccctccccataatattaactgcgttcaca

SEQ ID NO: 197386 - DNA, 35 bp, Artificial Sequence
  Synthetic oligonucleotide
taccaccccctccccatcgcgcgtgacgagaccca

SEQ ID NO: 197387 - DNA, 35 bp, Artificial Sequence
  Synthetic oligonucleotide
gtccatcacatctatcttgcgcagacgcgttccca

SEQ ID NO: 197388 - DNA, 35 bp, Artificial Sequence
  Synthetic oligonucleotide
tcctcgcaccaccatagtcactagaactgatgcca

SEQ ID NO: 197389 - DNA, 35 bp, Artificial Sequence
  Synthetic oligonucleotide
tatctgtccccccacggctggtatgcgcttatcca

SEQ ID NO: 197390 - DNA, 36 bp, Artificial Sequence
  Synthetic oligonucleotide
aacagatcggcctaccatgtctattttgcgcctcca

SEQ ID NO: 197391 - DNA, 36 bp, Artificial Sequence
  Synthetic oligonucleotide
tcagcacccccaccgacttgttcatgccccagtcca

SEQ ID NO: 197392 - DNA, 35 bp, Artificial Sequence
  Synthetic oligonucleotide
tttgagcctcagacccgtttaccctgccgtccgca

SEQ ID NO: 197393 - DNA, 36 bp, Artificial Sequence
  Synthetic oligonucleotide
tacgggagagtggacagggtctgagggggaggtgca

SEQ ID NO: 197394 - DNA, 36 bp, Artificial Sequence
  Synthetic oligonucleotide
tccgtagccacgccgtgagcaccccgcttcattgca

SEQ ID NO: 197395 - DNA, 34 bp, Artificial Sequence
  Synthetic oligonucleotide
aaagggggggggggcgagtgctacagggtcatca

SEQ ID NO: 197396 - DNA, 36 bp, Artificial Sequence
  Synthetic oligonucleotide
agcctgccctgtccgttcctctcgcggatttcatca

SEQ ID NO: 197397 - DNA, 36 bp, Artificial Sequence
  Synthetic oligonucleotide
ttgcgacccgcactaagtgcccatagcccatattca

SEQ ID NO: 197398 - DNA, 35 bp, Artificial Sequence
  Synthetic oligonucleotide
gatgacgtatcgcctggtgtcctgtccgctcttca

SEQ ID NO: 197399 - DNA, 37 bp, Artificial Sequence
  Synthetic oligonucleotide
gtggagggggcaacgggtgttaggcgtggatgaaaga

SEQ ID NO: 197400 - DNA, 37 bp, Artificial Sequence
  Synthetic oligonucleotide
gcgcggtaagaagggggggcgggatgcagggtaaaga

SEQ ID NO: 197401 - DNA, 37 bp, Artificial Sequence
  Synthetic oligonucleotide
tgcggagaaaagcaggggaggtgcgggcgcgataaga

SEQ ID NO: 197402 - DNA, 37 bp, Artificial Sequence
  Synthetic oligonucleotide
aagtggggaggatggggattcaaggggcatggtaaga

SEQ ID NO: 197403 - DNA, 36 bp, Artificial Sequence
  Synthetic oligonucleotide
tgcgggggaacttaagggcatggggggcacaagaga

SEQ ID NO: 197404 - DNA, 36 bp, Artificial Sequence
  Synthetic oligonucleotide
aagcgggtcacccggtttacacctgcccatccacga

SEQ ID NO: 197405 - DNA, 37 bp, Artificial Sequence
  Synthetic oligonucleotide
ggttatgcctccgtctcctgtcccagcactcctacga

SEQ ID NO: 197406 - DNA, 37 bp, Artificial Sequence
  Synthetic oligonucleotide
atcaacgtcgacgttttgcattcaatccgcctcccga

SEQ ID NO: 197407 - DNA, 35 bp, Artificial Sequence
  Synthetic oligonucleotide
gtgccgccccgccttactatgagttcccgtcccga

SEQ ID NO: 197408 - DNA, 35 bp, Artificial Sequence
  Synthetic oligonucleotide
gtgagcgggaagattcgaggagggaagggggccga

SEQ ID NO: 197409 - DNA, 37 bp, Artificial Sequence
  Synthetic oligonucleotide
tgttccaccgctttcttctctaaggcgaccatgccga

SEQ ID NO: 197410 - DNA, 35 bp, Artificial Sequence
  Synthetic oligonucleotide
agttgctacggctgggggtggaagggggtgggcga

SEQ ID NO: 197411 - DNA, 37 bp, Artificial Sequence
  Synthetic oligonucleotide
ggttcaggaagaccgggaagggggcaaggagtggcga

SEQ ID NO: 197412 - DNA, 37 bp, Artificial Sequence
  Synthetic oligonucleotide
gccttgcaccatcacgcatataatagtttcttctcga

SEQ ID NO: 197413 - DNA, 37 bp, Artificial Sequence
  Synthetic oligonucleotide
gttgccaaccgcttatgtcgccatcaatcttcttcga

SEQ ID NO: 197414 - DNA, 36 bp, Artificial Sequence
  Synthetic oligonucleotide
tcagagaggggcggtaggagggagaggcttgtagga

SEQ ID NO: 197415 - DNA, 37 bp, Artificial Sequence
  Synthetic oligonucleotide
gcgcactgtaacgccctatcccgtgccattctacgga

SEQ ID NO: 197416 - DNA, 37 bp, Artificial Sequence
  Synthetic oligonucleotide
aaaagcggcaatcaataagggcgaggcgggaggcgga

SEQ ID NO: 197417 - DNA, 37 bp, Artificial Sequence
  Synthetic oligonucleotide
gaggggatcggaagggggcgtaggcatgctaggcgga

SEQ ID NO: 197418 - DNA, 37 bp, Artificial Sequence
  Synthetic oligonucleotide
gccccaatcgtccagcactagctcccgtaccatcgga

SEQ ID NO: 197419 - DNA, 37 bp, Artificial Sequence
  Synthetic oligonucleotide
tgtgataacgctcagggcgggaggggaccgacaggga

SEQ ID NO: 197420 - DNA, 37 bp, Artificial Sequence
  Synthetic oligonucleotide
atggggtaccgaggggactactcttgaagggagggga

SEQ ID NO: 197421 - DNA, 36 bp, Artificial Sequence
  Synthetic oligonucleotide
tgcccaaggagacggtggaaagggtggtcgggggga

SEQ ID NO: 197422 - DNA, 36 bp, Artificial Sequence
  Synthetic oligonucleotide
tcaccaacttccgccatgtctttttccccactggga

SEQ ID NO: 197423 - DNA, 37 bp, Artificial Sequence
  Synthetic oligonucleotide
gaccatccactatcgttgttttcatcccgtcttggga

SEQ ID NO: 197424 - DNA, 37 bp, Artificial Sequence
  Synthetic oligonucleotide
gcacacgcgaatatgtgttcccttccgctccaactga

SEQ ID NO: 197425 - DNA, 38 bp, Artificial Sequence
  Synthetic oligonucleotide
gacacgcgccatatcagccttttcccccgtcttactga

SEQ ID NO: 197426 - DNA, 38 bp, Artificial Sequence
  Synthetic oligonucleotide
gttcactacgcgctgtcaataccctccgccacacctga

SEQ ID NO: 197427 - DNA, 37 bp, Artificial Sequence
  Synthetic oligonucleotide
atgcaccatgccgcctttgtttgcgcttcccacctga

SEQ ID NO: 197428 - DNA, 37 bp, Artificial Sequence
  Synthetic oligonucleotide
accgtcggatggctgcttctcctcgccgtccacttga

SEQ ID NO: 197429 - DNA, 37 bp, Artificial Sequence
  Synthetic oligonucleotide
taccgcacccatcttacatgcgccatttatgccttga

SEQ ID NO: 197430 - DNA, 36 bp, Artificial Sequence
  Synthetic oligonucleotide
gccacgccagtgcaattcctcgtggttccccctata

SEQ ID NO: 197431 - DNA, 36 bp, Artificial Sequence
  Synthetic oligonucleotide
tccgaagctccggtttattctgcgctccattaccta

SEQ ID NO: 197432 - DNA, 36 bp, Artificial Sequence
  Synthetic oligonucleotide
gtagccacatagtttcgactctcctgccatgtccta

SEQ ID NO: 197433 - DNA, 36 bp, Artificial Sequence
  Synthetic oligonucleotide
gactcatcgcgcttacccataggctgtcctttgcta

SEQ ID NO: 197434 - DNA, 36 bp, Artificial Sequence
  Synthetic oligonucleotide
tgtgcctcgctctgtcgaccctccgtccctcttgta

SEQ ID NO: 197435 - DNA, 36 bp, Artificial Sequence
  Synthetic oligonucleotide
tgagagggatcggataaggtgcatggggggaggtta

SEQ ID NO: 197436 - DNA, 35 bp, Artificial Sequence
  Synthetic oligonucleotide
agacggtgtgctcctgccgtttctttcgtccttta

SEQ ID NO: 197437 - DNA, 35 bp, Artificial Sequence
  Synthetic oligonucleotide
gccgcgtgcaggtctacgctccaccgtttcgccac

SEQ ID NO: 197438 - DNA, 35 bp, Artificial Sequence
  Synthetic oligonucleotide
gccggacgcattgtgttcttccaccattatcgcac

SEQ ID NO: 197439 - DNA, 35 bp, Artificial Sequence
  Synthetic oligonucleotide
ttcggaggccgtcgtttctacctagctcttttcac

SEQ ID NO: 197440 - DNA, 35 bp, Artificial Sequence
  Synthetic oligonucleotide
acactctccagcctcactcgctgactgtttactac

SEQ ID NO: 197441 - DNA, 35 bp, Artificial Sequence
  Synthetic oligonucleotide
gccgatcaccccccagtccggtcaccagttattac

SEQ ID NO: 197442 - DNA, 35 bp, Artificial Sequence
  Synthetic oligonucleotide
actccactctccgagaatgaggtttgcccccttac

SEQ ID NO: 197443 - DNA, 35 bp, Artificial Sequence
  Synthetic oligonucleotide
ttaggcgccccgccgctttcaggtgccctgccacc

SEQ ID NO: 197444 - DNA, 34 bp, Artificial Sequence
  Synthetic oligonucleotide
tacgcacgacctattctatcatatttcgtagccc

SEQ ID NO: 197445 - DNA, 35 bp, Artificial Sequence
  Synthetic oligonucleotide
atcgcacacgtaatacgccttaagccgcacccgcc

SEQ ID NO: 197446 - DNA, 35 bp, Artificial Sequence
  Synthetic oligonucleotide
gcttgctgccagtctgtcagatactcttcatcgcc

SEQ ID NO: 197447 - DNA, 35 bp, Artificial Sequence
  Synthetic oligonucleotide
gtccgtctatgtcatattgcccgtttccttatgcc

SEQ ID NO: 197448 - DNA, 35 bp, Artificial Sequence
  Synthetic oligonucleotide
gaccatcggtcgagttcttgtcttcatgcactgcc

SEQ ID NO: 197449 - DNA, 35 bp, Artificial Sequence
  Synthetic oligonucleotide
gacacctgaactgtaagctacggataccccttgcc

SEQ ID NO: 197450 - DNA, 35 bp, Artificial Sequence
  Synthetic oligonucleotide
tacgaacctccgacgacactataaacgtacgatcc

SEQ ID NO: 197451 - DNA, 35 bp, Artificial Sequence
  Synthetic oligonucleotide
tgactgctacgtcacgtcactcgttccacctgtcc

SEQ ID NO: 197452 - DNA, 35 bp, Artificial Sequence
  Synthetic oligonucleotide
atcgagtgctcaagatatatttacccgtccctcgc

SEQ ID NO: 197453 - DNA, 35 bp, Artificial Sequence
  Synthetic oligonucleotide
ggttgtgcatccgaccgcatacgctcacttcctgc

SEQ ID NO: 197454 - DNA, 35 bp, Artificial Sequence
  Synthetic oligonucleotide
tctgttcactcgcatatcgtcacctattagccatc

SEQ ID NO: 197455 - DNA, 35 bp, Artificial Sequence
  Synthetic oligonucleotide
gcaccgagtggttccgccattccatgcaccttatc

SEQ ID NO: 197456 - DNA, 35 bp, Artificial Sequence
  Synthetic oligonucleotide
agcccatgcctccattattctcggttacatgcctc

SEQ ID NO: 197457 - DNA, 35 bp, Artificial Sequence
  Synthetic oligonucleotide
gtcacgtgctcttgccactctccgccatattcctc

SEQ ID NO: 197458 - DNA, 35 bp, Artificial Sequence
  Synthetic oligonucleotide
tccagcacatgctggttcgatccgtttcttatctc

SEQ ID NO: 197459 - DNA, 35 bp, Artificial Sequence
  Synthetic oligonucleotide
tacgatctgcctacattgcaattgcctacttggtc

SEQ ID NO: 197460 - DNA, 35 bp, Artificial Sequence
  Synthetic oligonucleotide
tctacaccgtcacttggcccgaccagttccctgtc

SEQ ID NO: 197461 - DNA, 35 bp, Artificial Sequence
  Synthetic oligonucleotide
acgctccacatgtccatccatcggtctgttccttc

SEQ ID NO: 197462 - DNA, 35 bp, Artificial Sequence
  Synthetic oligonucleotide
ttaaggggagaagaaggatgtagcgatagcagcag

SEQ ID NO: 197463 - DNA, 35 bp, Artificial Sequence
  Synthetic oligonucleotide
tgcatgcccccccgccgcgtttccggatgctaacg

SEQ ID NO: 197464 - DNA, 35 bp, Artificial Sequence
  Synthetic oligonucleotide
atatgtcccacctatcttgctccctgttttgtacg

SEQ ID NO: 197465 - DNA, 35 bp, Artificial Sequence
  Synthetic oligonucleotide
gcgaggagcacagggtgtctgcttattcctccccg

SEQ ID NO: 197466 - DNA, 35 bp, Artificial Sequence
  Synthetic oligonucleotide
gttctccgcgcgctaccaccccactcctgagttcg

SEQ ID NO: 197467 - DNA, 35 bp, Artificial Sequence
  Synthetic oligonucleotide
gcatcaccgatgtcccaatgccctggttagtttcg

SEQ ID NO: 197468 - DNA, 35 bp, Artificial Sequence
  Synthetic oligonucleotide
tccgcccatcctgctctgtcagccgcttaccaagg

SEQ ID NO: 197469 - DNA, 35 bp, Artificial Sequence
  Synthetic oligonucleotide
tgatcacacgtacacgaaggaggggatggaacggg

SEQ ID NO: 197470 - DNA, 35 bp, Artificial Sequence
  Synthetic oligonucleotide
tgcaagaggaggggagaaggaaaggtacggagtgg

SEQ ID NO: 197471 - DNA, 35 bp, Artificial Sequence
  Synthetic oligonucleotide
gtgggaggcgggcatgggtctgaaatgcggtgatg

SEQ ID NO: 197472 - DNA, 35 bp, Artificial Sequence
  Synthetic oligonucleotide
tcctcaccacccctcgaggaccacaagtattactg

SEQ ID NO: 197473 - DNA, 35 bp, Artificial Sequence
  Synthetic oligonucleotide
tcaacaccccccgccttatgtactgccgatctctg

SEQ ID NO: 197474 - DNA, 35 bp, Artificial Sequence
  Synthetic oligonucleotide
tccacctcaggttgcctcaaccccgttatgccttg

SEQ ID NO: 197475 - DNA, 35 bp, Artificial Sequence
  Synthetic oligonucleotide
tcacgactccctctgcctccgccatcatgctcttg

SEQ ID NO: 197476 - DNA, 35 bp, Artificial Sequence
  Synthetic oligonucleotide
aactacctccgaacgatcgcgtgagccttgaacat

SEQ ID NO: 197477 - DNA, 35 bp, Artificial Sequence
  Synthetic oligonucleotide
attccccaatgcgtcccattccagtcacgttccat

SEQ ID NO: 197478 - DNA, 35 bp, Artificial Sequence
  Synthetic oligonucleotide
acccatgcgtcgacgccgcgccccattcgccacct

SEQ ID NO: 197479 - DNA, 35 bp, Artificial Sequence
  Synthetic oligonucleotide
tgggagctcagacccgccttccccttgagtcccct

SEQ ID NO: 197480 - DNA, 35 bp, Artificial Sequence
  Synthetic oligonucleotide
gacgctgcgttttagctgcgtcgtctaattcccct

SEQ ID NO: 197481 - DNA, 35 bp, Artificial Sequence
  Synthetic oligonucleotide
acagagctttgctccgttgacctcgcccttgccct

SEQ ID NO: 197482 - DNA, 35 bp, Artificial Sequence
  Synthetic oligonucleotide
gtgcgcatcgggtgctcctccgcaggtcccttcct

SEQ ID NO: 197483 - DNA, 35 bp, Artificial Sequence
  Synthetic oligonucleotide
gtcaggctgcccctcttgtctactccccttttcct

SEQ ID NO: 197484 - DNA, 35 bp, Artificial Sequence
  Synthetic oligonucleotide
tagacgccggatgtcctcattgccgcgctatctct

SEQ ID NO: 197485 - DNA, 35 bp, Artificial Sequence
  Synthetic oligonucleotide
gtggaggggggcgagtagtgacgacggtagggagt

SEQ ID NO: 197486 - DNA, 35 bp, Artificial Sequence
  Synthetic oligonucleotide
ttgcgcctcacgtttggcctgcattattcgcctgt

SEQ ID NO: 197487 - DNA, 35 bp, Artificial Sequence
  Synthetic oligonucleotide
tgaccacacacccattgctattcgtgcaccattgt

SEQ ID NO: 197488 - DNA, 35 bp, Artificial Sequence
  Synthetic oligonucleotide
gggtggccgctggtcccataatcagcctgctcctt

SEQ ID NO: 197489 - DNA, 36 bp, Artificial Sequence
  Synthetic oligonucleotide
taacgtgcccttcattgcctgtccgtcccagtattt

SEQ ID NO: 197490 - DNA, 36 bp, Artificial Sequence
  Synthetic oligonucleotide
gcaaccacgccaggtctcccccgcctacttatacaa

SEQ ID NO: 197491 - DNA, 36 bp, Artificial Sequence
  Synthetic oligonucleotide
atgtgccgtcctcgctatatcccgccttctccataa

SEQ ID NO: 197492 - DNA, 35 bp, Artificial Sequence
  Synthetic oligonucleotide
tccaccatccgttacctgtcctgtccctgtagtaa

SEQ ID NO: 197493 - DNA, 36 bp, Artificial Sequence
  Synthetic oligonucleotide
gactctgcctgctgccacacgtacaggtcctcttaa

SEQ ID NO: 197494 - DNA, 35 bp, Artificial Sequence
  Synthetic oligonucleotide
gcgagtgagacgatggggggagatatgggcgaaca

SEQ ID NO: 197495 - DNA, 36 bp, Artificial Sequence
  Synthetic oligonucleotide
accactccccatacgtttaggcgtgtccaccgcaca

SEQ ID NO: 197496 - DNA, 35 bp, Artificial Sequence
  Synthetic oligonucleotide
gcctgggcgggcgggataacgtcgatttagggaca

SEQ ID NO: 197497 - DNA, 35 bp, Artificial Sequence
  Synthetic oligonucleotide
tcctgccacgatcgatttctccctgcctctgtaca

SEQ ID NO: 197498 - DNA, 36 bp, Artificial Sequence
  Synthetic oligonucleotide
tgaggaccgcccaccatcatcttaagtcagtgtaca

SEQ ID NO: 197499 - DNA, 36 bp, Artificial Sequence
  Synthetic oligonucleotide
gccagtccgccctccatgaatcagcgcttcttacca

SEQ ID NO: 197500 - DNA, 36 bp, Artificial Sequence
  Synthetic oligonucleotide
tgtgcatcaccagcacccccctcgagtctctcgcca

SEQ ID NO: 197501 - DNA, 36 bp, Artificial Sequence
  Synthetic oligonucleotide
aacgatagccggggggggaaagaagctgatgtgcca

SEQ ID NO: 197502 - DNA, 36 bp, Artificial Sequence
  Synthetic oligonucleotide
tgccatcgcatttttatctgcctatacgaacctcca

SEQ ID NO: 197503 - DNA, 36 bp, Artificial Sequence
  Synthetic oligonucleotide
tgtgtgcgggatggggagggagatcatgggttcgca

SEQ ID NO: 197504 - DNA, 36 bp, Artificial Sequence
  Synthetic oligonucleotide
tagatacgctgcatgtgtaccgcccgcccgccatca

SEQ ID NO: 197505 - DNA, 37 bp, Artificial Sequence
  Synthetic oligonucleotide
tgtgcgagtaggcggggagggagggaaggttctaaga

SEQ ID NO: 197506 - DNA, 37 bp, Artificial Sequence
  Synthetic oligonucleotide
gcagggagggggggggtatacaatcacgattgggaga

SEQ ID NO: 197507 - DNA, 37 bp, Artificial Sequence
  Synthetic oligonucleotide
tgcctgatcgatctatcgcgtacttcctcttactaga

SEQ ID NO: 197508 - DNA, 37 bp, Artificial Sequence
  Synthetic oligonucleotide
tgcaaaaaggggaggacggggcaggccggaagctaga

SEQ ID NO: 197509 - DNA, 37 bp, Artificial Sequence
  Synthetic oligonucleotide
accaccccaccgcgcaacgtgcttaattcctgtacga

SEQ ID NO: 197510 - DNA, 35 bp, Artificial Sequence
  Synthetic oligonucleotide
tcatgcgtcgccacgttctgctcttcatctcccga

SEQ ID NO: 197511 - DNA, 37 bp, Artificial Sequence
  Synthetic oligonucleotide
tcatgtccctcaggtcaatttctgactatcgtgccga

SEQ ID NO: 197512 - DNA, 35 bp, Artificial Sequence
  Synthetic oligonucleotide
atgtccacggcccgtatcgcttgactaccctccga

SEQ ID NO: 197513 - DNA, 36 bp, Artificial Sequence
  Synthetic oligonucleotide
tagggggggaggtcgaggaaggatgtaggcgcgcga

SEQ ID NO: 197514 - DNA, 37 bp, Artificial Sequence
  Synthetic oligonucleotide
tattctccacgctgcaccttttccgtcgcttggcgga

SEQ ID NO: 197515 - DNA, 37 bp, Artificial Sequence
  Synthetic oligonucleotide
tgaaaggtgggaaaggggctgaagggaagggtgcgga

SEQ ID NO: 197516 - DNA, 37 bp, Artificial Sequence
  Synthetic oligonucleotide
actacctccccccacccatgctggtatcatacaggga

SEQ ID NO: 197517 - DNA, 36 bp, Artificial Sequence
  Synthetic oligonucleotide
tgcaaggtaggtgggagagagggggagacttaggga

SEQ ID NO: 197518 - DNA, 37 bp, Artificial Sequence
  Synthetic oligonucleotide
tcacacccacaggtctgccctacactcccacgcggga

SEQ ID NO: 197519 - DNA, 37 bp, Artificial Sequence
  Synthetic oligonucleotide
gcgagcactctgggagggcggggtttacaggcgggga

SEQ ID NO: 197520 - DNA, 35 bp, Artificial Sequence
  Synthetic oligonucleotide
ttctgcccactatcctcaccaccgcttcctttgga

SEQ ID NO: 197521 - DNA, 37 bp, Artificial Sequence
  Synthetic oligonucleotide
atggacaggagggggtgctagtggggagccgggatga

SEQ ID NO: 197522 - DNA, 38 bp, Artificial Sequence
  Synthetic oligonucleotide
gattattgcctctcgttgtaccaccttccagtctatga

SEQ ID NO: 197523 - DNA, 38 bp, Artificial Sequence
  Synthetic oligonucleotide
gtcggacgtggtggggggcaaagggagagagagtatga

SEQ ID NO: 197524 - DNA, 38 bp, Artificial Sequence
  Synthetic oligonucleotide
acaccacccagcgtgttcgcgccttttccacattatga

SEQ ID NO: 197525 - DNA, 38 bp, Artificial Sequence
  Synthetic oligonucleotide
atcacgctgtcaacttcgtgattttgccttccttatga

SEQ ID NO: 197526 - DNA, 38 bp, Artificial Sequence
  Synthetic oligonucleotide
actggaacgggggacgggtgggggaaatgtaacactga

SEQ ID NO: 197527 - DNA, 37 bp, Artificial Sequence
  Synthetic oligonucleotide
ttccgccccaggcctatcaacctaccgttctacctga

SEQ ID NO: 197528 - DNA, 38 bp, Artificial Sequence
  Synthetic oligonucleotide
aacgaagacaagtaggatagtgggggaaacggcgctga

SEQ ID NO: 197529 - DNA, 38 bp, Artificial Sequence
  Synthetic oligonucleotide
agtcaactatgcagcgctgtcctcctgctccactctga

SEQ ID NO: 197530 - DNA, 38 bp, Artificial Sequence
  Synthetic oligonucleotide
tcacacactgacctgccctgttactgacacttcagtga

SEQ ID NO: 197531 - DNA, 36 bp, Artificial Sequence
  Synthetic oligonucleotide
catggaagaaagcaggacggggtgaggagggggtga

SEQ ID NO: 197532 - DNA, 36 bp, Artificial Sequence
  Synthetic oligonucleotide
atgcccaccgctggctattcttcattgcacacttga

SEQ ID NO: 197533 - DNA, 37 bp, Artificial Sequence
  Synthetic oligonucleotide
tatggacacccctgctgtgcctggacccccttcttga

SEQ ID NO: 197534 - DNA, 36 bp, Artificial Sequence
  Synthetic oligonucleotide
gccacgtcctgcacagcgttagttatcttacctcta

SEQ ID NO: 197535 - DNA, 36 bp, Artificial Sequence
  Synthetic oligonucleotide
gtccccccgcatcttaacgagcctcgtatatttcta

SEQ ID NO: 197536 - DNA, 35 bp, Artificial Sequence
  Synthetic oligonucleotide
agaacgatgggagctgggagtagtggtgtagcgta

SEQ ID NO: 197537 - DNA, 34 bp, Artificial Sequence
  Synthetic oligonucleotide
gcgctcccctctcttcgcatatgtcgcgtggtta

SEQ ID NO: 197538 - DNA, 35 bp, Artificial Sequence
  Synthetic oligonucleotide
gagaccacacacctaagcatatggctccgttccac

SEQ ID NO: 197539 - DNA, 35 bp, Artificial Sequence
  Synthetic oligonucleotide
tgttcaactggctttgtcttcacactctcttcgac

SEQ ID NO: 197540 - DNA, 35 bp, Artificial Sequence
  Synthetic oligonucleotide
gacaaacaggggtagcggggcgggaacgaatatac

SEQ ID NO: 197541 - DNA, 35 bp, Artificial Sequence
  Synthetic oligonucleotide
gccaagtggctgctacgtagttatcccccgcctac

SEQ ID NO: 197542 - DNA, 35 bp, Artificial Sequence
  Synthetic oligonucleotide
gtttccccgtcagatttcttccgtcccctgtcacc

SEQ ID NO: 197543 - DNA, 35 bp, Artificial Sequence
  Synthetic oligonucleotide
atgccacccaacgatagttatctcgcggattcacc

SEQ ID NO: 197544 - DNA, 33 bp, Artificial Sequence
  Synthetic oligonucleotide
tgtgcatccccccccccgctgattgcgtaaccc

SEQ ID NO: 197545 - DNA, 35 bp, Artificial Sequence
  Synthetic oligonucleotide
accacatcatctacacatttgggcgcttacacccc

SEQ ID NO: 197546 - DNA, 34 bp, Artificial Sequence
  Synthetic oligonucleotide
aactagcactccgtctacctttggtccagttccc

SEQ ID NO: 197547 - DNA, 35 bp, Artificial Sequence
  Synthetic oligonucleotide
tcattgcccccccgccgacacatggttactttccc

SEQ ID NO: 197548 - DNA, 35 bp, Artificial Sequence
  Synthetic oligonucleotide
gtgcgtgtatgaactgtccctcactcgtttcagcc

SEQ ID NO: 197549 - DNA, 35 bp, Artificial Sequence
  Synthetic oligonucleotide
tgtggccaccgaactgttttctcgcccgtaccgcc

SEQ ID NO: 197550 - DNA, 35 bp, Artificial Sequence
  Synthetic oligonucleotide
gacgatcgtcgtctacagctccgcgcccgtccgcc

SEQ ID NO: 197551 - DNA, 34 bp, Artificial Sequence
  Synthetic oligonucleotide
tacacagatgttgccgtcgaccttgattacccgc

SEQ ID NO: 197552 - DNA, 35 bp, Artificial Sequence
  Synthetic oligonucleotide
gtgcaccgcacgtaatacctcgatgcatacgccgc

SEQ ID NO: 197553 - DNA, 35 bp, Artificial Sequence
  Synthetic oligonucleotide
gatcccgacaactccatttccacctgctcattcgc

SEQ ID NO: 197554 - DNA, 35 bp, Artificial Sequence
  Synthetic oligonucleotide
gtttcccgccgtcaactccttgcttaattctctgc

SEQ ID NO: 197555 - DNA, 35 bp, Artificial Sequence
  Synthetic oligonucleotide
gcgtagtgcagtatctcctccgcgctggttgttgc

SEQ ID NO: 197556 - DNA, 34 bp, Artificial Sequence
  Synthetic oligonucleotide
atccccgcccgacccgcgctttaactagctttgc

SEQ ID NO: 197557 - DNA, 35 bp, Artificial Sequence
  Synthetic oligonucleotide
actgtctcactccctcatggtcatcatggacaatc

SEQ ID NO: 197558 - DNA, 35 bp, Artificial Sequence
  Synthetic oligonucleotide
ggagctcaactcgcccggccgcttttcgttacatc

SEQ ID NO: 197559 - DNA, 35 bp, Artificial Sequence
  Synthetic oligonucleotide
gcgacatttcctcacatctatttatagtctccctc

SEQ ID NO: 197560 - DNA, 35 bp, Artificial Sequence
  Synthetic oligonucleotide
gtacaccgctcctgggtccaatcgctccatctctc

SEQ ID NO: 197561 - DNA, 35 bp, Artificial Sequence
  Synthetic oligonucleotide
agctccaaccacggtaatgcctcttcttcggagtc

SEQ ID NO: 197562 - DNA, 35 bp, Artificial Sequence
  Synthetic oligonucleotide
gtgtgcccgtccgtcgtttgtcccttgttatcgtc

SEQ ID NO: 197563 - DNA, 34 bp, Artificial Sequence
  Synthetic oligonucleotide
agtcgcctcttgcctctaagtaacatcctgggtc

SEQ ID NO: 197564 - DNA, 35 bp, Artificial Sequence
  Synthetic oligonucleotide
tctgaaccatcttgcggttacactctctgccattc

SEQ ID NO: 197565 - DNA, 35 bp, Artificial Sequence
  Synthetic oligonucleotide
attccagaagggagaggggggcaatgacagggttc

SEQ ID NO: 197566 - DNA, 35 bp, Artificial Sequence
  Synthetic oligonucleotide
tagaacgcgtccacccaatcgccgtctgttttttc

SEQ ID NO: 197567 - DNA, 35 bp, Artificial Sequence
  Synthetic oligonucleotide
gaagggaggggcgggagggataggttctaagacag

SEQ ID NO: 197568 - DNA, 35 bp, Artificial Sequence
  Synthetic oligonucleotide
tattgccccagcctccccccttttagctacacgag

SEQ ID NO: 197569 - DNA, 35 bp, Artificial Sequence
  Synthetic oligonucleotide
actagacacgtcagcactcccaataccctcctgcg

SEQ ID NO: 197570 - DNA, 35 bp, Artificial Sequence
  Synthetic oligonucleotide
gcacgtctgtccgcactcccgatcgccttccctcg

SEQ ID NO: 197571 - DNA, 35 bp, Artificial Sequence
  Synthetic oligonucleotide
gaagcgatgcatcaagctcagtccacccatcttcg

SEQ ID NO: 197572 - DNA, 35 bp, Artificial Sequence
  Synthetic oligonucleotide
gatgggaaggggtggggagacagggcggggcaggg

SEQ ID NO: 197573 - DNA, 35 bp, Artificial Sequence
  Synthetic oligonucleotide
acgccacgcctacgctttactcagtgtctaccctg

SEQ ID NO: 197574 - DNA, 35 bp, Artificial Sequence
  Synthetic oligonucleotide
tacgacggccatgatctaattatccttcccctctg

SEQ ID NO: 197575 - DNA, 35 bp, Artificial Sequence
  Synthetic oligonucleotide
taccgctccctccttgtcccccgcactcatttctg

SEQ ID NO: 197576 - DNA, 35 bp, Artificial Sequence
  Synthetic oligonucleotide
gtcacggccatctgagtcttcggccttttacacat

SEQ ID NO: 197577 - DNA, 35 bp, Artificial Sequence
  Synthetic oligonucleotide
gatgtgggggggtggacgaggtcataggtcaagat

SEQ ID NO: 197578 - DNA, 35 bp, Artificial Sequence
  Synthetic oligonucleotide
gcacaagtgacgtgtatttccccctgtcgctctat

SEQ ID NO: 197579 - DNA, 35 bp, Artificial Sequence
  Synthetic oligonucleotide
acgctgaagccgcgctgtgccttatcctccagcct

SEQ ID NO: 197580 - DNA, 35 bp, Artificial Sequence
  Synthetic oligonucleotide
gtcccatcgcaccagtactgcatctgtggctttct

SEQ ID NO: 197581 - DNA, 36 bp, Artificial Sequence
  Synthetic oligonucleotide
acaccaacgtacaaacgtcgatcgctcccccgcagt

SEQ ID NO: 197582 - DNA, 35 bp, Artificial Sequence
  Synthetic oligonucleotide
tcgacgggttagtcagtgttctccgccccccacgt

SEQ ID NO: 197583 - DNA, 35 bp, Artificial Sequence
  Synthetic oligonucleotide
tagccggagtcgcaagttccatctggccatacctt

SEQ ID NO: 197584 - DNA, 35 bp, Artificial Sequence
  Synthetic oligonucleotide
accacccggtgggtgacagtttatttaccatcctt

SEQ ID NO: 197585 - DNA, 35 bp, Artificial Sequence
  Synthetic oligonucleotide
gcactacaatcgctgctttccgttcctgatttctt

SEQ ID NO: 197586 - DNA, 35 bp, Artificial Sequence
  Synthetic oligonucleotide
tgccgcttagcctttaagttcaaccttccaccgtt

SEQ ID NO: 197587 - DNA, 35 bp, Artificial Sequence
  Synthetic oligonucleotide
agtgacccatcagcagagccggctactccccattt

SEQ ID NO: 197588 - DNA, 35 bp, Artificial Sequence
  Synthetic oligonucleotide
aattcgcgagcgcctaggtcacgctcctcccgttt

SEQ ID NO: 197589 - DNA, 35 bp, Artificial Sequence
  Synthetic oligonucleotide
atccgaagtgaagggagggtgggatggaagggaaa

SEQ ID NO: 197590 - DNA, 36 bp, Artificial Sequence
  Synthetic oligonucleotide
gacacagggagcaaagaaggggcgcgtgaagtgaaa

SEQ ID NO: 197591 - DNA, 35 bp, Artificial Sequence
  Synthetic oligonucleotide
atccatccgccacttgttccagcctttccgtgaaa

SEQ ID NO: 197592 - DNA, 36 bp, Artificial Sequence
  Synthetic oligonucleotide
gtgcacaccaacaacggagggagaggcaagggagaa

SEQ ID NO: 197593 - DNA, 35 bp, Artificial Sequence
  Synthetic oligonucleotide
accacctccatcccatggcatcaggccataaataa

SEQ ID NO: 197594 - DNA, 36 bp, Artificial Sequence
  Synthetic oligonucleotide
agatgggggggggtgcgggatgggatcggtcagtaa

SEQ ID NO: 197595 - DNA, 36 bp, Artificial Sequence
  Synthetic oligonucleotide
gacgcccctccccctgtttagtttctcgttctgaca

SEQ ID NO: 197596 - DNA, 35 bp, Artificial Sequence
  Synthetic oligonucleotide
gtcccccgccccttctgttcaagacccgtggccca

SEQ ID NO: 197597 - DNA, 36 bp, Artificial Sequence
  Synthetic oligonucleotide
tcccaacgatatggtcctcagccgctggttccgcca

SEQ ID NO: 197598 - DNA, 35 bp, Artificial Sequence
  Synthetic oligonucleotide
ggaacaggccccacttatagtgtctactttcgcca

SEQ ID NO: 197599 - DNA, 35 bp, Artificial Sequence
  Synthetic oligonucleotide
atgccctcacatccgctattgccgtaaccgttcca

SEQ ID NO: 197600 - DNA, 36 bp, Artificial Sequence
  Synthetic oligonucleotide
gttgagccaggggggaaaagttgaagcagacaagca

SEQ ID NO: 197601 - DNA, 36 bp, Artificial Sequence
  Synthetic oligonucleotide
gtggagtgggcgggacgtcgggacccaaggagagca

SEQ ID NO: 197602 - DNA, 36 bp, Artificial Sequence
  Synthetic oligonucleotide
gacctttcccgacctgctgcacctcgtacagttgca

SEQ ID NO: 197603 - DNA, 35 bp, Artificial Sequence
  Synthetic oligonucleotide
gcaccgcgcattcttcgatccgcatacacctctca

SEQ ID NO: 197604 - DNA, 37 bp, Artificial Sequence
  Synthetic oligonucleotide
agctgcctcacatagttcgttcccctctccggtcaga

SEQ ID NO: 197605 - DNA, 37 bp, Artificial Sequence
  Synthetic oligonucleotide
gcaaaccactggacgcctgccttgaccctcttttaga

SEQ ID NO: 197606 - DNA, 37 bp, Artificial Sequence
  Synthetic oligonucleotide
tagcccgctccagtttcaagcctccctttccgtccga

SEQ ID NO: 197607 - DNA, 37 bp, Artificial Sequence
  Synthetic oligonucleotide
accctcagccgttgctcaccgatcgcactctttccga

SEQ ID NO: 197608 - DNA, 36 bp, Artificial Sequence
  Synthetic oligonucleotide
aacgggggacgtaacggcgtgggatgggagaacgga

SEQ ID NO: 197609 - DNA, 37 bp, Artificial Sequence
  Synthetic oligonucleotide
tgaacgcaacggagtctttctcgtcacccctcgcgga

SEQ ID NO: 197610 - DNA, 37 bp, Artificial Sequence
  Synthetic oligonucleotide
tccgacctgtccattgtcattttgctcttgtttcgga

SEQ ID NO: 197611 - DNA, 37 bp, Artificial Sequence
  Synthetic oligonucleotide
acaggagggtaaagggtgggctggttgaggacaggga

SEQ ID NO: 197612 - DNA, 37 bp, Artificial Sequence
  Synthetic oligonucleotide
taggagggagtggattgacggggagcagacggcggga

SEQ ID NO: 197613 - DNA, 37 bp, Artificial Sequence
  Synthetic oligonucleotide
gaagggaaggtgaaaatgcatggtgggggggcgatga

SEQ ID NO: 197614 - DNA, 36 bp, Artificial Sequence
  Synthetic oligonucleotide
tgcgacaccgccgcctgtttcgaacgtgccctatga

SEQ ID NO: 197615 - DNA, 38 bp, Artificial Sequence
  Synthetic oligonucleotide
gctgagcgccctttgatatagcgtcccccctgtcctga

SEQ ID NO: 197616 - DNA, 38 bp, Artificial Sequence
  Synthetic oligonucleotide
acgaaacggcccctggtatcttctgcactcgccgctga

SEQ ID NO: 197617 - DNA, 37 bp, Artificial Sequence
  Synthetic oligonucleotide
gtgcatcctcccatttcaacccctcccatgtcgctga

SEQ ID NO: 197618 - DNA, 36 bp, Artificial Sequence
  Synthetic oligonucleotide
ttagacacgcccgaatttaggcctccactcctctga

SEQ ID NO: 197619 - DNA, 38 bp, Artificial Sequence
  Synthetic oligonucleotide
aacataagcgtatgggggggatgggataagggtcgtga

SEQ ID NO: 197620 - DNA, 35 bp, Artificial Sequence
  Synthetic oligonucleotide
gtcacgttgggaaaggggctgaggcaagggggtga

SEQ ID NO: 197621 - DNA, 36 bp, Artificial Sequence
  Synthetic oligonucleotide
gcaagggagggggtgagtagtgcggagggatattga

SEQ ID NO: 197622 - DNA, 38 bp, Artificial Sequence
  Synthetic oligonucleotide
aacgccggccccatcgccactagaccagtcttgcttga

SEQ ID NO: 197623 - DNA, 35 bp, Artificial Sequence
  Synthetic oligonucleotide
gtggatcgggagtagagggcgggatgactagttga

SEQ ID NO: 197624 - DNA, 36 bp, Artificial Sequence
  Synthetic oligonucleotide
ttgcaccccgccgcccctctgtattgtacccgttga

SEQ ID NO: 197625 - DNA, 36 bp, Artificial Sequence
  Synthetic oligonucleotide
acagcccacgtcccctttttgcctgcactccgttga

SEQ ID NO: 197626 - DNA, 36 bp, Artificial Sequence
  Synthetic oligonucleotide
taacccgccacctttgcatctggtatccgccggata

SEQ ID NO: 197627 - DNA, 36 bp, Artificial Sequence
  Synthetic oligonucleotide
tctgcgacgcctatactgcacgcatcatcctccgta

SEQ ID NO: 197628 - DNA, 35 bp, Artificial Sequence
  Synthetic oligonucleotide
accgctcccgccccctctgtcatgtgacattcgta

SEQ ID NO: 197629 - DNA, 35 bp, Artificial Sequence
  Synthetic oligonucleotide
gtacccatccaacgataactgctgtcgccacctta

SEQ ID NO: 197630 - DNA, 35 bp, Artificial Sequence
  Synthetic oligonucleotide
tcccctgcccacttatattgtttgtacctcggtta

SEQ ID NO: 197631 - DNA, 35 bp, Artificial Sequence
  Synthetic oligonucleotide
aagcaccctgatccgatcgtcctgcccggtaccac

SEQ ID NO: 197632 - DNA, 35 bp, Artificial Sequence
  Synthetic oligonucleotide
gtattcgtacacacgctcttatcacctggatccac

SEQ ID NO: 197633 - DNA, 35 bp, Artificial Sequence
  Synthetic oligonucleotide
taccgctccgctcaattgtctgccctttttttcac

SEQ ID NO: 197634 - DNA, 35 bp, Artificial Sequence
  Synthetic oligonucleotide
gcacgtttagtgtactgctgccccccgttccctac

SEQ ID NO: 197635 - DNA, 35 bp, Artificial Sequence
  Synthetic oligonucleotide
tcacaccccggcctacgtgcaatcaatcgttcacc

SEQ ID NO: 197636 - DNA, 35 bp, Artificial Sequence
  Synthetic oligonucleotide
gaggacctcggcaaagtaatcgcgccacgcccccc

SEQ ID NO: 197637 - DNA, 35 bp, Artificial Sequence
  Synthetic oligonucleotide
agcccccagccgccaacaacacaggtgctctcccc

SEQ ID NO: 197638 - DNA, 35 bp, Artificial Sequence
  Synthetic oligonucleotide
tcgtccccctcgcctctgacatcgttagggtgccc

SEQ ID NO: 197639 - DNA, 35 bp, Artificial Sequence
  Synthetic oligonucleotide
tctgagctccatttgcactgatttttggtcttccc

SEQ ID NO: 197640 - DNA, 35 bp, Artificial Sequence
  Synthetic oligonucleotide
tcccggtgcagaatacattgtcccacgtgcttgcc

SEQ ID NO: 197641 - DNA, 35 bp, Artificial Sequence
  Synthetic oligonucleotide
ggagcgccgcacttgaccatgacggccttacctcc

SEQ ID NO: 197642 - DNA, 35 bp, Artificial Sequence
  Synthetic oligonucleotide
tccccttgccttgttgtagcgacagcgaaccctcc

SEQ ID NO: 197643 - DNA, 35 bp, Artificial Sequence
  Synthetic oligonucleotide
tcaccttgccccgatgtcactgccgcacattctcc

SEQ ID NO: 197644 - DNA, 35 bp, Artificial Sequence
  Synthetic oligonucleotide
tcatcctggtcaagtgatttccgcctatgtcttcc

SEQ ID NO: 197645 - DNA, 35 bp, Artificial Sequence
  Synthetic oligonucleotide
tcccatcctcaccacttaaaaaccactgtttccgc

SEQ ID NO: 197646 - DNA, 35 bp, Artificial Sequence
  Synthetic oligonucleotide
tctgcgcatggtattttccctgttctccttgcggc

SEQ ID NO: 197647 - DNA, 34 bp, Artificial Sequence
  Synthetic oligonucleotide
tgaaacctccatgtactcatttcacccagtttgc

SEQ ID NO: 197648 - DNA, 35 bp, Artificial Sequence
  Synthetic oligonucleotide
ggacgacgccactgcttcctggcctcagcattatc

SEQ ID NO: 197649 - DNA, 35 bp, Artificial Sequence
  Synthetic oligonucleotide
actcgctcgtcttaactgttctcatgcgccttatc

SEQ ID NO: 197650 - DNA, 35 bp, Artificial Sequence
  Synthetic oligonucleotide
ttcccagacgtaagtcgtaggtattgttgttcctc

SEQ ID NO: 197651 - DNA, 35 bp, Artificial Sequence
  Synthetic oligonucleotide
ggtcatccaacctgtgtacctgtggttgccttctc

SEQ ID NO: 197652 - DNA, 35 bp, Artificial Sequence
  Synthetic oligonucleotide
taatctggtcagatggcgccccaccctcaactgtc

SEQ ID NO: 197653 - DNA, 35 bp, Artificial Sequence
  Synthetic oligonucleotide
gacccgcgcctgaactataggtccatctacccttc

SEQ ID NO: 197654 - DNA, 35 bp, Artificial Sequence
  Synthetic oligonucleotide
ttagcgcacatcaatctgatattcccgtagctttc

SEQ ID NO: 197655 - DNA, 36 bp, Artificial Sequence
  Synthetic oligonucleotide
atagaagagcacgggtggaattcggagggaggacag

SEQ ID NO: 197656 - DNA, 35 bp, Artificial Sequence
  Synthetic oligonucleotide
aggggtgaagccgaattagggaggatggtgagtag

SEQ ID NO: 197657 - DNA, 35 bp, Artificial Sequence
  Synthetic oligonucleotide
tcccctccgccatatgtcattccaactgacccacg

SEQ ID NO: 197658 - DNA, 35 bp, Artificial Sequence
  Synthetic oligonucleotide
gtaacccgtcccccgcatatgtccaggtatccacg

SEQ ID NO: 197659 - DNA, 35 bp, Artificial Sequence
  Synthetic oligonucleotide
acacccccaagaagcctatccgccggacctcgacg

SEQ ID NO: 197660 - DNA, 35 bp, Artificial Sequence
  Synthetic oligonucleotide
gactcacctacagtatcgcctgctctttgcccgcg

SEQ ID NO: 197661 - DNA, 35 bp, Artificial Sequence
  Synthetic oligonucleotide
tgccaactcgcgtcgtctcccgggcccacttatcg

SEQ ID NO: 197662 - DNA, 35 bp, Artificial Sequence
  Synthetic oligonucleotide
aacagacagaacgttgagggcgtggaggttgaggg

SEQ ID NO: 197663 - DNA, 35 bp, Artificial Sequence
  Synthetic oligonucleotide
tcaacacccgttcacttgcgcggacttcaccatgg

SEQ ID NO: 197664 - DNA, 35 bp, Artificial Sequence
  Synthetic oligonucleotide
ttgtgtcccaatccctcgccgttacatcctgatgg

SEQ ID NO: 197665 - DNA, 34 bp, Artificial Sequence
  Synthetic oligonucleotide
tgggctccacccgttcagcacaccaccgtttctg

SEQ ID NO: 197666 - DNA, 35 bp, Artificial Sequence
  Synthetic oligonucleotide
gaacgcaggagggtggaggtagtgtgttatgccat

SEQ ID NO: 197667 - DNA, 35 bp, Artificial Sequence
  Synthetic oligonucleotide
tcaagcattgcccgccttatgcccctcaagcctat

SEQ ID NO: 197668 - DNA, 35 bp, Artificial Sequence
  Synthetic oligonucleotide
atgtcccatagcccccaccacgtgctcttagcact

SEQ ID NO: 197669 - DNA, 35 bp, Artificial Sequence
  Synthetic oligonucleotide
actgatcacattccgacccgtttccacacgctact

SEQ ID NO: 197670 - DNA, 35 bp, Artificial Sequence
  Synthetic oligonucleotide
tcgtgaccgctcgtgtcgctcctgtttgtccctct

SEQ ID NO: 197671 - DNA, 35 bp, Artificial Sequence
  Synthetic oligonucleotide
gccgcaaccgcctaactgttccgtgcccatctctt

SEQ ID NO: 197672 - DNA, 35 bp, Artificial Sequence
  Synthetic oligonucleotide
ttgtcgcccctgtgcattgttcctcctgcttggtt

SEQ ID NO: 197673 - DNA, 36 bp, Artificial Sequence
  Synthetic oligonucleotide
tcagtcttcaagagcgtacgccccatctgcccccca

SEQ ID NO: 197674 - DNA, 35 bp, Artificial Sequence
  Synthetic oligonucleotide
tgttgcggcacctcctgtagtcacaagcccctcca

SEQ ID NO: 197675 - DNA, 36 bp, Artificial Sequence
  Synthetic oligonucleotide
tcgatggcgaacagcccctactcgattatgcctcca

SEQ ID NO: 197676 - DNA, 36 bp, Artificial Sequence
  Synthetic oligonucleotide
tcctcaccgcctgctcctttctgtctcgggcttcca

SEQ ID NO: 197677 - DNA, 35 bp, Artificial Sequence
  Synthetic oligonucleotide
tgtgtgcctagtgttgcctccttcattactccgca

SEQ ID NO: 197678 - DNA, 36 bp, Artificial Sequence
  Synthetic oligonucleotide
atccaccacacgttgtctctttgtccattgaatgca

SEQ ID NO: 197679 - DNA, 36 bp, Artificial Sequence
  Synthetic oligonucleotide
gcacgtggccgtaatcaagcctcttcgcccacctca

SEQ ID NO: 197680 - DNA, 35 bp, Artificial Sequence
  Synthetic oligonucleotide
tatcgttccgcactttctgttttctcgtctcctca

SEQ ID NO: 197681 - DNA, 35 bp, Artificial Sequence
  Synthetic oligonucleotide
ttcgcgcttatgctttagtgcctccgcctatctca

SEQ ID NO: 197682 - DNA, 36 bp, Artificial Sequence
  Synthetic oligonucleotide
gactacacccccttgtcgtacggtgacattacgtca

SEQ ID NO: 197683 - DNA, 35 bp, Artificial Sequence
  Synthetic oligonucleotide
gcatgacctggaccatctgtctccgccggttttca

SEQ ID NO: 197684 - DNA, 37 bp, Artificial Sequence
  Synthetic oligonucleotide
atggtacgggctgagggcggtaagggacgaaaccaga

SEQ ID NO: 197685 - DNA, 36 bp, Artificial Sequence
  Synthetic oligonucleotide
atgacccatggaagacgaggtgaaagggtagggaga

SEQ ID NO: 197686 - DNA, 37 bp, Artificial Sequence
  Synthetic oligonucleotide
gttccccccccagatgtgttctcgtctactcccacga

SEQ ID NO: 197687 - DNA, 36 bp, Artificial Sequence
  Synthetic oligonucleotide
actgaccgcctcgccttgtaacctcccgtcgtacga

SEQ ID NO: 197688 - DNA, 35 bp, Artificial Sequence
  Synthetic oligonucleotide
gtccgctacagttcgcggcataatccactctccga

SEQ ID NO: 197689 - DNA, 35 bp, Artificial Sequence
  Synthetic oligonucleotide
acatcccaaccagctgtgaaccttacctgttccga

SEQ ID NO: 197690 - DNA, 37 bp, Artificial Sequence
  Synthetic oligonucleotide
cccggtcgcgcacccgtatagccctttatttcatcga

SEQ ID NO: 197691 - DNA, 37 bp, Artificial Sequence
  Synthetic oligonucleotide
ggatcaggcgcccctcttgttatccgccattattcga

SEQ ID NO: 197692 - DNA, 37 bp, Artificial Sequence
  Synthetic oligonucleotide
ttctcccgccagtcctcttcaagggttccatcttcga

SEQ ID NO: 197693 - DNA, 37 bp, Artificial Sequence
  Synthetic oligonucleotide
gatccggggcaagggggcacgaacgaagaagcaagga

SEQ ID NO: 197694 - DNA, 36 bp, Artificial Sequence
  Synthetic oligonucleotide
gaaaggacagggggcgatttatgagcgggagaagga

SEQ ID NO: 197695 - DNA, 37 bp, Artificial Sequence
  Synthetic oligonucleotide
gacctaagtggggaggaccaggaagcaaggggacgga

SEQ ID NO: 197696 - DNA, 37 bp, Artificial Sequence
  Synthetic oligonucleotide
tagatcggcggaggggggctatccagagcggggcgga

SEQ ID NO: 197697 - DNA, 37 bp, Artificial Sequence
  Synthetic oligonucleotide
atgcaggacatggtccagggtcgagggcgggatggga

SEQ ID NO: 197698 - DNA, 37 bp, Artificial Sequence
  Synthetic oligonucleotide
acgcgaagtgtgcgtctccctcgccctcctgactgga

SEQ ID NO: 197699 - DNA, 37 bp, Artificial Sequence
  Synthetic oligonucleotide
gtattggcggggggtcatgctgtatggggatggtgga

SEQ ID NO: 197700 - DNA, 37 bp, Artificial Sequence
  Synthetic oligonucleotide
acatcgccggatcgcgtcaatcatcttccgcccatga

SEQ ID NO: 197701 - DNA, 38 bp, Artificial Sequence
  Synthetic oligonucleotide
ttaacgccgccgcacctgcctaacatgcacagtcatga

SEQ ID NO: 197702 - DNA, 37 bp, Artificial Sequence
  Synthetic oligonucleotide
gggaggacggagggtagaaggtggaaaatggtgatga

SEQ ID NO: 197703 - DNA, 37 bp, Artificial Sequence
  Synthetic oligonucleotide
gaatggggaacggatgagggggtgggaccaggactga

SEQ ID NO: 197704 - DNA, 38 bp, Artificial Sequence
  Synthetic oligonucleotide
tctcggcctcagccttgtacggcttctgttccccctga

SEQ ID NO: 197705 - DNA, 38 bp, Artificial Sequence
  Synthetic oligonucleotide
gcaccgcacacacgctttgatcactctactcggcctga

SEQ ID NO: 197706 - DNA, 38 bp, Artificial Sequence
  Synthetic oligonucleotide
gtcatgcgaatgaacgtaggggaggtgaagggggctga

SEQ ID NO: 197707 - DNA, 38 bp, Artificial Sequence
  Synthetic oligonucleotide
gcccagccgccgcttcacgtcgagcacaccttatctga

SEQ ID NO: 197708 - DNA, 35 bp, Artificial Sequence
  Synthetic oligonucleotide
gaagaccgggcgggtggcatgaaagggttgagtga

SEQ ID NO: 197709 - DNA, 38 bp, Artificial Sequence
  Synthetic oligonucleotide
gtgttcctcatgcgtttcaccagccctcatccccgtga

SEQ ID NO: 197710 - DNA, 37 bp, Artificial Sequence
  Synthetic oligonucleotide
agaccggatgaggagggtgaggtggagcagagcgtga

SEQ ID NO: 197711 - DNA, 38 bp, Artificial Sequence
  Synthetic oligonucleotide
aattgcgcttaaggggggtagggagtgggaaatggtga

SEQ ID NO: 197712 - DNA, 38 bp, Artificial Sequence
  Synthetic oligonucleotide
gaaacgaaggtgggggatgcagatgggcagtgtggtga

SEQ ID NO: 197713 - DNA, 38 bp, Artificial Sequence
  Synthetic oligonucleotide
gagagcggtggcggaggcggtcatggcggagggattga

SEQ ID NO: 197714 - DNA, 38 bp, Artificial Sequence
  Synthetic oligonucleotide
tgtcacgtgcgctcccccctatagtctgcctgtattga

SEQ ID NO: 197715 - DNA, 38 bp, Artificial Sequence
  Synthetic oligonucleotide
gccaccgtcatcagattaatactcgccgctccccttga

SEQ ID NO: 197716 - DNA, 36 bp, Artificial Sequence
  Synthetic oligonucleotide
atccactgctcccctgtttcctcgtgtctgttacta

SEQ ID NO: 197717 - DNA, 35 bp, Artificial Sequence
  Synthetic oligonucleotide
gaacagtcgcttcagcgtaccctcccccggaccta

SEQ ID NO: 197718 - DNA, 35 bp, Artificial Sequence
  Synthetic oligonucleotide
tgggcccccgcatcaatgccacgtttttccatcta

SEQ ID NO: 197719 - DNA, 35 bp, Artificial Sequence
  Synthetic oligonucleotide
tggacgactcctgacctgttcattcacctcatcta

SEQ ID NO: 197720 - DNA, 35 bp, Artificial Sequence
  Synthetic oligonucleotide
tagctcccctgctcgcctattccatgtctcgtcta

SEQ ID NO: 197721 - DNA, 36 bp, Artificial Sequence
  Synthetic oligonucleotide
gacgcacggtatgttgtccctctcctgccctccgta

SEQ ID NO: 197722 - DNA, 35 bp, Artificial Sequence
  Synthetic oligonucleotide
tagaaacgggaaggcacggggggggaagtgaggta

SEQ ID NO: 197723 - DNA, 36 bp, Artificial Sequence
  Synthetic oligonucleotide
tgcccccatataccctcgcccttgtcttccgtggta

SEQ ID NO: 197724 - DNA, 35 bp, Artificial Sequence
  Synthetic oligonucleotide
acccctcctgctcgcttgttgtccatgccagatta

SEQ ID NO: 197725 - DNA, 35 bp, Artificial Sequence
  Synthetic oligonucleotide
actacggcatcagccacgtaccttccgttttctta

SEQ ID NO: 197726 - DNA, 35 bp, Artificial Sequence
  Synthetic oligonucleotide
acgctacgtacgcccacgtgatccagctaccaaac

SEQ ID NO: 197727 - DNA, 35 bp, Artificial Sequence
  Synthetic oligonucleotide
tgagtgccactcagcctgtgccgacgcccaccaac

SEQ ID NO: 197728 - DNA, 35 bp, Artificial Sequence
  Synthetic oligonucleotide
tagtgccacggctttccgttagatcaatcctccac

SEQ ID NO: 197729 - DNA, 35 bp, Artificial Sequence
  Synthetic oligonucleotide
tagcgccacattgatcacgttcattttttttccac

SEQ ID NO: 197730 - DNA, 35 bp, Artificial Sequence
  Synthetic oligonucleotide
acacgttgtgcgtctcagctcttcttccttggcac

SEQ ID NO: 197731 - DNA, 35 bp, Artificial Sequence
  Synthetic oligonucleotide
gatctacgtccctcgcgccttttaaccattaggac

SEQ ID NO: 197732 - DNA, 35 bp, Artificial Sequence
  Synthetic oligonucleotide
tgccccgccagcctgtctctttcgatcgcactacc

SEQ ID NO: 197733 - DNA, 35 bp, Artificial Sequence
  Synthetic oligonucleotide
gacctcaggcctatcgacccatggaacctgcgccc

SEQ ID NO: 197734 - DNA, 35 bp, Artificial Sequence
  Synthetic oligonucleotide
accgcaacccctccgggtgtctgaacgttcctccc

SEQ ID NO: 197735 - DNA, 35 bp, Artificial Sequence
  Synthetic oligonucleotide
tccaccctacaactgagttaaggcccgattatgcc

SEQ ID NO: 197736 - DNA, 35 bp, Artificial Sequence
  Synthetic oligonucleotide
tcccgcccctgttgttgcctcacgctaggtcatcc

SEQ ID NO: 197737 - DNA, 35 bp, Artificial Sequence
  Synthetic oligonucleotide
tgttgccgtcgactgcgacatattcgctcatctcc

SEQ ID NO: 197738 - DNA, 35 bp, Artificial Sequence
  Synthetic oligonucleotide
tcctccaccctacgatgccgccatagcctatctcc

SEQ ID NO: 197739 - DNA, 35 bp, Artificial Sequence
  Synthetic oligonucleotide
atgtgccatcgtcagcacgcttcctaactacttcc

SEQ ID NO: 197740 - DNA, 35 bp, Artificial Sequence
  Synthetic oligonucleotide
actcgctaagccgtaccactatacctcgctgccgc

SEQ ID NO: 197741 - DNA, 34 bp, Artificial Sequence
  Synthetic oligonucleotide
agtgagaggagcaggagtagtaggaggtgtcggc

SEQ ID NO: 197742 - DNA, 35 bp, Artificial Sequence
  Synthetic oligonucleotide
tctcacccgtggaattccctgtatgttagccctgc

SEQ ID NO: 197743 - DNA, 35 bp, Artificial Sequence
  Synthetic oligonucleotide
acatgcctcttgtcctgttttcttaccgccgctgc

SEQ ID NO: 197744 - DNA, 35 bp, Artificial Sequence
  Synthetic oligonucleotide
tgccgagcctcatgtctgcctactcatattgctgc

SEQ ID NO: 197745 - DNA, 35 bp, Artificial Sequence
  Synthetic oligonucleotide
ttcgatccgtaggttctgctacacctgacccttgc

SEQ ID NO: 197746 - DNA, 35 bp, Artificial Sequence
  Synthetic oligonucleotide
tctcgcgtcctccgtcacttacgaacccatcttgc

SEQ ID NO: 197747 - DNA, 35 bp, Artificial Sequence
  Synthetic oligonucleotide
tcaggaaaccctcctcctttatcgtggccactatc

SEQ ID NO: 197748 - DNA, 35 bp, Artificial Sequence
  Synthetic oligonucleotide
gttcgggggcagactttgggtgggagggttttatc

SEQ ID NO: 197749 - DNA, 35 bp, Artificial Sequence
  Synthetic oligonucleotide
atcctcccgtaactttgcgctcacatgagtgcctc

SEQ ID NO: 197750 - DNA, 35 bp, Artificial Sequence
  Synthetic oligonucleotide
gccacactcctctgcagtactcagccttcacgctc

SEQ ID NO: 197751 - DNA, 35 bp, Artificial Sequence
  Synthetic oligonucleotide
attcccgtccagccgctttccactgtccatggctc

SEQ ID NO: 197752 - DNA, 35 bp, Artificial Sequence
  Synthetic oligonucleotide
atcacgacgagctggatctcttgcacgcatctctc

SEQ ID NO: 197753 - DNA, 35 bp, Artificial Sequence
  Synthetic oligonucleotide
tgctgacgcattgtccttcctgcccccgccctgtc

SEQ ID NO: 197754 - DNA, 35 bp, Artificial Sequence
  Synthetic oligonucleotide
tcctcgtgtccacacggttaaaaaccaatcctgtc

SEQ ID NO: 197755 - DNA, 35 bp, Artificial Sequence
  Synthetic oligonucleotide
tgtcagggttcacctcgtccgctgcaattccgttc

SEQ ID NO: 197756 - DNA, 35 bp, Artificial Sequence
  Synthetic oligonucleotide
gactgtatcccctcctgacgaagtgtaagcctttc

SEQ ID NO: 197757 - DNA, 36 bp, Artificial Sequence
  Synthetic oligonucleotide
gatcgtgggcgagagggtaggaggggtggggaggag

SEQ ID NO: 197758 - DNA, 35 bp, Artificial Sequence
  Synthetic oligonucleotide
gatatgcctctgctccacctccgtttaataaaccg

SEQ ID NO: 197759 - DNA, 35 bp, Artificial Sequence
  Synthetic oligonucleotide
tacgccgcagtcccgtctattctacaccatttccg

SEQ ID NO: 197760 - DNA, 36 bp, Artificial Sequence
  Synthetic oligonucleotide
tctagcggtcgtcagtcgtcctcccgcctaccctcg

SEQ ID NO: 197761 - DNA, 35 bp, Artificial Sequence
  Synthetic oligonucleotide
ttcaataggggtgagagggcgggacaaaagcaggg

SEQ ID NO: 197762 - DNA, 35 bp, Artificial Sequence
  Synthetic oligonucleotide
gcagacggcgaacgaaggggcgggagtggcgcgat

SEQ ID NO: 197763 - DNA, 35 bp, Artificial Sequence
  Synthetic oligonucleotide
tgatacccacaatgccccctccgttatcggtggat

SEQ ID NO: 197764 - DNA, 35 bp, Artificial Sequence
  Synthetic oligonucleotide
ttcgttgcgacggactcgcttcgtcttccgtacct

SEQ ID NO: 197765 - DNA, 35 bp, Artificial Sequence
  Synthetic oligonucleotide
atgtcccgacgtactttccgacactccgtttgcct

SEQ ID NO: 197766 - DNA, 35 bp, Artificial Sequence
  Synthetic oligonucleotide
atgtcacaggcgttatcatgtccccgtcttccgct

SEQ ID NO: 197767 - DNA, 35 bp, Artificial Sequence
  Synthetic oligonucleotide
tcaacaccactcgcgttcgcccaaccgccccatct

SEQ ID NO: 197768 - DNA, 35 bp, Artificial Sequence
  Synthetic oligonucleotide
gcactgtcgctttcagtgtctattatcgcccatct

SEQ ID NO: 197769 - DNA, 35 bp, Artificial Sequence
  Synthetic oligonucleotide
tcttcgcaaagggctgcttattcgtcgttccatct

SEQ ID NO: 197770 - DNA, 35 bp, Artificial Sequence
  Synthetic oligonucleotide
gatcagacgttaggatcgcgtgctgcctcacctct

SEQ ID NO: 197771 - DNA, 35 bp, Artificial Sequence
  Synthetic oligonucleotide
tagtggtcgacaacgtatcacgatccctgccctct

SEQ ID NO: 197772 - DNA, 35 bp, Artificial Sequence
  Synthetic oligonucleotide
gaccagcagacacacgttgtggccttcgatcctct

SEQ ID NO: 197773 - DNA, 35 bp, Artificial Sequence
  Synthetic oligonucleotide
ggaggaggacggatcgggggggctaaggattaggt

SEQ ID NO: 197774 - DNA, 35 bp, Artificial Sequence
  Synthetic oligonucleotide
agccgggcatcaggtaccgtcccctttcccgcatt

SEQ ID NO: 197775 - DNA, 35 bp, Artificial Sequence
  Synthetic oligonucleotide
aggagcctcagtgcaaatttgtaccacctcccctt

SEQ ID NO: 197776 - DNA, 35 bp, Artificial Sequence
  Synthetic oligonucleotide
gtcatcacgtactgatcccttcctcttcggtgctt

SEQ ID NO: 197777 - DNA, 35 bp, Artificial Sequence
  Synthetic oligonucleotide
ttctcgccctcgcgctgtacctttaagccttgctt

SEQ ID NO: 197778 - DNA, 36 bp, Artificial Sequence
  Synthetic oligonucleotide
tgcacaccggcaacgctgctcacgctctcttgtctt

SEQ ID NO: 197779 - DNA, 35 bp, Artificial Sequence
  Synthetic oligonucleotide
gttgatgtcacacgttgcccaaggtcttgttcgtt

SEQ ID NO: 197780 - DNA, 36 bp, Artificial Sequence
  Synthetic oligonucleotide
gttccgccccattagtagtaatttcgcacctttcaa

SEQ ID NO: 197781 - DNA, 36 bp, Artificial Sequence
  Synthetic oligonucleotide
atgggaacgaaagcaaggaagggaagcgacggagaa

SEQ ID NO: 197782 - DNA, 36 bp, Artificial Sequence
  Synthetic oligonucleotide
tatgtaacgcccaatggtccgtccttcctgtcttaa

SEQ ID NO: 197783 - DNA, 36 bp, Artificial Sequence
  Synthetic oligonucleotide
ttggaaaggtgggggcgtatttctagcggggggaca

SEQ ID NO: 197784 - DNA, 35 bp, Artificial Sequence
  Synthetic oligonucleotide
ttgtgcactcgcccccctgatctattcgtactaca

SEQ ID NO: 197785 - DNA, 35 bp, Artificial Sequence
  Synthetic oligonucleotide
gatggcccatctcgacctctttcgcagtgctccca

SEQ ID NO: 197786 - DNA, 36 bp, Artificial Sequence
  Synthetic oligonucleotide
tttcgcaccccgttgcgcttaactattcccgtccca

SEQ ID NO: 197787 - DNA, 35 bp, Artificial Sequence
  Synthetic oligonucleotide
ttcgcagtccgtccgtcatacccactgcttcgcca

SEQ ID NO: 197788 - DNA, 35 bp, Artificial Sequence
  Synthetic oligonucleotide
gagctgacccgacctaactgcctccacgaatgcca

SEQ ID NO: 197789 - DNA, 36 bp, Artificial Sequence
  Synthetic oligonucleotide
tccaccctcatagtctggacttagtaacgtcctcca

SEQ ID NO: 197790 - DNA, 36 bp, Artificial Sequence
  Synthetic oligonucleotide
tcagcgggggggctgggcaatatgggtcgaagcgca

SEQ ID NO: 197791 - DNA, 36 bp, Artificial Sequence
  Synthetic oligonucleotide
gcgcgcgaaagaggaggcatatggatgtagcgcgca

SEQ ID NO: 197792 - DNA, 35 bp, Artificial Sequence
  Synthetic oligonucleotide
tatgcatcctcgggccgctccttctgcaatctgca

SEQ ID NO: 197793 - DNA, 36 bp, Artificial Sequence
  Synthetic oligonucleotide
gtgtacgtaagtctccgcctccaccacgtgtttgca

SEQ ID NO: 197794 - DNA, 36 bp, Artificial Sequence
  Synthetic oligonucleotide
gcacctgtcttgccccggcctgaatccaccatatca

SEQ ID NO: 197795 - DNA, 35 bp, Artificial Sequence
  Synthetic oligonucleotide
gcacccttcgcagagccaactttccccttatgtca

SEQ ID NO: 197796 - DNA, 37 bp, Artificial Sequence
  Synthetic oligonucleotide
gtacacccgttccctcctgttcttgttcggttgaaga

SEQ ID NO: 197797 - DNA, 37 bp, Artificial Sequence
  Synthetic oligonucleotide
ttggagcgctgagggggtgggtggtagtggggccaga

SEQ ID NO: 197798 - DNA, 35 bp, Artificial Sequence
  Synthetic oligonucleotide
tgcccccgcacccgactacctgctcatggacgaga

SEQ ID NO: 197799 - DNA, 25 bp, Artificial Sequence
  Synthetic oligonucleotide
accccccctgccgtttactcaacga

SEQ ID NO: 197800 - DNA, 37 bp, Artificial Sequence
  Synthetic oligonucleotide
ggatcgaaagggcggtaagggagcggacggtacacga

SEQ ID NO: 197801 - DNA, 37 bp, Artificial Sequence
  Synthetic oligonucleotide
ttgcccctccgcctatgacccattgtgctcagtacga

SEQ ID NO: 197802 - DNA, 37 bp, Artificial Sequence
  Synthetic oligonucleotide
gtctgggaacaaggcgaaggagggacggcggtaccga

SEQ ID NO: 197803 - DNA, 37 bp, Artificial Sequence
  Synthetic oligonucleotide
tccgacggagtccggcatatacgcctccgctccccga

SEQ ID NO: 197804 - DNA, 35 bp, Artificial Sequence
  Synthetic oligonucleotide
gccaagcccaattaagtatctttcctgccgcccga

SEQ ID NO: 197805 - DNA, 36 bp, Artificial Sequence
  Synthetic oligonucleotide
agtgtcacggcgggtggggattcgggaggttagcga

SEQ ID NO: 197806 - DNA, 37 bp, Artificial Sequence
  Synthetic oligonucleotide
gtgcccccgcacgctcccttattgaccacttacgcga

SEQ ID NO: 197807 - DNA, 37 bp, Artificial Sequence
  Synthetic oligonucleotide
aattgcacgtcaccttcccccccgcttgctgatgcga

SEQ ID NO: 197808 - DNA, 37 bp, Artificial Sequence
  Synthetic oligonucleotide
atcgccgcgctcattggagctcactcacctctctcga

SEQ ID NO: 197809 - DNA, 37 bp, Artificial Sequence
  Synthetic oligonucleotide
gatgcgagtggcggtgagggaagaatagagtgaagga

SEQ ID NO: 197810 - DNA, 37 bp, Artificial Sequence
  Synthetic oligonucleotide
ggtgacaatgggctgcgaatggacgggaaggggtgga

SEQ ID NO: 197811 - DNA, 37 bp, Artificial Sequence
  Synthetic oligonucleotide
atgacccccatccacaagtgtatatccatgcccatga

SEQ ID NO: 197812 - DNA, 38 bp, Artificial Sequence
  Synthetic oligonucleotide
tttcatccgccacgtgcatacgcttacctacctcatga

SEQ ID NO: 197813 - DNA, 37 bp, Artificial Sequence
  Synthetic oligonucleotide
gaacagcaccaccttcgtcgtacccgctccccgatga

SEQ ID NO: 197814 - DNA, 38 bp, Artificial Sequence
  Synthetic oligonucleotide
gggtgaggaggagcgggaggaaaaggaccccgggatga

SEQ ID NO: 197815 - DNA, 38 bp, Artificial Sequence
  Synthetic oligonucleotide
tagggggcgggacgggagaactgagggcatgtatatga

SEQ ID NO: 197816 - DNA, 38 bp, Artificial Sequence
  Synthetic oligonucleotide
gatccatcgcatcctacgccaaagtgccccctctatga

SEQ ID NO: 197817 - DNA, 38 bp, Artificial Sequence
  Synthetic oligonucleotide
accatcctcatactcgggccacagtcgcgtttacctga

SEQ ID NO: 197818 - DNA, 38 bp, Artificial Sequence
  Synthetic oligonucleotide
atccgcaggctctccgtgtactccgctccattgcctga

SEQ ID NO: 197819 - DNA, 38 bp, Artificial Sequence
  Synthetic oligonucleotide
aagaacgaacggtagtatataggggcggagggagctga

SEQ ID NO: 197820 - DNA, 38 bp, Artificial Sequence
  Synthetic oligonucleotide
aacacacccgctttgccttctcgtaccccttgccgtga

SEQ ID NO: 197821 - DNA, 38 bp, Artificial Sequence
  Synthetic oligonucleotide
gatgtggaacagtgggggtggtacagaatgagtggtga

SEQ ID NO: 197822 - DNA, 38 bp, Artificial Sequence
  Synthetic oligonucleotide
gcctgtctcccgttctgcattttccacagcctgattga

SEQ ID NO: 197823 - DNA, 38 bp, Artificial Sequence
  Synthetic oligonucleotide
gacgccggtcacctttgcctttgatatcttgtacttga

SEQ ID NO: 197824 - DNA, 37 bp, Artificial Sequence
  Synthetic oligonucleotide
gactacgcccccactggatacggtttctcctccttga

SEQ ID NO: 197825 - DNA, 38 bp, Artificial Sequence
  Synthetic oligonucleotide
ccgaccccagcattgatccctcgcccacaaatagttga

SEQ ID NO: 197826 - DNA, 38 bp, Artificial Sequence
  Synthetic oligonucleotide
tacgggagacgaaagagggggccgcgatgaagggttga

SEQ ID NO: 197827 - DNA, 37 bp, Artificial Sequence
  Synthetic oligonucleotide
ggaggtggtggggtggacttatggcggtaactgttga

SEQ ID NO: 197828 - DNA, 35 bp, Artificial Sequence
  Synthetic oligonucleotide
tacgtcggggtggggaacgggggagactgtaaata

SEQ ID NO: 197829 - DNA, 35 bp, Artificial Sequence
  Synthetic oligonucleotide
acctcactcggagctatatggcacccccagcccta

SEQ ID NO: 197830 - DNA, 35 bp, Artificial Sequence
  Synthetic oligonucleotide
tgaccctaagcgttcccattattcgcgccactcta

SEQ ID NO: 197831 - DNA, 35 bp, Artificial Sequence
  Synthetic oligonucleotide
tccttaacgacaaacgtgctgcctgctttcctcta

SEQ ID NO: 197832 - DNA, 36 bp, Artificial Sequence
  Synthetic oligonucleotide
acgaggagggcaataagggcgttaagttgggcggta

SEQ ID NO: 197833 - DNA, 36 bp, Artificial Sequence
  Synthetic oligonucleotide
tgacccccacctatgcgtcattacgttatcttgtta

SEQ ID NO: 197834 - DNA, 35 bp, Artificial Sequence
  Synthetic oligonucleotide
gcacctggccttgctaactcgccttctcttgagac

SEQ ID NO: 197835 - DNA, 36 bp, Artificial Sequence
  Synthetic oligonucleotide
gtgccgcagagtcattcgccccagaccgtgaacccc

SEQ ID NO: 197836 - DNA, 35 bp, Artificial Sequence
  Synthetic oligonucleotide
acgacaaggctcagttccatctccagtgccccccc

SEQ ID NO: 197837 - DNA, 35 bp, Artificial Sequence
  Synthetic oligonucleotide
tagtcgccctcgtatatgccacccgtcttgtcccc

SEQ ID NO: 197838 - DNA, 35 bp, Artificial Sequence
  Synthetic oligonucleotide
tgcggaagaacgcccttattgctataccttggccc

SEQ ID NO: 197839 - DNA, 35 bp, Artificial Sequence
  Synthetic oligonucleotide
tgtggaccccgaactgttttctcgcccgtaccgcc

SEQ ID NO: 197840 - DNA, 35 bp, Artificial Sequence
  Synthetic oligonucleotide
aaccagcagtccgtacagttgctcatttcgccgcc

SEQ ID NO: 197841 - DNA, 35 bp, Artificial Sequence
  Synthetic oligonucleotide
gatcgccatcccctgtactttagcattatatcgcc

SEQ ID NO: 197842 - DNA, 35 bp, Artificial Sequence
  Synthetic oligonucleotide
ggaacgcaactgcatgcccgaacatctccgagtcc

SEQ ID NO: 197843 - DNA, 35 bp, Artificial Sequence
  Synthetic oligonucleotide
gcgaaggtcagtatccctagtcttttccattgtcc

SEQ ID NO: 197844 - DNA, 35 bp, Artificial Sequence
  Synthetic oligonucleotide
gccgggcctccggtacctgatttacgctggtttcc

SEQ ID NO: 197845 - DNA, 35 bp, Artificial Sequence
  Synthetic oligonucleotide
gtttgcactcgcctccatacgtaacatcttacggc

SEQ ID NO: 197846 - DNA, 35 bp, Artificial Sequence
  Synthetic oligonucleotide
atgcgcatctcccttcgctgatattcctggccggc

SEQ ID NO: 197847 - DNA, 35 bp, Artificial Sequence
  Synthetic oligonucleotide
tcatgcatgtcggcggtctcctcctcaaattctgc

SEQ ID NO: 197848 - DNA, 35 bp, Artificial Sequence
  Synthetic oligonucleotide
gtcccccccccacttgcgacaagagacttacgtgc

SEQ ID NO: 197849 - DNA, 35 bp, Artificial Sequence
  Synthetic oligonucleotide
atccccccgcaccatttgtcggcctaagcctactc

SEQ ID NO: 197850 - DNA, 35 bp, Artificial Sequence
  Synthetic oligonucleotide
tgcgatcctcccactgcatttggtgcctgcctctc

SEQ ID NO: 197851 - DNA, 35 bp, Artificial Sequence
  Synthetic oligonucleotide
tacgtccgggcttatcgatatttagttgcgctctc

SEQ ID NO: 197852 - DNA, 35 bp, Artificial Sequence
  Synthetic oligonucleotide
taacccccccctatttgtccgagcagtcgtttctc

SEQ ID NO: 197853 - DNA, 35 bp, Artificial Sequence
  Synthetic oligonucleotide
gatagcggcatccgattcgactctgccccgccgtc

SEQ ID NO: 197854 - DNA, 35 bp, Artificial Sequence
  Synthetic oligonucleotide
acaccttgcctcctgtctcttcaccgcgtgtggtc

SEQ ID NO: 197855 - DNA, 32 bp, Artificial Sequence
  Synthetic oligonucleotide
ttatctgccgctaacgcctctcacgctttgtc

SEQ ID NO: 197856 - DNA, 35 bp, Artificial Sequence
  Synthetic oligonucleotide
tgctggtggtcgccgtatctgttctgttcccgttc

SEQ ID NO: 197857 - DNA, 35 bp, Artificial Sequence
  Synthetic oligonucleotide
ggtcaccctccccgttcaacatgaaactcctcgag

SEQ ID NO: 197858 - DNA, 35 bp, Artificial Sequence
  Synthetic oligonucleotide
tacgggcgggaggcgggacattagagcgacatacg

SEQ ID NO: 197859 - DNA, 35 bp, Artificial Sequence
  Synthetic oligonucleotide
tacgcccctcacctctcctgtgcctgtattaaccg

SEQ ID NO: 197860 - DNA, 35 bp, Artificial Sequence
  Synthetic oligonucleotide
gttccgccccagtcgacatttatcagtcctcctcg

SEQ ID NO: 197861 - DNA, 35 bp, Artificial Sequence
  Synthetic oligonucleotide
acgcctcgggagggtgggctccgtttgatcacggg

SEQ ID NO: 197862 - DNA, 35 bp, Artificial Sequence
  Synthetic oligonucleotide
tttgcgctgtcatacttcaaacgcccctttccctg

SEQ ID NO: 197863 - DNA, 35 bp, Artificial Sequence
  Synthetic oligonucleotide
actgcgccccgcctctcgattcattgcaatatgtg

SEQ ID NO: 197864 - DNA, 35 bp, Artificial Sequence
  Synthetic oligonucleotide
actgtagtacctcgcccgcatccagcgtatcccat

SEQ ID NO: 197865 - DNA, 35 bp, Artificial Sequence
  Synthetic oligonucleotide
gttgacctccgctgggcccattggattcaccatat

SEQ ID NO: 197866 - DNA, 35 bp, Artificial Sequence
  Synthetic oligonucleotide
tgtacctccgcgaatgcactggacccattaactat

SEQ ID NO: 197867 - DNA, 35 bp, Artificial Sequence
  Synthetic oligonucleotide
gtcacgcattgagttctagtacccatctcctctat

SEQ ID NO: 197868 - DNA, 35 bp, Artificial Sequence
  Synthetic oligonucleotide
atgggaccgtcgtatcacgccctcttcgctccact

SEQ ID NO: 197869 - DNA, 35 bp, Artificial Sequence
  Synthetic oligonucleotide
gacaaccactgtgggtaatctagccctcctctact

SEQ ID NO: 197870 - DNA, 35 bp, Artificial Sequence
  Synthetic oligonucleotide
gctgttcgccatccacgcctatacacggtattact

SEQ ID NO: 197871 - DNA, 35 bp, Artificial Sequence
  Synthetic oligonucleotide
tactgccccatcgctgtcttcctcacaacacacct

SEQ ID NO: 197872 - DNA, 35 bp, Artificial Sequence
  Synthetic oligonucleotide
ttagtacaccgccattgtgctttattccactcgct

SEQ ID NO: 197873 - DNA, 35 bp, Artificial Sequence
  Synthetic oligonucleotide
atccgccctaccgtctggtatgttcatccacctct

SEQ ID NO: 197874 - DNA, 35 bp, Artificial Sequence
  Synthetic oligonucleotide
tgtttacgcagcatctctatcatacgcccttctct

SEQ ID NO: 197875 - DNA, 35 bp, Artificial Sequence
  Synthetic oligonucleotide
ttgccgccatttgtcgtctctgccttgcttacggt

SEQ ID NO: 197876 - DNA, 35 bp, Artificial Sequence
  Synthetic oligonucleotide
tccacacctatttctgacgtatacgtccagtactt

SEQ ID NO: 197877 - DNA, 35 bp, Artificial Sequence
  Synthetic oligonucleotide
acgtctccatccgggttacagctccatccgtactt

SEQ ID NO: 197878 - DNA, 35 bp, Artificial Sequence
  Synthetic oligonucleotide
atcacgcaccccatgcggactttggagcctccttt

SEQ ID NO: 197879 - DNA, 35 bp, Artificial Sequence
  Synthetic oligonucleotide
gtgggtctaccgttcaattgccccttccttggttt

SEQ ID NO: 197880 - DNA, 35 bp, Artificial Sequence
  Synthetic oligonucleotide
accctgggtccagagggtgggaagggccacatttt

SEQ ID NO: 197881 - DNA, 36 bp, Artificial Sequence
  Synthetic oligonucleotide
atccgccgcctaccacattcggttaattcggaccaa

SEQ ID NO: 197882 - DNA, 36 bp, Artificial Sequence
  Synthetic oligonucleotide
tcacccctgccctagccgtttacatacgttttccaa

SEQ ID NO: 197883 - DNA, 35 bp, Artificial Sequence
  Synthetic oligonucleotide
accaccctaccgccagctcacctttcgactgtcaa

SEQ ID NO: 197884 - DNA, 36 bp, Artificial Sequence
  Synthetic oligonucleotide
gtagccagaggggagggcggatacttgtaggcggaa

SEQ ID NO: 197885 - DNA, 36 bp, Artificial Sequence
  Synthetic oligonucleotide
gttacgcgccccgttttttgccgttgattattggaa

SEQ ID NO: 197886 - DNA, 36 bp, Artificial Sequence
  Synthetic oligonucleotide
aaaccgggggggtggcacaaagtgggaatgagtgaa

SEQ ID NO: 197887 - DNA, 36 bp, Artificial Sequence
  Synthetic oligonucleotide
gccaacgcccccatgaatcaccccgtcagtcagaca

SEQ ID NO: 197888 - DNA, 36 bp, Artificial Sequence
  Synthetic oligonucleotide
gattcggtcattgttatattgctcatcgctccacca

SEQ ID NO: 197889 - DNA, 35 bp, Artificial Sequence
  Synthetic oligonucleotide
gcccaccatcactcgtcttaacacgtcaacgccca

SEQ ID NO: 197890 - DNA, 36 bp, Artificial Sequence
  Synthetic oligonucleotide
tacgtacagacctgtcacttctgttactccgttcca

SEQ ID NO: 197891 - DNA, 35 bp, Artificial Sequence
  Synthetic oligonucleotide
atccatccgtagccgtgccatgtctccgttcctca

SEQ ID NO: 197892 - DNA, 37 bp, Artificial Sequence
  Synthetic oligonucleotide
gagaaatcggcaggaagggggggggtggtctgcaaga

SEQ ID NO: 197893 - DNA, 37 bp, Artificial Sequence
  Synthetic oligonucleotide
ttgtgccgccgtgtccattcgtccaacgccctcaaga

SEQ ID NO: 197894 - DNA, 36 bp, Artificial Sequence
  Synthetic oligonucleotide
tccatgttgtcccatgcgatcatttccatctccaga

SEQ ID NO: 197895 - DNA, 35 bp, Artificial Sequence
  Synthetic oligonucleotide
gcatgcacgtgggggcggtgggttcgggtcaacga

SEQ ID NO: 197896 - DNA, 37 bp, Artificial Sequence
  Synthetic oligonucleotide
gcactcgcactcactagtactcaccgccgcactacga

SEQ ID NO: 197897 - DNA, 36 bp, Artificial Sequence
  Synthetic oligonucleotide
atgagagcgggctaaagggaggggggggccaaccga

SEQ ID NO: 197898 - DNA, 36 bp, Artificial Sequence
  Synthetic oligonucleotide
aaggccgacacatagtgcttccttagtgccccccga

SEQ ID NO: 197899 - DNA, 36 bp, Artificial Sequence
  Synthetic oligonucleotide
gccaccgctctaccctcttccttactgtctgtccga

SEQ ID NO: 197900 - DNA, 37 bp, Artificial Sequence
  Synthetic oligonucleotide
tccctgcccctttgctttagatcactcccgtttccga

SEQ ID NO: 197901 - DNA, 37 bp, Artificial Sequence
  Synthetic oligonucleotide
tcatccacgacgctagttagtagcttacacctttcga

SEQ ID NO: 197902 - DNA, 37 bp, Artificial Sequence
  Synthetic oligonucleotide
taggagagggcgagagcggtggaacgactaaacagga

SEQ ID NO: 197903 - DNA, 36 bp, Artificial Sequence
  Synthetic oligonucleotide
gtcggagggagaataaggggaataatgtgggacgga

SEQ ID NO: 197904 - DNA, 37 bp, Artificial Sequence
  Synthetic oligonucleotide
gtgggttgatggatacgggtggggggcggactcggga

SEQ ID NO: 197905 - DNA, 37 bp, Artificial Sequence
  Synthetic oligonucleotide
gaagggtcgataggggaacctatgacagggaagggga

SEQ ID NO: 197906 - DNA, 37 bp, Artificial Sequence
  Synthetic oligonucleotide
tataccgctcccgccgtcgcctattgcccttgttgga

SEQ ID NO: 197907 - DNA, 38 bp, Artificial Sequence
  Synthetic oligonucleotide
atggggtacgcggggtggtcggggaggctacggaatga

SEQ ID NO: 197908 - DNA, 38 bp, Artificial Sequence
  Synthetic oligonucleotide
gatgcctccgtccgtgtctcgcctccccatgcttatga

SEQ ID NO: 197909 - DNA, 37 bp, Artificial Sequence
  Synthetic oligonucleotide
accatcgacccgggccctccgccatttatgtccctga

SEQ ID NO: 197910 - DNA, 36 bp, Artificial Sequence
  Synthetic oligonucleotide
ggtgaccgagggttggtggggaagggaatggagtga

SEQ ID NO: 197911 - DNA, 37 bp, Artificial Sequence
  Synthetic oligonucleotide
tgcatcctcctgttcgcccttccgttcacctccgtga

SEQ ID NO: 197912 - DNA, 37 bp, Artificial Sequence
  Synthetic oligonucleotide
acaccacccttctgcaccagtaacggtgaaatcgtga

SEQ ID NO: 197913 - DNA, 38 bp, Artificial Sequence
  Synthetic oligonucleotide
acgcgggggatacgggagggcaatcgatcgccgggtga

SEQ ID NO: 197914 - DNA, 38 bp, Artificial Sequence
  Synthetic oligonucleotide
actgtgcccgtcggcccttatacccgagcccaccttga

SEQ ID NO: 197915 - DNA, 38 bp, Artificial Sequence
  Synthetic oligonucleotide
gagacacgggggagcagtgtggggaaaggtcgcgttga

SEQ ID NO: 197916 - DNA, 38 bp, Artificial Sequence
  Synthetic oligonucleotide
atcgcacccttccgccctgaactgaccacgcaatttga

SEQ ID NO: 197917 - DNA, 34 bp, Artificial Sequence
  Synthetic oligonucleotide
ataccatcccttttgcttatgagtcactacccta

SEQ ID NO: 197918 - DNA, 35 bp, Artificial Sequence
  Synthetic oligonucleotide
gtccgacacgtcacatatgtcctgctcaatcctta

SEQ ID NO: 197919 - DNA, 36 bp, Artificial Sequence
  Synthetic oligonucleotide
tgcgactgtgaaaagggtaggagcagggaggggtta

SEQ ID NO: 197920 - DNA, 36 bp, Artificial Sequence
  Synthetic oligonucleotide
tcccctaacgtgcatttgctgccctgcttatcttta

SEQ ID NO: 197921 - DNA, 35 bp, Artificial Sequence
  Synthetic oligonucleotide
tccccgtgtcacccatgttcatctaccgcctccac

SEQ ID NO: 197922 - DNA, 35 bp, Artificial Sequence
  Synthetic oligonucleotide
gacggaggtggaactgggagtattggtaacggcac

SEQ ID NO: 197923 - DNA, 35 bp, Artificial Sequence
  Synthetic oligonucleotide
gtttagcgcagccttcaatttctatacccgctcac

SEQ ID NO: 197924 - DNA, 35 bp, Artificial Sequence
  Synthetic oligonucleotide
taacgctcgcccgcccctaacaggtctccgattac

SEQ ID NO: 197925 - DNA, 34 bp, Artificial Sequence
  Synthetic oligonucleotide
tcatggtcccgattgatccgccatctgttcaacc

SEQ ID NO: 197926 - DNA, 35 bp, Artificial Sequence
  Synthetic oligonucleotide
gcgcaatgtagctgtccatacgcttgcccgccccc

SEQ ID NO: 197927 - DNA, 35 bp, Artificial Sequence
  Synthetic oligonucleotide
tcatggcgaactaccggacgttacatctcgcgccc

SEQ ID NO: 197928 - DNA, 35 bp, Artificial Sequence
  Synthetic oligonucleotide
gcaggactagatgtcctcagttcctatcgtcgccc

SEQ ID NO: 197929 - DNA, 35 bp, Artificial Sequence
  Synthetic oligonucleotide
tgccgcaccgccggtcgtatctgcgctcgcctccc

SEQ ID NO: 197930 - DNA, 35 bp, Artificial Sequence
  Synthetic oligonucleotide
atgcaacgccctgacctatgtattcactgtttccc

SEQ ID NO: 197931 - DNA, 35 bp, Artificial Sequence
  Synthetic oligonucleotide
tactaccaccgatagtatgtaggccctcactcgcc

SEQ ID NO: 197932 - DNA, 35 bp, Artificial Sequence
  Synthetic oligonucleotide
aactcccgctccatgcgtctccaagcccctctgcc

SEQ ID NO: 197933 - DNA, 35 bp, Artificial Sequence
  Synthetic oligonucleotide
ggagacccagctgcgcttctgagccgccttattcc

SEQ ID NO: 197934 - DNA, 35 bp, Artificial Sequence
  Synthetic oligonucleotide
tctaacgcacatggatcccctagctcaccagttcc

SEQ ID NO: 197935 - DNA, 35 bp, Artificial Sequence
  Synthetic oligonucleotide
acgacgcaacgctgcttcacggttagctcctttcc

SEQ ID NO: 197936 - DNA, 35 bp, Artificial Sequence
  Synthetic oligonucleotide
tgcaaaaccgtcgcactttccgtaccgtgacctgc

SEQ ID NO: 197937 - DNA, 35 bp, Artificial Sequence
  Synthetic oligonucleotide
ggagccaaactgcttaatccttggacctctcctgc

SEQ ID NO: 197938 - DNA, 35 bp, Artificial Sequence
  Synthetic oligonucleotide
tcaccgcatctggcgtcttaagaatcgcccttatc

SEQ ID NO: 197939 - DNA, 35 bp, Artificial Sequence
  Synthetic oligonucleotide
gagatcgccaattgacgctgccccttatgtcactc

SEQ ID NO: 197940 - DNA, 35 bp, Artificial Sequence
  Synthetic oligonucleotide
tagatgtgccacggcgtgccgctcgttattgcctc

SEQ ID NO: 197941 - DNA, 35 bp, Artificial Sequence
  Synthetic oligonucleotide
ttcgaccggtaatgcaacgtgcggttattcttctc

SEQ ID NO: 197942 - DNA, 35 bp, Artificial Sequence
  Synthetic oligonucleotide
tgccatacatagctatactgttcgatcacaccttc

SEQ ID NO: 197943 - DNA, 35 bp, Artificial Sequence
  Synthetic oligonucleotide
tcaagagcgccgtggctcgtttacctactttcttc

SEQ ID NO: 197944 - DNA, 35 bp, Artificial Sequence
  Synthetic oligonucleotide
tagccttaccccgcgatctgcggtcccaaccgttc

SEQ ID NO: 197945 - DNA, 35 bp, Artificial Sequence
  Synthetic oligonucleotide
ccacactggcgccttgtcatcaccggccaactttc

SEQ ID NO: 197946 - DNA, 35 bp, Artificial Sequence
  Synthetic oligonucleotide
tacgcccggccgcctctcatcacctcagccatcag

SEQ ID NO: 197947 - DNA, 35 bp, Artificial Sequence
  Synthetic oligonucleotide
tcaccatccctcgcttgctgtacagtgtcattacg

SEQ ID NO: 197948 - DNA, 35 bp, Artificial Sequence
  Synthetic oligonucleotide
attgcaacctccatacccgtctatccctgactgcg

SEQ ID NO: 197949 - DNA, 35 bp, Artificial Sequence
  Synthetic oligonucleotide
ttactctgcccaccccctaatgcgttacaattgcg

SEQ ID NO: 197950 - DNA, 35 bp, Artificial Sequence
  Synthetic oligonucleotide
ggaccagactccaccccccgcaaccactgggctcg

SEQ ID NO: 197951 - DNA, 35 bp, Artificial Sequence
  Synthetic oligonucleotide
tccacgctccccgtaaactctttgcgatcctttcg

SEQ ID NO: 197952 - DNA, 35 bp, Artificial Sequence
  Synthetic oligonucleotide
acgatcgggtccgaaaggggagggtggaaggaagg

SEQ ID NO: 197953 - DNA, 35 bp, Artificial Sequence
  Synthetic oligonucleotide
agcggtgaggaggggtgaactggttggaaggacgg

SEQ ID NO: 197954 - DNA, 35 bp, Artificial Sequence
  Synthetic oligonucleotide
gtggccgagggtggggaggggtcttcaaaagtggg

SEQ ID NO: 197955 - DNA, 35 bp, Artificial Sequence
  Synthetic oligonucleotide
gaagtcatgagccttggggtggtattgggggtggg

SEQ ID NO: 197956 - DNA, 35 bp, Artificial Sequence
  Synthetic oligonucleotide
ggagggggaataatggaggtacagtgggcagcatg

SEQ ID NO: 197957 - DNA, 35 bp, Artificial Sequence
  Synthetic oligonucleotide
tgagaccaccctccctcctgttaagttatagcatg

SEQ ID NO: 197958 - DNA, 35 bp, Artificial Sequence
  Synthetic oligonucleotide
tcagaccatcgaatatctctagtaccccgcacctg

SEQ ID NO: 197959 - DNA, 35 bp, Artificial Sequence
  Synthetic oligonucleotide
tagcctgcggtaatccctcttcggtatcgtgcctg

SEQ ID NO: 197960 - DNA, 35 bp, Artificial Sequence
  Synthetic oligonucleotide
gacgggtcatgacgggtgggacagggcttggccat

SEQ ID NO: 197961 - DNA, 35 bp, Artificial Sequence
  Synthetic oligonucleotide
ggatgatgggcagggtggaagtaggtgcggaggat

SEQ ID NO: 197962 - DNA, 35 bp, Artificial Sequence
  Synthetic oligonucleotide
gcctccaccgcggtcacacgggcttccaaataact

SEQ ID NO: 197963 - DNA, 35 bp, Artificial Sequence
  Synthetic oligonucleotide
tgggaggaaggaggggtagtggtggacgggtgact

SEQ ID NO: 197964 - DNA, 35 bp, Artificial Sequence
  Synthetic oligonucleotide
gatagcatgcacatcatatagtctctgtcctcgct

SEQ ID NO: 197965 - DNA, 35 bp, Artificial Sequence
  Synthetic oligonucleotide
tgtggagggacgggaggcggtatagactgaatgct

SEQ ID NO: 197966 - DNA, 35 bp, Artificial Sequence
  Synthetic oligonucleotide
tgcggtgcctaagacttgtcattgtccacttctct

SEQ ID NO: 197967 - DNA, 35 bp, Artificial Sequence
  Synthetic oligonucleotide
tgtgctgtcatctgctctccagccgcccgacttct

SEQ ID NO: 197968 - DNA, 35 bp, Artificial Sequence
  Synthetic oligonucleotide
gcactagagtagtgttttgctcccgtgtcccttct

SEQ ID NO: 197969 - DNA, 35 bp, Artificial Sequence
  Synthetic oligonucleotide
gtcacactacgtcgagctctctctcacattgcatt

SEQ ID NO: 197970 - DNA, 35 bp, Artificial Sequence
  Synthetic oligonucleotide
acgtacttcccgatctcacacacacggtttcactt

SEQ ID NO: 197971 - DNA, 35 bp, Artificial Sequence
  Synthetic oligonucleotide
tcgtgactaaacgtctgtctcgcttcgctcccctt

SEQ ID NO: 197972 - DNA, 35 bp, Artificial Sequence
  Synthetic oligonucleotide
ttcatggaggaggaagggtaggagcggagaggctt

SEQ ID NO: 197973 - DNA, 35 bp, Artificial Sequence
  Synthetic oligonucleotide
atcgccgtccacccgtttagacgccccacgttctt

SEQ ID NO: 197974 - DNA, 36 bp, Artificial Sequence
  Synthetic oligonucleotide
gccgtggtcataacggaagggtggcgggaggggaaa

SEQ ID NO: 197975 - DNA, 36 bp, Artificial Sequence
  Synthetic oligonucleotide
gatcacacctcccggatcgagtagaaccgctctaaa

SEQ ID NO: 197976 - DNA, 36 bp, Artificial Sequence
  Synthetic oligonucleotide
tacaccgtatgtgtcaagggggcgaggggcgacgaa

SEQ ID NO: 197977 - DNA, 35 bp, Artificial Sequence
  Synthetic oligonucleotide
tttgtccactacgccgcctgttcgcccccgaggaa

SEQ ID NO: 197978 - DNA, 35 bp, Artificial Sequence
  Synthetic oligonucleotide
accacgtaaggtgcatctgcccccgaactcttgaa

SEQ ID NO: 197979 - DNA, 36 bp, Artificial Sequence
  Synthetic oligonucleotide
ggggacggtagggaaggaccgggcgaaggtgaaaca

SEQ ID NO: 197980 - DNA, 36 bp, Artificial Sequence
  Synthetic oligonucleotide
taaggaacaaggagtggaggaagctggtggaggaca

SEQ ID NO: 197981 - DNA, 36 bp, Artificial Sequence
  Synthetic oligonucleotide
ggagtgcggggggaaggggcaaagtaaaggcaccca

SEQ ID NO: 197982 - DNA, 36 bp, Artificial Sequence
  Synthetic oligonucleotide
tccacagtcacaaatcagctcggcatacttccccca

SEQ ID NO: 197983 - DNA, 36 bp, Artificial Sequence
  Synthetic oligonucleotide
aacccccatcgtactgcatgccttaggcgctgctca

SEQ ID NO: 197984 - DNA, 35 bp, Artificial Sequence
  Synthetic oligonucleotide
aaaatggcgggggagaggtgggagggagtaagtca

SEQ ID NO: 197985 - DNA, 36 bp, Artificial Sequence
  Synthetic oligonucleotide
agagtcagtcctccgttgccacaacactccctgtca

SEQ ID NO: 197986 - DNA, 36 bp, Artificial Sequence
  Synthetic oligonucleotide
gaactgggagaagggaagataacagcgagacctaga

SEQ ID NO: 197987 - DNA, 37 bp, Artificial Sequence
  Synthetic oligonucleotide
gtgaccggacagcaatgtcgcgttctatcctttccga

SEQ ID NO: 197988 - DNA, 37 bp, Artificial Sequence
  Synthetic oligonucleotide
gtttggcggggagggtgggtaacgctggagggagcga

SEQ ID NO: 197989 - DNA, 37 bp, Artificial Sequence
  Synthetic oligonucleotide
gccatcccccatcatgctgccttcgtcccagtctcga

SEQ ID NO: 197990 - DNA, 36 bp, Artificial Sequence
  Synthetic oligonucleotide
gacggggctcagtcggggaaaggaggagggtctcga

SEQ ID NO: 197991 - DNA, 37 bp, Artificial Sequence
  Synthetic oligonucleotide
gggtgggaggggcaacgttggtagggattcgattcga

SEQ ID NO: 197992 - DNA, 37 bp, Artificial Sequence
  Synthetic oligonucleotide
ggtgagactaaacggaaggtaggagggaggtatagga

SEQ ID NO: 197993 - DNA, 37 bp, Artificial Sequence
  Synthetic oligonucleotide
gcggaggtggccggggggagagcacgtgcggcaggga

SEQ ID NO: 197994 - DNA, 37 bp, Artificial Sequence
  Synthetic oligonucleotide
aacacggaggacacgggaaaggggatcgttgtaggga

SEQ ID NO: 197995 - DNA, 37 bp, Artificial Sequence
  Synthetic oligonucleotide
aacacgagcgcccgccctcctacgacatcccttggga

SEQ ID NO: 197996 - DNA, 37 bp, Artificial Sequence
  Synthetic oligonucleotide
atacagcgaacgaggggaaggggcaaggggtttggga

SEQ ID NO: 197997 - DNA, 37 bp, Artificial Sequence
  Synthetic oligonucleotide
acaccaaggtagggatagcggaggggacgggattgga

SEQ ID NO: 197998 - DNA, 37 bp, Artificial Sequence
  Synthetic oligonucleotide
tttggcgtgggtaaggggggaaggcgagtttggatga

SEQ ID NO: 197999 - DNA, 38 bp, Artificial Sequence
  Synthetic oligonucleotide
gtcctgcacagggctttttatggtgcctccctcactga

SEQ ID NO: 198000 - DNA, 37 bp, Artificial Sequence
  Synthetic oligonucleotide
aaccaccgagatgtcaccgctctgtccgtccccctga

SEQ ID NO: 198001 - DNA, 35 bp, Artificial Sequence
  Synthetic oligonucleotide
gctgatgcgatgcccttccgtgaaactactcctga

SEQ ID NO: 198002 - DNA, 38 bp, Artificial Sequence
  Synthetic oligonucleotide
acacctgtgccatcgacgttttcttagctctcatctga

SEQ ID NO: 198003 - DNA, 38 bp, Artificial Sequence
  Synthetic oligonucleotide
ttagcgcgggaggagggaacacgggtgtgcgtaggtga

SEQ ID NO: 198004 - DNA, 38 bp, Artificial Sequence
  Synthetic oligonucleotide
gtgggggggaagagagggtattcaggacgtccgggtga

SEQ ID NO: 198005 - DNA, 35 bp, Artificial Sequence
  Synthetic oligonucleotide
tcccacttcgatcatataccttcgccattctgtga

SEQ ID NO: 198006 - DNA, 38 bp, Artificial Sequence
  Synthetic oligonucleotide
tgccaacacagtgtctcccggttcactcttactcttga

SEQ ID NO: 198007 - DNA, 38 bp, Artificial Sequence
  Synthetic oligonucleotide
ggacccaccctcagccgctgtgtcgctcctcgtcttga

SEQ ID NO: 198008 - DNA, 36 bp, Artificial Sequence
  Synthetic oligonucleotide
gtggcccacgtcagtcgtccttccgtcctgtcttga

SEQ ID NO: 198009 - DNA, 36 bp, Artificial Sequence
  Synthetic oligonucleotide
gagagggagtggccggaaggagtacgcgtgagttga

SEQ ID NO: 198010 - DNA, 38 bp, Artificial Sequence
  Synthetic oligonucleotide
tacttcgcccctgctgtttctctaggtgttctcgttga

SEQ ID NO: 198011 - DNA, 38 bp, Artificial Sequence
  Synthetic oligonucleotide
gcgtgcccctctatatgccttacgtcgccccgatttga

SEQ ID NO: 198012 - DNA, 38 bp, Artificial Sequence
  Synthetic oligonucleotide
accctggtctcatgcctatccccgcggtccttgtttga

SEQ ID NO: 198013 - DNA, 36 bp, Artificial Sequence
  Synthetic oligonucleotide
tctgctccacccttcattgcaactcacagtttttga

SEQ ID NO: 198014 - DNA, 36 bp, Artificial Sequence
  Synthetic oligonucleotide
atccacgtcaagcaaggggtgggggggaagttcata

SEQ ID NO: 198015 - DNA, 35 bp, Artificial Sequence
  Synthetic oligonucleotide
ttgaccggggtcagacggatcaggggggagggcta

SEQ ID NO: 198016 - DNA, 36 bp, Artificial Sequence
  Synthetic oligonucleotide
atgacccttacccgcccagagcttgtacgctaagta

SEQ ID NO: 198017 - DNA, 36 bp, Artificial Sequence
  Synthetic oligonucleotide
gacgagtgaaggaggttgggactggatatagaggta

SEQ ID NO: 198018 - DNA, 35 bp, Artificial Sequence
  Synthetic oligonucleotide
tcacctctctcgcccggacacgtctcccatcggta

SEQ ID NO: 198019 - DNA, 35 bp, Artificial Sequence
  Synthetic oligonucleotide
gacccagggaagaattgggatgggaatatagggta

SEQ ID NO: 198020 - DNA, 36 bp, Artificial Sequence
  Synthetic oligonucleotide
gtcaggggcggagagatagggggcgttcggagtgta

SEQ ID NO: 198021 - DNA, 36 bp, Artificial Sequence
  Synthetic oligonucleotide
gcccccctgctgtcttggactgcctcttgctactta

SEQ ID NO: 198022 - DNA, 35 bp, Artificial Sequence
  Synthetic oligonucleotide
gcacacctttcacatcgtcgtctcagatgcccaac

SEQ ID NO: 198023 - DNA, 35 bp, Artificial Sequence
  Synthetic oligonucleotide
acctcacggctcggatacgtagcgcctctctacac

SEQ ID NO: 198024 - DNA, 35 bp, Artificial Sequence
  Synthetic oligonucleotide
gcgacttccatcagaccgttacccccgcaactcac

SEQ ID NO: 198025 - DNA, 35 bp, Artificial Sequence
  Synthetic oligonucleotide
gcccatcgtagcatgccagcctccccactctcgac

SEQ ID NO: 198026 - DNA, 35 bp, Artificial Sequence
  Synthetic oligonucleotide
gactgtctcccatgctcgattagccctcccgatac

SEQ ID NO: 198027 - DNA, 35 bp, Artificial Sequence
  Synthetic oligonucleotide
gccatcccatcccatctgtctcacgtactctttac

SEQ ID NO: 198028 - DNA, 35 bp, Artificial Sequence
  Synthetic oligonucleotide
taaccctgtcatgccgccctttgctcccaaagacc

SEQ ID NO: 198029 - DNA, 35 bp, Artificial Sequence
  Synthetic oligonucleotide
tcacgcctcgccctttgactatgaccttcccgacc

SEQ ID NO: 198030 - DNA, 35 bp, Artificial Sequence
  Synthetic oligonucleotide
ttacgtgtcgccattggtgtaccatccctgctacc

SEQ ID NO: 198031 - DNA, 35 bp, Artificial Sequence
  Synthetic oligonucleotide
gccatgtagatcgaattgtactccgcctttctacc

SEQ ID NO: 198032 - DNA, 35 bp, Artificial Sequence
  Synthetic oligonucleotide
actcatgcacactctccgtatctagtcgttgaccc

SEQ ID NO: 198033 - DNA, 35 bp, Artificial Sequence
  Synthetic oligonucleotide
gagcactggctgtgcagaacgtcgagtctcccccc

SEQ ID NO: 198034 - DNA, 35 bp, Artificial Sequence
  Synthetic oligonucleotide
acaagccgccccatccgtcctcatgatagccgccc

SEQ ID NO: 198035 - DNA, 35 bp, Artificial Sequence
  Synthetic oligonucleotide
gttcagtgcagtcgcaatctaatcccactatgccc

SEQ ID NO: 198036 - DNA, 35 bp, Artificial Sequence
  Synthetic oligonucleotide
gagcactcgccgctcctaatgccagttcttgtccc

SEQ ID NO: 198037 - DNA, 35 bp, Artificial Sequence
  Synthetic oligonucleotide
atcgcggccagagatgtgtgcttcccgccattccc

SEQ ID NO: 198038 - DNA, 35 bp, Artificial Sequence
  Synthetic oligonucleotide
tagacagtattgcgcgttatacacgtccccttgcc

SEQ ID NO: 198039 - DNA, 35 bp, Artificial Sequence
  Synthetic oligonucleotide
gtccaccgcgccaggtatacatcttccccgtgcgc

SEQ ID NO: 198040 - DNA, 35 bp, Artificial Sequence
  Synthetic oligonucleotide
gaagaccccgtacatcgatatctagccaccctcgc

SEQ ID NO: 198041 - DNA, 35 bp, Artificial Sequence
  Synthetic oligonucleotide
atcgcgtgccttcccgtgtaccatcccccttaggc

SEQ ID NO: 198042 - DNA, 35 bp, Artificial Sequence
  Synthetic oligonucleotide
atggaggaacaggcaaaggcgagtatggaaggggc

SEQ ID NO: 198043 - DNA, 35 bp, Artificial Sequence
  Synthetic oligonucleotide
ttccacgccgccacgatcttcacactcacacctgc

SEQ ID NO: 198044 - DNA, 35 bp, Artificial Sequence
  Synthetic oligonucleotide
tatagccatcccccgttcgctgcgtcttatcaatc

SEQ ID NO: 198045 - DNA, 35 bp, Artificial Sequence
  Synthetic oligonucleotide
gtgcgggtgagccgctttaatttccctgttctatc

SEQ ID NO: 198046 - DNA, 35 bp, Artificial Sequence
  Synthetic oligonucleotide
tgttgcacgccttaatgcctggaccctttaacctc

SEQ ID NO: 198047 - DNA, 35 bp, Artificial Sequence
  Synthetic oligonucleotide
gctgcgatcaatggcttcaaccggtacttcttctc

SEQ ID NO: 198048 - DNA, 35 bp, Artificial Sequence
  Synthetic oligonucleotide
gaccctccgatctccgtgctcttagacttcaggtc

SEQ ID NO: 198049 - DNA, 35 bp, Artificial Sequence
  Synthetic oligonucleotide
accatcccgggtgccatgacctggccaatcatgtc

SEQ ID NO: 198050 - DNA, 35 bp, Artificial Sequence
  Synthetic oligonucleotide
tacgacgagagatccacggcgttcctgatcccttc

SEQ ID NO: 198051 - DNA, 35 bp, Artificial Sequence
  Synthetic oligonucleotide
gacattcacgtaagtcgcgttttttacacctgttc

SEQ ID NO: 198052 - DNA, 35 bp, Artificial Sequence
  Synthetic oligonucleotide
ggagaggggaagggttgttaaaactcgggtaacag

SEQ ID NO: 198053 - DNA, 35 bp, Artificial Sequence
  Synthetic oligonucleotide
gcacatttagtggagaagggggacggagactggag

SEQ ID NO: 198054 - DNA, 35 bp, Artificial Sequence
  Synthetic oligonucleotide
tctcacctacgatcctgaccatagcgccatccacg

SEQ ID NO: 198055 - DNA, 35 bp, Artificial Sequence
  Synthetic oligonucleotide
gtgccacgggcaccgataacgactcacttcctacg

SEQ ID NO: 198056 - DNA, 35 bp, Artificial Sequence
  Synthetic oligonucleotide
gaaggggaaaaggtcgagtcgggggtggcgagagg

SEQ ID NO: 198057 - DNA, 35 bp, Artificial Sequence
  Synthetic oligonucleotide
tagccccttcacccagtctaatacgtcccactagg

SEQ ID NO: 198058 - DNA, 36 bp, Artificial Sequence
  Synthetic oligonucleotide
gttgaggcaacgagtaaggaaaggggagtagaacgg

SEQ ID NO: 198059 - DNA, 35 bp, Artificial Sequence
  Synthetic oligonucleotide
atacccgttccccttcgcctgccaatgccaatcgg

SEQ ID NO: 198060 - DNA, 35 bp, Artificial Sequence
  Synthetic oligonucleotide
gccgacgccggtggtgtccattttttccgctctgg

SEQ ID NO: 198061 - DNA, 35 bp, Artificial Sequence
  Synthetic oligonucleotide
tagccgccccaattgcgcaatgtgaattacccctg

SEQ ID NO: 198062 - DNA, 35 bp, Artificial Sequence
  Synthetic oligonucleotide
gtacgggtgcgggtggggtgtcggaactgggagat

SEQ ID NO: 198063 - DNA, 35 bp, Artificial Sequence
  Synthetic oligonucleotide
gtccaacctcgagatctcttatcgtcccatccgat

SEQ ID NO: 198064 - DNA, 35 bp, Artificial Sequence
  Synthetic oligonucleotide
tccattccagggccctcctttcctacaatgagact

SEQ ID NO: 198065 - DNA, 35 bp, Artificial Sequence
  Synthetic oligonucleotide
atcgcaacgccctttgttacggtcatcccccgact

SEQ ID NO: 198066 - DNA, 35 bp, Artificial Sequence
  Synthetic oligonucleotide
tcacccgcctgaccctgttgttttgttcgtcacct

SEQ ID NO: 198067 - DNA, 35 bp, Artificial Sequence
  Synthetic oligonucleotide
gttcagtagctcttcccatccttgtatcgtaccct

SEQ ID NO: 198068 - DNA, 35 bp, Artificial Sequence
  Synthetic oligonucleotide
ttcgcgcctatgttatcatacacttctctgtccct

SEQ ID NO: 198069 - DNA, 35 bp, Artificial Sequence
  Synthetic oligonucleotide
atggtagccccctctgcgagtatgttaccgttcct

SEQ ID NO: 198070 - DNA, 35 bp, Artificial Sequence
  Synthetic oligonucleotide
tccgcgcctcaccttttctaagtccggtctgtgct

SEQ ID NO: 198071 - DNA, 35 bp, Artificial Sequence
  Synthetic oligonucleotide
gccaccctcgaagcaataaccgtctgtctctctct

SEQ ID NO: 198072 - DNA, 35 bp, Artificial Sequence
  Synthetic oligonucleotide
gaaatgggaggaaggtggtaggtagagttcgtcgt

SEQ ID NO: 198073 - DNA, 35 bp, Artificial Sequence
  Synthetic oligonucleotide
ggacacgccgcgaactaactgcacccatcctatgt

SEQ ID NO: 198074 - DNA, 35 bp, Artificial Sequence
  Synthetic oligonucleotide
atcgcgcagccgctagatcccccttccccggctgt

SEQ ID NO: 198075 - DNA, 35 bp, Artificial Sequence
  Synthetic oligonucleotide
tgcctgaaccgactggtacccgtgccctgctttgt

SEQ ID NO: 198076 - DNA, 35 bp, Artificial Sequence
  Synthetic oligonucleotide
gtccccgcttcccctggtgatctccgcgcctgatt

SEQ ID NO: 198077 - DNA, 35 bp, Artificial Sequence
  Synthetic oligonucleotide
gaacagcagaaggtggggatggggcatgggaactt

SEQ ID NO: 198078 - DNA, 35 bp, Artificial Sequence
  Synthetic oligonucleotide
agtgtatgcccagatccaatcgccgtactgccttt

SEQ ID NO: 198079 - DNA, 35 bp, Artificial Sequence
  Synthetic oligonucleotide
gacccaccgcacgcctgtaagcttcctgccctttt

SEQ ID NO: 198080 - DNA, 36 bp, Artificial Sequence
  Synthetic oligonucleotide
gtgataccgccttcacctttgtttagtgaaaacaaa

SEQ ID NO: 198081 - DNA, 35 bp, Artificial Sequence
  Synthetic oligonucleotide
aacacgggccagggggggggtactgcctatgcaaa

SEQ ID NO: 198082 - DNA, 36 bp, Artificial Sequence
  Synthetic oligonucleotide
ttagggagggggaggttgtgaccatggggacagaaa

SEQ ID NO: 198083 - DNA, 36 bp, Artificial Sequence
  Synthetic oligonucleotide
gtgccataggtgggggggaggagtacgggccataaa

SEQ ID NO: 198084 - DNA, 35 bp, Artificial Sequence
  Synthetic oligonucleotide
gacgcctcgggcccttcttatcgtatccactacaa

SEQ ID NO: 198085 - DNA, 36 bp, Artificial Sequence
  Synthetic oligonucleotide
gagagacaacaagggcaggggggaagaatggaggaa

SEQ ID NO: 198086 - DNA, 36 bp, Artificial Sequence
  Synthetic oligonucleotide
gtcaacccccgccgctaataagagtcccgtttacca

SEQ ID NO: 198087 - DNA, 36 bp, Artificial Sequence
  Synthetic oligonucleotide
tagccccatcttagcgtgattagtcactacgcccca

SEQ ID NO: 198088 - DNA, 36 bp, Artificial Sequence
  Synthetic oligonucleotide
gagtcgctgccctgctcctgttactagtccttgcca

SEQ ID NO: 198089 - DNA, 35 bp, Artificial Sequence
  Synthetic oligonucleotide
accaccccgcctctgaggttcgaagccaactggca

SEQ ID NO: 198090 - DNA, 36 bp, Artificial Sequence
  Synthetic oligonucleotide
agaggtacatgaggagggatgggaacgggtttggca

SEQ ID NO: 198091 - DNA, 36 bp, Artificial Sequence
  Synthetic oligonucleotide
tccacaagcgcaaacgtccggcgaactctcacttca

SEQ ID NO: 198092 - DNA, 35 bp, Artificial Sequence
  Synthetic oligonucleotide
acctcgctcccaaatgactggcgattcacttttca

SEQ ID NO: 198093 - DNA, 36 bp, Artificial Sequence
  Synthetic oligonucleotide
agaggacgagggaaaaaagaggtagtggcaggaaga

SEQ ID NO: 198094 - DNA, 37 bp, Artificial Sequence
  Synthetic oligonucleotide
ggactacagtgcgggaggacggacgggacggaggaga

SEQ ID NO: 198095 - DNA, 36 bp, Artificial Sequence
  Synthetic oligonucleotide
atacgggcggaacgggggtggagcggccgactgaga

SEQ ID NO: 198096 - DNA, 37 bp, Artificial Sequence
  Synthetic oligonucleotide
gcgcatgccaccatgtcactcttgctcccatctgaga

SEQ ID NO: 198097 - DNA, 35 bp, Artificial Sequence
  Synthetic oligonucleotide
tagactccaccattccgtgtttcaactaccataga

SEQ ID NO: 198098 - DNA, 37 bp, Artificial Sequence
  Synthetic oligonucleotide
aaacgcagtcgagggaagggaggcgggcaatgaccga

SEQ ID NO: 198099 - DNA, 37 bp, Artificial Sequence
  Synthetic oligonucleotide
tcagtcgctacgtgcctctaccttcttgtttctccga

SEQ ID NO: 198100 - DNA, 37 bp, Artificial Sequence
  Synthetic oligonucleotide
gtgagagtacgaaagggtggggggcgaggcactgcga

SEQ ID NO: 198101 - DNA, 37 bp, Artificial Sequence
  Synthetic oligonucleotide
tcccatccgccctactgggtagcagttctatctgcga

SEQ ID NO: 198102 - DNA, 36 bp, Artificial Sequence
  Synthetic oligonucleotide
atcgcgtgctgtacaccatgccctttcgccactcga

SEQ ID NO: 198103 - DNA, 37 bp, Artificial Sequence
  Synthetic oligonucleotide
gttccacccgtcgctatatgcgtaagcctcgactcga

SEQ ID NO: 198104 - DNA, 35 bp, Artificial Sequence
  Synthetic oligonucleotide
tactcaagcgccgctctctctttggaatacctcga

SEQ ID NO: 198105 - DNA, 35 bp, Artificial Sequence
  Synthetic oligonucleotide
tcaaagaggcgacaccttctgtaccttctcctcga

SEQ ID NO: 198106 - DNA, 35 bp, Artificial Sequence
  Synthetic oligonucleotide
tcctaagcgcgatccgccccccgccactatttcga

SEQ ID NO: 198107 - DNA, 36 bp, Artificial Sequence
  Synthetic oligonucleotide
tatcagacgtctgcaagggacatgggggggaaggga

SEQ ID NO: 198108 - DNA, 37 bp, Artificial Sequence
  Synthetic oligonucleotide
ttgagggcgggggggaatgagtcacctacgacgggga

SEQ ID NO: 198109 - DNA, 37 bp, Artificial Sequence
  Synthetic oligonucleotide
tctaacgggggcgaggtagcatatcggggagggggga

SEQ ID NO: 198110 - DNA, 37 bp, Artificial Sequence
  Synthetic oligonucleotide
tgtccagccatcacgtctcctttataccgcctactga

SEQ ID NO: 198111 - DNA, 36 bp, Artificial Sequence
  Synthetic oligonucleotide
gatccctccgtctcatccgtttgcgttactgtctga

SEQ ID NO: 198112 - DNA, 38 bp, Artificial Sequence
  Synthetic oligonucleotide
agaccggggagggaaggctaggaaagaacatcaggtga

SEQ ID NO: 198113 - DNA, 38 bp, Artificial Sequence
  Synthetic oligonucleotide
gagcaaaggaaggggacggaggtgtcgactgtctgtga

SEQ ID NO: 198114 - DNA, 37 bp, Artificial Sequence
  Synthetic oligonucleotide
gtgcgccttgctctaatcatgcccccagtcccattga

SEQ ID NO: 198115 - DNA, 37 bp, Artificial Sequence
  Synthetic oligonucleotide
ggaggtgttggggtggacttatggcggtacctgttga

SEQ ID NO: 198116 - DNA, 38 bp, Artificial Sequence
  Synthetic oligonucleotide
gaggacaacgggagggaggaagggcgacattactttga

SEQ ID NO: 198117 - DNA, 36 bp, Artificial Sequence
  Synthetic oligonucleotide
acctctcatcgcactgtttccatccagtaccttgta

SEQ ID NO: 198118 - DNA, 35 bp, Artificial Sequence
  Synthetic oligonucleotide
tcacgccccattggaccttacgctttgcgttctta

SEQ ID NO: 198119 - DNA, 36 bp, Artificial Sequence
  Synthetic oligonucleotide
gcccacttaacatctgcgtgagtccttggtttctta

SEQ ID NO: 198120 - DNA, 35 bp, Artificial Sequence
  Synthetic oligonucleotide
aaagggcgggccggggatcgtagggttttagcaac

SEQ ID NO: 198121 - DNA, 35 bp, Artificial Sequence
  Synthetic oligonucleotide
tagccgtctcagcgttatctattcactccatcaac

SEQ ID NO: 198122 - DNA, 35 bp, Artificial Sequence
  Synthetic oligonucleotide
gatgcgccggcccccctcgttgcggtcaacataac

SEQ ID NO: 198123 - DNA, 35 bp, Artificial Sequence
  Synthetic oligonucleotide
gtacccagtagggcgaagggcgggtgagggttaac

SEQ ID NO: 198124 - DNA, 34 bp, Artificial Sequence
  Synthetic oligonucleotide
gtaccacccgggcggatcgtgattaaccccgcac

SEQ ID NO: 198125 - DNA, 35 bp, Artificial Sequence
  Synthetic oligonucleotide
gcatgccgccctctcattacgtctactagccgcac

SEQ ID NO: 198126 - DNA, 35 bp, Artificial Sequence
  Synthetic oligonucleotide
gtgacctcactgctgtttcactacattctcccgac

SEQ ID NO: 198127 - DNA, 35 bp, Artificial Sequence
  Synthetic oligonucleotide
accgccccttcgcaataagggcatccattctatac

SEQ ID NO: 198128 - DNA, 35 bp, Artificial Sequence
  Synthetic oligonucleotide
ttgcaccatccagccgttggttcgcctgcattacc

SEQ ID NO: 198129 - DNA, 35 bp, Artificial Sequence
  Synthetic oligonucleotide
tctggtgcaacagaaggccgtaccccccgtcaccc

SEQ ID NO: 198130 - DNA, 35 bp, Artificial Sequence
  Synthetic oligonucleotide
gtaccggtcgtaacttgggtaagccatacccgccc

SEQ ID NO: 198131 - DNA, 35 bp, Artificial Sequence
  Synthetic oligonucleotide
gacggtgcaatatggacgcgtcaacctcttctccc

SEQ ID NO: 198132 - DNA, 35 bp, Artificial Sequence
  Synthetic oligonucleotide
aactctaccacacgtgagtcatatcatccattccc

SEQ ID NO: 198133 - DNA, 35 bp, Artificial Sequence
  Synthetic oligonucleotide
tgcgatccccctctgctgttttttattgcgcctcc

SEQ ID NO: 198134 - DNA, 35 bp, Artificial Sequence
  Synthetic oligonucleotide
tatcgtgccactgtcccctgtcatacgtcctttcc

SEQ ID NO: 198135 - DNA, 35 bp, Artificial Sequence
  Synthetic oligonucleotide
tttgcactgtgttatgtgttcttctgcccttttcc

SEQ ID NO: 198136 - DNA, 35 bp, Artificial Sequence
  Synthetic oligonucleotide
tgttcagccctgctgttgccctcaaacaccaccgc

SEQ ID NO: 198137 - DNA, 31 bp, Artificial Sequence
  Synthetic oligonucleotide
gtgccgccatcgcagagaacttcttcaccgc

SEQ ID NO: 198138 - DNA, 35 bp, Artificial Sequence
  Synthetic oligonucleotide
ttggctgacttaagcgttattgctgccacccccgc

SEQ ID NO: 198139 - DNA, 35 bp, Artificial Sequence
  Synthetic oligonucleotide
agccgcgattgcctgaactattacgtccttcctgc

SEQ ID NO: 198140 - DNA, 35 bp, Artificial Sequence
  Synthetic oligonucleotide
tgagccccccgcaatttgctacactaactatgatc

SEQ ID NO: 198141 - DNA, 35 bp, Artificial Sequence
  Synthetic oligonucleotide
acatccagccgtgcgccgtactcaggcttacactc

SEQ ID NO: 198142 - DNA, 35 bp, Artificial Sequence
  Synthetic oligonucleotide
aagaacagctcagctattctagccatcgtgccctc

SEQ ID NO: 198143 - DNA, 35 bp, Artificial Sequence
  Synthetic oligonucleotide
acagggcacaaccgcatgtatgcccggtcttcctc

SEQ ID NO: 198144 - DNA, 35 bp, Artificial Sequence
  Synthetic oligonucleotide
gatcgtgcccgtgcagagttgctccatcgttcctc

SEQ ID NO: 198145 - DNA, 35 bp, Artificial Sequence
  Synthetic oligonucleotide
gaggatgaaaaggggggtattcggcgagagacgtc

SEQ ID NO: 198146 - DNA, 35 bp, Artificial Sequence
  Synthetic oligonucleotide
agagcgcagaattggttggctctccgttccctgtc

SEQ ID NO: 198147 - DNA, 35 bp, Artificial Sequence
  Synthetic oligonucleotide
acgtcccgacgctggttatttggccccagcccttc

SEQ ID NO: 198148 - DNA, 35 bp, Artificial Sequence
  Synthetic oligonucleotide
tgcctgtaccgccgtgaccactgttgtcctccttc

SEQ ID NO: 198149 - DNA, 35 bp, Artificial Sequence
  Synthetic oligonucleotide
gaccccctgttagtacctcgtcgccactttccttc

SEQ ID NO: 198150 - DNA, 35 bp, Artificial Sequence
  Synthetic oligonucleotide
ggaccgcggcaaattccgttccatcgatctttttc

SEQ ID NO: 198151 - DNA, 35 bp, Artificial Sequence
  Synthetic oligonucleotide
gttatggcaggtggcacacgggaggaagggggaag

SEQ ID NO: 198152 - DNA, 35 bp, Artificial Sequence
  Synthetic oligonucleotide
aaagggtcaagagcggtagaggggaggagaaaacg

SEQ ID NO: 198153 - DNA, 35 bp, Artificial Sequence
  Synthetic oligonucleotide
acacgcaaggggggacgagaaggggcaagacaacg

SEQ ID NO: 198154 - DNA, 35 bp, Artificial Sequence
  Synthetic oligonucleotide
atgacgcggcccccgtgcttctacaactcccaccg

SEQ ID NO: 198155 - DNA, 35 bp, Artificial Sequence
  Synthetic oligonucleotide
gatcgccctccgctcgcaattttctagatcccccg

SEQ ID NO: 198156 - DNA, 35 bp, Artificial Sequence
  Synthetic oligonucleotide
tcgtagagtcactggttcacattttctccatcccg

SEQ ID NO: 198157 - DNA, 34 bp, Artificial Sequence
  Synthetic oligonucleotide
tcacaccaacaccaactattaagaccgctgcgcg

SEQ ID NO: 198158 - DNA, 35 bp, Artificial Sequence
  Synthetic oligonucleotide
acatgtccctgcacagcggatacccctgcccatcg

SEQ ID NO: 198159 - DNA, 35 bp, Artificial Sequence
  Synthetic oligonucleotide
gatccttgcctcgactggtagccattgtttcatcg

SEQ ID NO: 198160 - DNA, 35 bp, Artificial Sequence
  Synthetic oligonucleotide
ttggatggagaggggtggtgacttatgaggaaagg

SEQ ID NO: 198161 - DNA, 35 bp, Artificial Sequence
  Synthetic oligonucleotide
gctaggggtaaagcggtgaatggaagggagtaagg

SEQ ID NO: 198162 - DNA, 35 bp, Artificial Sequence
  Synthetic oligonucleotide
ttgtgcctccctctctagcgggtcatccctccggg

SEQ ID NO: 198163 - DNA, 35 bp, Artificial Sequence
  Synthetic oligonucleotide
acgacatgaggagttcgggaaaggtgagggtcggg

SEQ ID NO: 198164 - DNA, 35 bp, Artificial Sequence
  Synthetic oligonucleotide
aggatgtgccgtccggtgttagcctttcttccctg

SEQ ID NO: 198165 - DNA, 33 bp, Artificial Sequence
  Synthetic oligonucleotide
acactccggccccatccgtgatccacttctctg

SEQ ID NO: 198166 - DNA, 35 bp, Artificial Sequence
  Synthetic oligonucleotide
ttacgtcgaaggcgccatgttcttcccggtccttg

SEQ ID NO: 198167 - DNA, 35 bp, Artificial Sequence
  Synthetic oligonucleotide
acataccacctaacatgttcgccgttccgctcttg

SEQ ID NO: 198168 - DNA, 34 bp, Artificial Sequence
  Synthetic oligonucleotide
gtactccccctccaatccgtgttagtttgtaact

SEQ ID NO: 198169 - DNA, 35 bp, Artificial Sequence
  Synthetic oligonucleotide
acccacaacgtgcaacttctgctatgcttcccact

SEQ ID NO: 198170 - DNA, 35 bp, Artificial Sequence
  Synthetic oligonucleotide
ttctgcactgcgttggttatgaaccctactcccct

SEQ ID NO: 198171 - DNA, 35 bp, Artificial Sequence
  Synthetic oligonucleotide
gactcgctacaggtcgcgtaatccccgtcagccct

SEQ ID NO: 198172 - DNA, 35 bp, Artificial Sequence
  Synthetic oligonucleotide
tgacacaccaactgctggcttctggttccaacgct

SEQ ID NO: 198173 - DNA, 35 bp, Artificial Sequence
  Synthetic oligonucleotide
gcccccacctccgtcgcatcttcgtgcgctgctct

SEQ ID NO: 198174 - DNA, 35 bp, Artificial Sequence
  Synthetic oligonucleotide
cccactcgccttgcatgacttgtctagttgccctt

SEQ ID NO: 198175 - DNA, 35 bp, Artificial Sequence
  Synthetic oligonucleotide
acacaccgccactccttttactgccagcccctctt

SEQ ID NO: 198176 - DNA, 35 bp, Artificial Sequence
  Synthetic oligonucleotide
tcgaacgaacggagaagacgaacaaggggggggtt

SEQ ID NO: 198177 - DNA, 35 bp, Artificial Sequence
  Synthetic oligonucleotide
ggatacgatcatcgcgttactgtctcccctatgtt

SEQ ID NO: 198178 - DNA, 35 bp, Artificial Sequence
  Synthetic oligonucleotide
tccagcgctgcccttccgagttatgttactacttt

SEQ ID NO: 198179 - DNA, 36 bp, Artificial Sequence
  Synthetic oligonucleotide
aacgcgagaacggggaaaaacaaacggagaggtaaa

SEQ ID NO: 198180 - DNA, 35 bp, Artificial Sequence
  Synthetic oligonucleotide
ttatccacctccgccagtaactgtcctagttacaa

SEQ ID NO: 198181 - DNA, 35 bp, Artificial Sequence
  Synthetic oligonucleotide
aagaagggaagaagcgacagggaaaggaaccgcaa

SEQ ID NO: 198182 - DNA, 35 bp, Artificial Sequence
  Synthetic oligonucleotide
acctggccaccccgctctgtccagtaccatacgaa

SEQ ID NO: 198183 - DNA, 36 bp, Artificial Sequence
  Synthetic oligonucleotide
tcatcgctcctgcctgtccatacgtccacgccataa

SEQ ID NO: 198184 - DNA, 36 bp, Artificial Sequence
  Synthetic oligonucleotide
gcgacgcatacgtttcgtcgccattgatcactttaa

SEQ ID NO: 198185 - DNA, 36 bp, Artificial Sequence
  Synthetic oligonucleotide
gagtgaggtcagcggtcaaggggggcgggaataaca

SEQ ID NO: 198186 - DNA, 36 bp, Artificial Sequence
  Synthetic oligonucleotide
acatccagccctatgccaagcgctgcccacactaca

SEQ ID NO: 198187 - DNA, 36 bp, Artificial Sequence
  Synthetic oligonucleotide
tgtacgccacttctgcttatttgcccctgtactaca

SEQ ID NO: 198188 - DNA, 35 bp, Artificial Sequence
  Synthetic oligonucleotide
gacacaccaggttgtccggtctccaagtctcccca

SEQ ID NO: 198189 - DNA, 36 bp, Artificial Sequence
  Synthetic oligonucleotide
tgctacatgatctgcgtcagccaccgccctgatcca

SEQ ID NO: 198190 - DNA, 36 bp, Artificial Sequence
  Synthetic oligonucleotide
tgatgaagaggggactagggggtatgacagatagca

SEQ ID NO: 198191 - DNA, 36 bp, Artificial Sequence
  Synthetic oligonucleotide
gctccccctgcgaagtgtccctgccccatcctagca

SEQ ID NO: 198192 - DNA, 35 bp, Artificial Sequence
  Synthetic oligonucleotide
gacgtgggaaggcaggagaggggaaggtggaggca

SEQ ID NO: 198193 - DNA, 33 bp, Artificial Sequence
  Synthetic oligonucleotide
gtccccgcccccctcgttcaccacagcctggca

SEQ ID NO: 198194 - DNA, 36 bp, Artificial Sequence
  Synthetic oligonucleotide
gtgcgggtgggtgggtggcatgcgtagtggaaatca

SEQ ID NO: 198195 - DNA, 36 bp, Artificial Sequence
  Synthetic oligonucleotide
tacccgcgcccaagcagccgtaaccatacttcttca

SEQ ID NO: 198196 - DNA, 37 bp, Artificial Sequence
  Synthetic oligonucleotide
gactaggagcatgaaggcgggaggaagccggggaaga

SEQ ID NO: 198197 - DNA, 37 bp, Artificial Sequence
  Synthetic oligonucleotide
tagctgaggacgggaaagggagagctggcgatggaga

SEQ ID NO: 198198 - DNA, 37 bp, Artificial Sequence
  Synthetic oligonucleotide
tacaccacacaagcgctgtcaagtgcctcctatccga

SEQ ID NO: 198199 - DNA, 37 bp, Artificial Sequence
  Synthetic oligonucleotide
taactagcaccatcagctcgctccagacctcctccga

SEQ ID NO: 198200 - DNA, 35 bp, Artificial Sequence
  Synthetic oligonucleotide
tgcgccatccgcttgggctattccacgtgctccga

SEQ ID NO: 198201 - DNA, 37 bp, Artificial Sequence
  Synthetic oligonucleotide
tcaaggtacgagggggactggagatgggaagggcgga

SEQ ID NO: 198202 - DNA, 37 bp, Artificial Sequence
  Synthetic oligonucleotide
tgacggagggcgggatggggagttcgaaacaatcgga

SEQ ID NO: 198203 - DNA, 37 bp, Artificial Sequence
  Synthetic oligonucleotide
agaaggggccggggggacgagtggggactgaaaggga

SEQ ID NO: 198204 - DNA, 37 bp, Artificial Sequence
  Synthetic oligonucleotide
gacgccgggacaaatcgcgttttgggaaaggggggga

SEQ ID NO: 198205 - DNA, 37 bp, Artificial Sequence
  Synthetic oligonucleotide
acgtcaaagggaggagaggggagaccgcgggatggga

SEQ ID NO: 198206 - DNA, 37 bp, Artificial Sequence
  Synthetic oligonucleotide
gagcagagcactcaaaaggggaaagggcggtatggga

SEQ ID NO: 198207 - DNA, 37 bp, Artificial Sequence
  Synthetic oligonucleotide
tgactccgggagggtgggagcatcgccgtgggcatga

SEQ ID NO: 198208 - DNA, 35 bp, Artificial Sequence
  Synthetic oligonucleotide
gaaagccacttacgctgcacatcataactccctga

SEQ ID NO: 198209 - DNA, 37 bp, Artificial Sequence
  Synthetic oligonucleotide
tgatcagggggggggtaagtagaagaggcaacagtga

SEQ ID NO: 198210 - DNA, 38 bp, Artificial Sequence
  Synthetic oligonucleotide
tagtaagggaagaggtgggaacaggggataagtagtga

SEQ ID NO: 198211 - DNA, 38 bp, Artificial Sequence
  Synthetic oligonucleotide
ggggcggggacagctggggttcaatgtacagggggtga

SEQ ID NO: 198212 - DNA, 37 bp, Artificial Sequence
  Synthetic oligonucleotide
ttccgcacaactgccgattaacatcctccaccattga

SEQ ID NO: 198213 - DNA, 38 bp, Artificial Sequence
  Synthetic oligonucleotide
atcgcttcacccgcacatgcttaggccgacccgcttga

SEQ ID NO: 198214 - DNA, 36 bp, Artificial Sequence
  Synthetic oligonucleotide
taccgcgccttcgtttctacctcttcatacgtttga

SEQ ID NO: 198215 - DNA, 36 bp, Artificial Sequence
  Synthetic oligonucleotide
gacgagggttggaagggggtaggtaacatgcgcata

SEQ ID NO: 198216 - DNA, 36 bp, Artificial Sequence
  Synthetic oligonucleotide
aacactgcagggtgaatggacgtggtgggagggata

SEQ ID NO: 198217 - DNA, 35 bp, Artificial Sequence
  Synthetic oligonucleotide
actcccacacctagagcgcgactgcactcaaccta

SEQ ID NO: 198218 - DNA, 36 bp, Artificial Sequence
  Synthetic oligonucleotide
attgcccgttccgacgtacatgcatcaactctccta

SEQ ID NO: 198219 - DNA, 36 bp, Artificial Sequence
  Synthetic oligonucleotide
gaccccgccctgaccgttctatatgctcacttgcta

SEQ ID NO: 198220 - DNA, 35 bp, Artificial Sequence
  Synthetic oligonucleotide
ttcagcctcggacgttcccctgtggtcctgcatta

SEQ ID NO: 198221 - DNA, 36 bp, Artificial Sequence
  Synthetic oligonucleotide
tccgaccacggttccacttttttcctcctgtgctta

SEQ ID NO: 198222 - DNA, 35 bp, Artificial Sequence
  Synthetic oligonucleotide
gcatcccgccagaactcgttattcccctactacac

SEQ ID NO: 198223 - DNA, 35 bp, Artificial Sequence
  Synthetic oligonucleotide
gtcgcatgatagtatcgctttcgccccggttccac

SEQ ID NO: 198224 - DNA, 35 bp, Artificial Sequence
  Synthetic oligonucleotide
tgcggtaccgttgagatcggccccctctcgttcac

SEQ ID NO: 198225 - DNA, 35 bp, Artificial Sequence
  Synthetic oligonucleotide
tatgccaatcgcagccccgtttttccctcaacgac

SEQ ID NO: 198226 - DNA, 35 bp, Artificial Sequence
  Synthetic oligonucleotide
aagtcgagcgttcgtgcggcgctgctatccacccc

SEQ ID NO: 198227 - DNA, 35 bp, Artificial Sequence
  Synthetic oligonucleotide
tcagcacatttgttctatcgtcagctgcatccccc

SEQ ID NO: 198228 - DNA, 35 bp, Artificial Sequence
  Synthetic oligonucleotide
tacaggcccaatggtgtttgcccacgtccctcccc

SEQ ID NO: 198229 - DNA, 35 bp, Artificial Sequence
  Synthetic oligonucleotide
gccctgcgccgtttggcctcccgagatccccgccc

SEQ ID NO: 198230 - DNA, 35 bp, Artificial Sequence
  Synthetic oligonucleotide
gtacgtccagctacatttgtagccttgtctcgccc

SEQ ID NO: 198231 - DNA, 35 bp, Artificial Sequence
  Synthetic oligonucleotide
tggactcgtccacatgctcgtcatctcgtttgccc

SEQ ID NO: 198232 - DNA, 35 bp, Artificial Sequence
  Synthetic oligonucleotide
gagacgctgtatcgacgtctgtatcatttcgtccc

SEQ ID NO: 198233 - DNA, 35 bp, Artificial Sequence
  Synthetic oligonucleotide
aggacgccccactagtcttacagtgcgcatttccc

SEQ ID NO: 198234 - DNA, 35 bp, Artificial Sequence
  Synthetic oligonucleotide
tttagctcgcccgtcatgactattagcctcccgcc

SEQ ID NO: 198235 - DNA, 35 bp, Artificial Sequence
  Synthetic oligonucleotide
taacaccacgcccggccgttattcagcattccgcc

SEQ ID NO: 198236 - DNA, 35 bp, Artificial Sequence
  Synthetic oligonucleotide
accgaccacgaccgacatgtaaatgcacctctgcc

SEQ ID NO: 198237 - DNA, 35 bp, Artificial Sequence
  Synthetic oligonucleotide
tccgtacgcatagtgaagtgctctcgtccccatcc

SEQ ID NO: 198238 - DNA, 35 bp, Artificial Sequence
  Synthetic oligonucleotide
gtgtccacggcctctgacctatctattctgcctgc

SEQ ID NO: 198239 - DNA, 35 bp, Artificial Sequence
  Synthetic oligonucleotide
tcacacccttcccatggacatggagccttacttgc

SEQ ID NO: 198240 - DNA, 35 bp, Artificial Sequence
  Synthetic oligonucleotide
gatgcgtctgccttggaatttcccacctgttttgc

SEQ ID NO: 198241 - DNA, 35 bp, Artificial Sequence
  Synthetic oligonucleotide
gaagggcagtaacgccacctggacctcctccactc

SEQ ID NO: 198242 - DNA, 35 bp, Artificial Sequence
  Synthetic oligonucleotide
tcacaccgcctgtgccctttagctcctcaaccctc

SEQ ID NO: 198243 - DNA, 35 bp, Artificial Sequence
  Synthetic oligonucleotide
gtgtcaccgagcttttaactgcccgaatgttcctc

SEQ ID NO: 198244 - DNA, 35 bp, Artificial Sequence
  Synthetic oligonucleotide
ttgtggcccccccagaagttgcgatgccactgctc

SEQ ID NO: 198245 - DNA, 35 bp, Artificial Sequence
  Synthetic oligonucleotide
gaccaccttaccgatcttactgcgaacctttgctc

SEQ ID NO: 198246 - DNA, 35 bp, Artificial Sequence
  Synthetic oligonucleotide
tcacccatccggaacaactttatcactggtatctc

SEQ ID NO: 198247 - DNA, 35 bp, Artificial Sequence
  Synthetic oligonucleotide
tgctccacgcgcttgttctcgggccccctgttctc

SEQ ID NO: 198248 - DNA, 35 bp, Artificial Sequence
  Synthetic oligonucleotide
acccccgcacgtactgtcctggtggtctcatattc

SEQ ID NO: 198249 - DNA, 35 bp, Artificial Sequence
  Synthetic oligonucleotide
tcagaggggggagatggattactgagtgggtgaag

SEQ ID NO: 198250 - DNA, 35 bp, Artificial Sequence
  Synthetic oligonucleotide
atggtggagttaatgaggtggaatggacggcagag

SEQ ID NO: 198251 - DNA, 35 bp, Artificial Sequence
  Synthetic oligonucleotide
ttgcccccccggcattgtttctacacactaccacg

SEQ ID NO: 198252 - DNA, 35 bp, Artificial Sequence
  Synthetic oligonucleotide
acatcacaccttcaacgggataactcgctcttccg

SEQ ID NO: 198253 - DNA, 35 bp, Artificial Sequence
  Synthetic oligonucleotide
ggaccttgcgcaagcattgaatttgcccctactcg

SEQ ID NO: 198254 - DNA, 35 bp, Artificial Sequence
  Synthetic oligonucleotide
gcgaattgcagtgcctcgccgttttcatctcctcg

SEQ ID NO: 198255 - DNA, 35 bp, Artificial Sequence
  Synthetic oligonucleotide
gtggggtaggggggcgatgggcgttggggtagtcg

SEQ ID NO: 198256 - DNA, 35 bp, Artificial Sequence
  Synthetic oligonucleotide
taaaacgagactcaagggggggagagatgggtagg

SEQ ID NO: 198257 - DNA, 35 bp, Artificial Sequence
  Synthetic oligonucleotide
gatgcccatccgctggatagtaccaccctcttcgg

SEQ ID NO: 198258 - DNA, 35 bp, Artificial Sequence
  Synthetic oligonucleotide
ttacagcctccgaaccgcctaaccgtccatttttg

SEQ ID NO: 198259 - DNA, 35 bp, Artificial Sequence
  Synthetic oligonucleotide
ttgcgaaccgtactttctccgttccttagtggact

SEQ ID NO: 198260 - DNA, 35 bp, Artificial Sequence
  Synthetic oligonucleotide
atcagcagacctcagcttggtttagttctcctcct

SEQ ID NO: 198261 - DNA, 35 bp, Artificial Sequence
  Synthetic oligonucleotide
gtgacaacctcttcacatggtctaatgaccacgct

SEQ ID NO: 198262 - DNA, 35 bp, Artificial Sequence
  Synthetic oligonucleotide
taggatgtgccccgccttttccctctttagatgct

SEQ ID NO: 198263 - DNA, 35 bp, Artificial Sequence
  Synthetic oligonucleotide
gtggggtgaaacgcgtctatagggtgggggggagt

SEQ ID NO: 198264 - DNA, 35 bp, Artificial Sequence
  Synthetic oligonucleotide
ttaccatgtgtaccggtccctttgcactcgcctgt

SEQ ID NO: 198265 - DNA, 35 bp, Artificial Sequence
  Synthetic oligonucleotide
acatccgcccccacccactgtctagacggacagtt

SEQ ID NO: 198266 - DNA, 35 bp, Artificial Sequence
  Synthetic oligonucleotide
gatcgtgtccgtaccgctgtcctccttcggacttt

SEQ ID NO: 198267 - DNA, 35 bp, Artificial Sequence
  Synthetic oligonucleotide
taccacctcacatacgtgcttatcctggccttaaa

SEQ ID NO: 198268 - DNA, 36 bp, Artificial Sequence
  Synthetic oligonucleotide
gggggaaggcgggggggggaacaggcggaatcacaa

SEQ ID NO: 198269 - DNA, 36 bp, Artificial Sequence
  Synthetic oligonucleotide
tccgagtgcgctgcatcctgccatccattagcccaa

SEQ ID NO: 198270 - DNA, 35 bp, Artificial Sequence
  Synthetic oligonucleotide
gttgcaccatccgtttggtaacggctttccctcaa

SEQ ID NO: 198271 - DNA, 35 bp, Artificial Sequence
  Synthetic oligonucleotide
gaaacctcccccggtactccgccactctcgccgaa

SEQ ID NO: 198272 - DNA, 33 bp, Artificial Sequence
  Synthetic oligonucleotide
atctgcggggggggggctgggactaaactggaa

SEQ ID NO: 198273 - DNA, 36 bp, Artificial Sequence
  Synthetic oligonucleotide
tgcctcccgccgttcgacctccacccagtaaatgaa

SEQ ID NO: 198274 - DNA, 35 bp, Artificial Sequence
  Synthetic oligonucleotide
tgtggtaggggtgggagggaaagcgtcgcgacaca

SEQ ID NO: 198275 - DNA, 35 bp, Artificial Sequence
  Synthetic oligonucleotide
aacgcctccactgcaataagtcctgcatgatccca

SEQ ID NO: 198276 - DNA, 36 bp, Artificial Sequence
  Synthetic oligonucleotide
gaacaccgccttttgaacaataatcatggccttcca

SEQ ID NO: 198277 - DNA, 36 bp, Artificial Sequence
  Synthetic oligonucleotide
ttgaggtggagcacgggggtcaataggtgagcggca

SEQ ID NO: 198278 - DNA, 36 bp, Artificial Sequence
  Synthetic oligonucleotide
gtgatgggcgggcggggtgttggagccccctgggca

SEQ ID NO: 198279 - DNA, 36 bp, Artificial Sequence
  Synthetic oligonucleotide
acacaccggcccccgtatttgcttagttgctttgca

SEQ ID NO: 198280 - DNA, 36 bp, Artificial Sequence
  Synthetic oligonucleotide
gatatcatgccgtcacatctcaccgtagttctatca

SEQ ID NO: 198281 - DNA, 35 bp, Artificial Sequence
  Synthetic oligonucleotide
agcaacgtcacactccctgggctgtctctcactca

SEQ ID NO: 198282 - DNA, 37 bp, Artificial Sequence
  Synthetic oligonucleotide
acgagatgggggagccgggaacgagaggggaataaga

SEQ ID NO: 198283 - DNA, 37 bp, Artificial Sequence
  Synthetic oligonucleotide
gtgcaccgtaccgggtctttttcacctctccatcaga

SEQ ID NO: 198284 - DNA, 37 bp, Artificial Sequence
  Synthetic oligonucleotide
tatgggaagggtagggagggtatcgttgtcatataga

SEQ ID NO: 198285 - DNA, 33 bp, Artificial Sequence
  Synthetic oligonucleotide
gttctgcccatttgacttctctatacaccacga

SEQ ID NO: 198286 - DNA, 37 bp, Artificial Sequence
  Synthetic oligonucleotide
tgcgaggtcaggagggggatggaacggacggatacga

SEQ ID NO: 198287 - DNA, 36 bp, Artificial Sequence
  Synthetic oligonucleotide
atggtgccaccgactctattctgttatcctctccga

SEQ ID NO: 198288 - DNA, 35 bp, Artificial Sequence
  Synthetic oligonucleotide
ttcgggatgctcagtttctttcgcccacctttcga

SEQ ID NO: 198289 - DNA, 37 bp, Artificial Sequence
  Synthetic oligonucleotide
gtgggtcgacgataggtgggcatattcgtgggcggga

SEQ ID NO: 198290 - DNA, 37 bp, Artificial Sequence
  Synthetic oligonucleotide
taaggcgggaagaagggcggggcaaacgtatggggga

SEQ ID NO: 198291 - DNA, 37 bp, Artificial Sequence
  Synthetic oligonucleotide
ggatgccggaaggaatggagggagattagggcctgga

SEQ ID NO: 198292 - DNA, 38 bp, Artificial Sequence
  Synthetic oligonucleotide
tctactccccctctgtttgatctagttccaggctatga

SEQ ID NO: 198293 - DNA, 38 bp, Artificial Sequence
  Synthetic oligonucleotide
tgttgcctcccactgtctcttatccagtcagggtatga

SEQ ID NO: 198294 - DNA, 36 bp, Artificial Sequence
  Synthetic oligonucleotide
tctgcgcggagatggcatcccccctcccctttatga

SEQ ID NO: 198295 - DNA, 37 bp, Artificial Sequence
  Synthetic oligonucleotide
tcatgtcaaaggtgtgttctcctcgttccaccactga

SEQ ID NO: 198296 - DNA, 38 bp, Artificial Sequence
  Synthetic oligonucleotide
ttgagcacgcatcacaatgtcgcaccatcctccactga

SEQ ID NO: 198297 - DNA, 38 bp, Artificial Sequence
  Synthetic oligonucleotide
gtcgctcccgccgtgtgatctgcctgctccgtacctga

SEQ ID NO: 198298 - DNA, 38 bp, Artificial Sequence
  Synthetic oligonucleotide
cacgacgcctaatcactgtccaagcttactccccctga

SEQ ID NO: 198299 - DNA, 38 bp, Artificial Sequence
  Synthetic oligonucleotide
gagacgcgttcagctcgtcccttagcaccatatcctga

SEQ ID NO: 198300 - DNA, 38 bp, Artificial Sequence
  Synthetic oligonucleotide
tgagtggaggttgacgtaggggaagggccgcgaggtga

SEQ ID NO: 198301 - DNA, 38 bp, Artificial Sequence
  Synthetic oligonucleotide
atgacgaggggagcggagggggcgaacgcacacggtga

SEQ ID NO: 198302 - DNA, 38 bp, Artificial Sequence
  Synthetic oligonucleotide
tccaggcgtggggggggaggagctgcgggcacttgtga

SEQ ID NO: 198303 - DNA, 38 bp, Artificial Sequence
  Synthetic oligonucleotide
agcctgggtgggtcgggcagtaaagacgggtcgattga

SEQ ID NO: 198304 - DNA, 37 bp, Artificial Sequence
  Synthetic oligonucleotide
gggggacggagaaggaaggctaacgtcagcttattga

SEQ ID NO: 198305 - DNA, 37 bp, Artificial Sequence
  Synthetic oligonucleotide
gacgaggacaatgacttctgctgccatcttcccttga

SEQ ID NO: 198306 - DNA, 35 bp, Artificial Sequence
  Synthetic oligonucleotide
gtcaccaccagttcctcccggatcagttccccata

SEQ ID NO: 198307 - DNA, 35 bp, Artificial Sequence
  Synthetic oligonucleotide
gtctcgcccctcagctcttgtttcccggatagcta

SEQ ID NO: 198308 - DNA, 36 bp, Artificial Sequence
  Synthetic oligonucleotide
ttgcgaggggataggtgggggagagtgggcgaagta

SEQ ID NO: 198309 - DNA, 36 bp, Artificial Sequence
  Synthetic oligonucleotide
cccgatgcaatgctgtccctatcctgtccatccgta

SEQ ID NO: 198310 - DNA, 35 bp, Artificial Sequence
  Synthetic oligonucleotide
gcgctgcaggggcgggcgggatggtccgggcggta

SEQ ID NO: 198311 - DNA, 35 bp, Artificial Sequence
  Synthetic oligonucleotide
agaacgcgggcggtagggggacgggctttaatgta

SEQ ID NO: 198312 - DNA, 36 bp, Artificial Sequence
  Synthetic oligonucleotide
tctcacccccgtctccatctgcacgttccagtctta

SEQ ID NO: 198313 - DNA, 35 bp, Artificial Sequence
  Synthetic oligonucleotide
ttgtagacgggggaaatggagcatgaagggagaac

SEQ ID NO: 198314 - DNA, 35 bp, Artificial Sequence
  Synthetic oligonucleotide
tatgccccctcgccgtgaaccttggattgcctaac

SEQ ID NO: 198315 - DNA, 35 bp, Artificial Sequence
  Synthetic oligonucleotide
gacactgtcctgccctccccagtgcttgttcttac

SEQ ID NO: 198316 - DNA, 35 bp, Artificial Sequence
  Synthetic oligonucleotide
aactcacaccactgacgtcctcatatgacgcaccc

SEQ ID NO: 198317 - DNA, 35 bp, Artificial Sequence
  Synthetic oligonucleotide
tgtacctgtcagttatcgttccttgcacactaccc

SEQ ID NO: 198318 - DNA, 36 bp, Artificial Sequence
  Synthetic oligonucleotide
accggcggtgggtctcatgtcactatttcgccgccc

SEQ ID NO: 198319 - DNA, 35 bp, Artificial Sequence
  Synthetic oligonucleotide
tatagcgccgtatggcctcgttccccaccatagcc

SEQ ID NO: 198320 - DNA, 35 bp, Artificial Sequence
  Synthetic oligonucleotide
tcatccaccgtagccacgtggtcccggtcttatcc

SEQ ID NO: 198321 - DNA, 35 bp, Artificial Sequence
  Synthetic oligonucleotide
ggaccgacgcaccggttgatgaaaacgccgcctcc

SEQ ID NO: 198322 - DNA, 28 bp, Artificial Sequence
  Synthetic oligonucleotide
gatcacccgcaacacgctacacccccgc

SEQ ID NO: 198323 - DNA, 35 bp, Artificial Sequence
  Synthetic oligonucleotide
acttaagcggtcaaactacgcatcttcctcgccgc

SEQ ID NO: 198324 - DNA, 35 bp, Artificial Sequence
  Synthetic oligonucleotide
acccacaagcggcgggatgggagggtacgaagcgc

SEQ ID NO: 198325 - DNA, 35 bp, Artificial Sequence
  Synthetic oligonucleotide
gaaacgcacgcttccggatccaacaccttctttgc

SEQ ID NO: 198326 - DNA, 35 bp, Artificial Sequence
  Synthetic oligonucleotide
taccactcgcactcgaagcagagcttccgcccatc

SEQ ID NO: 198327 - DNA, 35 bp, Artificial Sequence
  Synthetic oligonucleotide
gttgtacaatgtggtctcattagccgcactccatc

SEQ ID NO: 198328 - DNA, 35 bp, Artificial Sequence
  Synthetic oligonucleotide
tgtgcccacatcgcgctttagtcccggctttactc

SEQ ID NO: 198329 - DNA, 35 bp, Artificial Sequence
  Synthetic oligonucleotide
aatctgtcgcgcgctctgtttaacgccgttccctc

SEQ ID NO: 198330 - DNA, 35 bp, Artificial Sequence
  Synthetic oligonucleotide
ttgatccaacgccggtccccgagtcagcccccgtc

SEQ ID NO: 198331 - DNA, 35 bp, Artificial Sequence
  Synthetic oligonucleotide
tccattggtgcagtgtttccccgccttctcacttc

SEQ ID NO: 198332 - DNA, 35 bp, Artificial Sequence
  Synthetic oligonucleotide
tggagaacagacggcatagctccacgttcctcttc

SEQ ID NO: 198333 - DNA, 35 bp, Artificial Sequence
  Synthetic oligonucleotide
gcagagcccttttatgtgacttgcccttcgttttc

SEQ ID NO: 198334 - DNA, 35 bp, Artificial Sequence
  Synthetic oligonucleotide
gggaggaggggggactggctattgcgctggggacg

SEQ ID NO: 198335 - DNA, 35 bp, Artificial Sequence
  Synthetic oligonucleotide
tagcacacttagtcgaatagggcgggcggggggcg

SEQ ID NO: 198336 - DNA, 35 bp, Artificial Sequence
  Synthetic oligonucleotide
acaggcgctcaccagtctgcctttccccggtttcg

SEQ ID NO: 198337 - DNA, 35 bp, Artificial Sequence
  Synthetic oligonucleotide
tcacccgccatccccgtctgtcccgccttcgaagg

SEQ ID NO: 198338 - DNA, 35 bp, Artificial Sequence
  Synthetic oligonucleotide
tgatcccgtcagtcgaacttacattccttccccgg

SEQ ID NO: 198339 - DNA, 35 bp, Artificial Sequence
  Synthetic oligonucleotide
gagatgacgatcggcacaatagggagcgaggaggg

SEQ ID NO: 198340 - DNA, 35 bp, Artificial Sequence
  Synthetic oligonucleotide
gaagcatcctgatcgtacgccctcaattcgccctg

SEQ ID NO: 198341 - DNA, 35 bp, Artificial Sequence
  Synthetic oligonucleotide
acacaccacctaatatgttcgccgttccgctcttg

SEQ ID NO: 198342 - DNA, 35 bp, Artificial Sequence
  Synthetic oligonucleotide
gccatctgccgctgtttcttcgggtcctggtccat

SEQ ID NO: 198343 - DNA, 35 bp, Artificial Sequence
  Synthetic oligonucleotide
acacatcatccgcaggatggtcccaatcaaccact

SEQ ID NO: 198344 - DNA, 35 bp, Artificial Sequence
  Synthetic oligonucleotide
agccggtccgggcccgtttcctcccctcgttgact

SEQ ID NO: 198345 - DNA, 35 bp, Artificial Sequence
  Synthetic oligonucleotide
gcccatgacttgttatgcatctcgaatacctccct

SEQ ID NO: 198346 - DNA, 35 bp, Artificial Sequence
  Synthetic oligonucleotide
gagactctgcccccgctgtgaaatggcctgctcct

SEQ ID NO: 198347 - DNA, 34 bp, Artificial Sequence
  Synthetic oligonucleotide
gctcagtccgccttgctcttgtgctcctattcct

SEQ ID NO: 198348 - DNA, 36 bp, Artificial Sequence
  Synthetic oligonucleotide
tcaatgcctcagcaattagcgttaaacttccctgct

SEQ ID NO: 198349 - DNA, 35 bp, Artificial Sequence
  Synthetic oligonucleotide
aagcactcttcctcccgtgttggctcattcttgct

SEQ ID NO: 198350 - DNA, 35 bp, Artificial Sequence
  Synthetic oligonucleotide
tgcgagcaagccacatggcacacccgcttccatct

SEQ ID NO: 198351 - DNA, 35 bp, Artificial Sequence
  Synthetic oligonucleotide
gcttgccgggcactcgttttccagcacttctatct

SEQ ID NO: 198352 - DNA, 35 bp, Artificial Sequence
  Synthetic oligonucleotide
tgagacaacgtaattctgccctgccttgtcggtct

SEQ ID NO: 198353 - DNA, 35 bp, Artificial Sequence
  Synthetic oligonucleotide
agatgcaggacgatcgccttctcacgtacccttct

SEQ ID NO: 198354 - DNA, 35 bp, Artificial Sequence
  Synthetic oligonucleotide
gtgtagaggaggtgaaatgggtagagacgggaggt

SEQ ID NO: 198355 - DNA, 35 bp, Artificial Sequence
  Synthetic oligonucleotide
gtctcgcccactatgctttaaccctcccattcggt

SEQ ID NO: 198356 - DNA, 35 bp, Artificial Sequence
  Synthetic oligonucleotide
ttcaaagacaccctccccctctccatgctgtgggt

SEQ ID NO: 198357 - DNA, 35 bp, Artificial Sequence
  Synthetic oligonucleotide
ttgaggccaacgctcctccccgctcttgacatggt

SEQ ID NO: 198358 - DNA, 35 bp, Artificial Sequence
  Synthetic oligonucleotide
gggcgggagggagggcacaatatcacgattacatt

SEQ ID NO: 198359 - DNA, 35 bp, Artificial Sequence
  Synthetic oligonucleotide
ttacgccgcccgctttaatgtagacacacgttatt

SEQ ID NO: 198360 - DNA, 35 bp, Artificial Sequence
  Synthetic oligonucleotide
tgcctaccgaacctgacttgcatgccgagtccctt

SEQ ID NO: 198361 - DNA, 35 bp, Artificial Sequence
  Synthetic oligonucleotide
ttccgccccagtttgtcccgccgtaaattatcctt

SEQ ID NO: 198362 - DNA, 35 bp, Artificial Sequence
  Synthetic oligonucleotide
gctatccagcgcagctattttatggtttgctcctt

SEQ ID NO: 198363 - DNA, 35 bp, Artificial Sequence
  Synthetic oligonucleotide
ggatagggcacacgcatccctgtttaggttctttt

SEQ ID NO: 198364 - DNA, 36 bp, Artificial Sequence
  Synthetic oligonucleotide
acacttcagccggagagggaagggcgggaccaaaaa

SEQ ID NO: 198365 - DNA, 35 bp, Artificial Sequence
  Synthetic oligonucleotide
gaggggaatgacggagagggagcatagggtcaaaa

SEQ ID NO: 198366 - DNA, 35 bp, Artificial Sequence
  Synthetic oligonucleotide
gttgcccgccttggtccctcgctatctgtgacaaa

SEQ ID NO: 198367 - DNA, 36 bp, Artificial Sequence
  Synthetic oligonucleotide
gtccatcaccattgctctattgaacctctctagcaa

SEQ ID NO: 198368 - DNA, 35 bp, Artificial Sequence
  Synthetic oligonucleotide
accgacacggtcttcacacctgctcccttttgcaa

SEQ ID NO: 198369 - DNA, 35 bp, Artificial Sequence
  Synthetic oligonucleotide
atccacctccgtttgcttgtattctcctgttagaa

SEQ ID NO: 198370 - DNA, 36 bp, Artificial Sequence
  Synthetic oligonucleotide
agtgtcatggagggggggcataggtggcggtcggaa

SEQ ID NO: 198371 - DNA, 35 bp, Artificial Sequence
  Synthetic oligonucleotide
tctgcacgctacagagcggctccacgtctccccca

SEQ ID NO: 198372 - DNA, 36 bp, Artificial Sequence
  Synthetic oligonucleotide
gtcgggatgccacaatcttgctcacctcccgttcca

SEQ ID NO: 198373 - DNA, 36 bp, Artificial Sequence
  Synthetic oligonucleotide
gggtgcggaaaggggggcggatagtgagcagcagca

SEQ ID NO: 198374 - DNA, 36 bp, Artificial Sequence
  Synthetic oligonucleotide
ttgaggtgcctcagtagaacctctccttatccctca

SEQ ID NO: 198375 - DNA, 36 bp, Artificial Sequence
  Synthetic oligonucleotide
aagcccacttcacaactggtacagtaacactcctca

SEQ ID NO: 198376 - DNA, 36 bp, Artificial Sequence
  Synthetic oligonucleotide
gagtgggccgtcgagaggggggtgggtgcggcttca

SEQ ID NO: 198377 - DNA, 35 bp, Artificial Sequence
  Synthetic oligonucleotide
tccggaccgccaccgccttcttagtggcactttca

SEQ ID NO: 198378 - DNA, 36 bp, Artificial Sequence
  Synthetic oligonucleotide
tgaacctcattgacccgccgccatcacccttataga

SEQ ID NO: 198379 - DNA, 37 bp, Artificial Sequence
  Synthetic oligonucleotide
ggaaaactcaggaggggggcgatagggcagggctaga

SEQ ID NO: 198380 - DNA, 37 bp, Artificial Sequence
  Synthetic oligonucleotide
tgtgctgtccgacaatcaatccctgcctccacgtaga

SEQ ID NO: 198381 - DNA, 36 bp, Artificial Sequence
  Synthetic oligonucleotide
tgtatccgcgcacattcctatatcaccgtgctacga

SEQ ID NO: 198382 - DNA, 37 bp, Artificial Sequence
  Synthetic oligonucleotide
aaacatgccgaggtgggtgcacagcaggggagggcga

SEQ ID NO: 198383 - DNA, 37 bp, Artificial Sequence
  Synthetic oligonucleotide
tgtggggaggcggcgagtggggagatagggcggagga

SEQ ID NO: 198384 - DNA, 37 bp, Artificial Sequence
  Synthetic oligonucleotide
gctggaagggcgtagaaagggggtggtgtggaacgga

SEQ ID NO: 198385 - DNA, 37 bp, Artificial Sequence
  Synthetic oligonucleotide
gacacagtgaatgtatgggatgtaggtaggggatgga

SEQ ID NO: 198386 - DNA, 37 bp, Artificial Sequence
  Synthetic oligonucleotide
gtgtagccgcattggggagggaaggcatgaaggtgga

SEQ ID NO: 198387 - DNA, 38 bp, Artificial Sequence
  Synthetic oligonucleotide
agaccgaagggaggggagaaggagccactatagaatga

SEQ ID NO: 198388 - DNA, 37 bp, Artificial Sequence
  Synthetic oligonucleotide
tagagtcagcagaggacggaggggagtgaaggaatga

SEQ ID NO: 198389 - DNA, 38 bp, Artificial Sequence
  Synthetic oligonucleotide
ggatccgccacgtgctgttgtaaccccttccgctatga

SEQ ID NO: 198390 - DNA, 38 bp, Artificial Sequence
  Synthetic oligonucleotide
agtgcagaagagagagcggtgtgaggtggtgggtatga

SEQ ID NO: 198391 - DNA, 37 bp, Artificial Sequence
  Synthetic oligonucleotide
gacccacacgaacgaactgtactatgccccacgctga

SEQ ID NO: 198392 - DNA, 38 bp, Artificial Sequence
  Synthetic oligonucleotide
attgtgctccacctgacagggcccgtcccctttgctga

SEQ ID NO: 198393 - DNA, 37 bp, Artificial Sequence
  Synthetic oligonucleotide
gcacggtggaggggagggacatttacgggacatctga

SEQ ID NO: 198394 - DNA, 37 bp, Artificial Sequence
  Synthetic oligonucleotide
acgcgcatactagcttatcagacctcgccctttctga

SEQ ID NO: 198395 - DNA, 38 bp, Artificial Sequence
  Synthetic oligonucleotide
gggggagacataggaaacaagagggacggatgaattga

SEQ ID NO: 198396 - DNA, 36 bp, Artificial Sequence
  Synthetic oligonucleotide
gacgactggaagtgctatctccgcccatgcccttga

SEQ ID NO: 198397 - DNA, 38 bp, Artificial Sequence
  Synthetic oligonucleotide
acaagaggagaagaggggtgagacgagaggtagcttga

SEQ ID NO: 198398 - DNA, 38 bp, Artificial Sequence
  Synthetic oligonucleotide
actcggcgaagagaaggggagggaagtagagcgtttga

SEQ ID NO: 198399 - DNA, 35 bp, Artificial Sequence
  Synthetic oligonucleotide
tcatctccgcttgaccaactgcttatcaccgcata

SEQ ID NO: 198400 - DNA, 33 bp, Artificial Sequence
  Synthetic oligonucleotide
acaccgaccctccaactgtgctgattggcccta

SEQ ID NO: 198401 - DNA, 36 bp, Artificial Sequence
  Synthetic oligonucleotide
gtacatggggcgggaggtgggttgtatccggtggta

SEQ ID NO: 198402 - DNA, 35 bp, Artificial Sequence
  Synthetic oligonucleotide
tctacacaaccgcatacacccttcagtgccttgta

SEQ ID NO: 198403 - DNA, 36 bp, Artificial Sequence
  Synthetic oligonucleotide
gccatgtcccgttgcgacaccacaccatttccatta

SEQ ID NO: 198404 - DNA, 35 bp, Artificial Sequence
  Synthetic oligonucleotide
accctaacccagatactgtttgccgccatttctta

SEQ ID NO: 198405 - DNA, 35 bp, Artificial Sequence
  Synthetic oligonucleotide
aacgcgtatcgccgcttgctgtcttcactcacaac

SEQ ID NO: 198406 - DNA, 35 bp, Artificial Sequence
  Synthetic oligonucleotide
agccacatcacttgcccactctgcattgctctaac

SEQ ID NO: 198407 - DNA, 35 bp, Artificial Sequence
  Synthetic oligonucleotide
gttaagcgggcggatgttggtggagggggggcgac

SEQ ID NO: 198408 - DNA, 35 bp, Artificial Sequence
  Synthetic oligonucleotide
tgacacaacaagctctacaagcagcacctctttac

SEQ ID NO: 198409 - DNA, 35 bp, Artificial Sequence
  Synthetic oligonucleotide
aacccagcctccgctgttgcacactgaatttcacc

SEQ ID NO: 198410 - DNA, 35 bp, Artificial Sequence
  Synthetic oligonucleotide
gcccggacactgtccgtttcttccgtgatgctacc

SEQ ID NO: 198411 - DNA, 35 bp, Artificial Sequence
  Synthetic oligonucleotide
agccgacgccacgtttcttcctcccgtttgctccc

SEQ ID NO: 198412 - DNA, 35 bp, Artificial Sequence
  Synthetic oligonucleotide
ttcacacgcacctctgcattagctccagggctgcc

SEQ ID NO: 198413 - DNA, 35 bp, Artificial Sequence
  Synthetic oligonucleotide
aacgacaagatgtccggtttgctgttacccttgcc

SEQ ID NO: 198414 - DNA, 35 bp, Artificial Sequence
  Synthetic oligonucleotide
accacgccccctgtgatgaagtgtcccttacatcc

SEQ ID NO: 198415 - DNA, 35 bp, Artificial Sequence
  Synthetic oligonucleotide
gaccctgccccccatgtttacccatattcggatcc

SEQ ID NO: 198416 - DNA, 35 bp, Artificial Sequence
  Synthetic oligonucleotide
tcattaccacccagcgtgccttcatgactgcctcc

SEQ ID NO: 198417 - DNA, 33 bp, Artificial Sequence
  Synthetic oligonucleotide
ttcatcctccgccatctggcattacacatgtcc

SEQ ID NO: 198418 - DNA, 35 bp, Artificial Sequence
  Synthetic oligonucleotide
tgcacagtcgcatctcccgctccaccaccctgggc

SEQ ID NO: 198419 - DNA, 35 bp, Artificial Sequence
  Synthetic oligonucleotide
tgagccccaccatcttgtttcgacgaatccatggc

SEQ ID NO: 198420 - DNA, 35 bp, Artificial Sequence
  Synthetic oligonucleotide
tgactaggggcgggactatgctagggagggcctgc

SEQ ID NO: 198421 - DNA, 35 bp, Artificial Sequence
  Synthetic oligonucleotide
tgtcctatccctgtgcttgtaacgttgattacatc

SEQ ID NO: 198422 - DNA, 35 bp, Artificial Sequence
  Synthetic oligonucleotide
atcccgtgacctccagaagactttgtcggaccatc

SEQ ID NO: 198423 - DNA, 35 bp, Artificial Sequence
  Synthetic oligonucleotide
gtcctgcgcgtgaacgaagttttacgctacccctc

SEQ ID NO: 198424 - DNA, 35 bp, Artificial Sequence
  Synthetic oligonucleotide
gcacactcgtccatcgatgtaccctctgctccctc

SEQ ID NO: 198425 - DNA, 35 bp, Artificial Sequence
  Synthetic oligonucleotide
acgccctctgcccgtgcactttcgcagctactctc

SEQ ID NO: 198426 - DNA, 35 bp, Artificial Sequence
  Synthetic oligonucleotide
tgcgcctggtccacctgtttgttgctcttacattc

SEQ ID NO: 198427 - DNA, 35 bp, Artificial Sequence
  Synthetic oligonucleotide
gacccaggcattgtcgctctccggccattaacttc

SEQ ID NO: 198428 - DNA, 35 bp, Artificial Sequence
  Synthetic oligonucleotide
tttcgccccacttatgtctaggtactcgacttttc

SEQ ID NO: 198429 - DNA, 35 bp, Artificial Sequence
  Synthetic oligonucleotide
gggggtgaggaaggaggatggtaaactggctcaag

SEQ ID NO: 198430 - DNA, 35 bp, Artificial Sequence
  Synthetic oligonucleotide
gaaaggtgcgaacggtacagtggaagggggaagag

SEQ ID NO: 198431 - DNA, 35 bp, Artificial Sequence
  Synthetic oligonucleotide
tagtggacgggggaggtcgtagaggaaggacatag

SEQ ID NO: 198432 - DNA, 34 bp, Artificial Sequence
  Synthetic oligonucleotide
ttcccagccacacggtatgtccccccccagctag

SEQ ID NO: 198433 - DNA, 35 bp, Artificial Sequence
  Synthetic oligonucleotide
gtttgcacgggctgcttggcataacaccctcttag

SEQ ID NO: 198434 - DNA, 32 bp, Artificial Sequence
  Synthetic oligonucleotide
accagcacagctcgttctatcaccttgtcacg

SEQ ID NO: 198435 - DNA, 35 bp, Artificial Sequence
  Synthetic oligonucleotide
tgcgaattataccaaccgctctgggcccccctccg

SEQ ID NO: 198436 - DNA, 35 bp, Artificial Sequence
  Synthetic oligonucleotide
gccgccaccacgctcctatctctcctcctacgtcg

SEQ ID NO: 198437 - DNA, 35 bp, Artificial Sequence
  Synthetic oligonucleotide
tcgtgccactctacgccgccgtatttaatcattcg

SEQ ID NO: 198438 - DNA, 35 bp, Artificial Sequence
  Synthetic oligonucleotide
acgcctactgttccccgcttacgacttacgcttcg

SEQ ID NO: 198439 - DNA, 35 bp, Artificial Sequence
  Synthetic oligonucleotide
gagtcacataggaggagggcaagaaggagcgtttg

SEQ ID NO: 198440 - DNA, 35 bp, Artificial Sequence
  Synthetic oligonucleotide
acacccgaacactgagatggaacgctcctcttcat

SEQ ID NO: 198441 - DNA, 32 bp, Artificial Sequence
  Synthetic oligonucleotide
acacgccctggttgtgtctccgaccgccctat

SEQ ID NO: 198442 - DNA, 35 bp, Artificial Sequence
  Synthetic oligonucleotide
gatcccatccacgtgaaacgcttcattggccttat

SEQ ID NO: 198443 - DNA, 35 bp, Artificial Sequence
  Synthetic oligonucleotide
attacatcgcccctcctgccattcccttgcgacct

SEQ ID NO: 198444 - DNA, 35 bp, Artificial Sequence
  Synthetic oligonucleotide
ttcggatcgccgcacctgtttttgccgaccttcct

SEQ ID NO: 198445 - DNA, 35 bp, Artificial Sequence
  Synthetic oligonucleotide
tcaacgccgacgccaatggccacatctctttcgct

SEQ ID NO: 198446 - DNA, 35 bp, Artificial Sequence
  Synthetic oligonucleotide
tgctacctccgctgttggccttcatgttctctgct

SEQ ID NO: 198447 - DNA, 35 bp, Artificial Sequence
  Synthetic oligonucleotide
atccgcatgcccacttgcacgtgattaccccgggt

SEQ ID NO: 198448 - DNA, 35 bp, Artificial Sequence
  Synthetic oligonucleotide
ttagccgccctcgcccgtttcctgtcaactttggt

SEQ ID NO: 198449 - DNA, 35 bp, Artificial Sequence
  Synthetic oligonucleotide
tcacgcggtcgcccctgttcttctctggtctactt

SEQ ID NO: 198450 - DNA, 35 bp, Artificial Sequence
  Synthetic oligonucleotide
taacctccgtgcacttgatgggccaccgttccttt

SEQ ID NO: 198451 - DNA, 36 bp, Artificial Sequence
  Synthetic oligonucleotide
agggagggggagatcgggaaagtgcggaacaaaaaa

SEQ ID NO: 198452 - DNA, 36 bp, Artificial Sequence
  Synthetic oligonucleotide
accccgtagccgggtagggtccatttcgggtgggaa

SEQ ID NO: 198453 - DNA, 35 bp, Artificial Sequence
  Synthetic oligonucleotide
tgtacacatgcctcaatccgcctaccctccgttaa

SEQ ID NO: 198454 - DNA, 36 bp, Artificial Sequence
  Synthetic oligonucleotide
tcctttccgccgcccgtacattctcgcagtgaaaca

SEQ ID NO: 198455 - DNA, 27 bp, Artificial Sequence
  Synthetic oligonucleotide
acctacgactcaccttccgatcgtaca

SEQ ID NO: 198456 - DNA, 36 bp, Artificial Sequence
  Synthetic oligonucleotide
ggacatgccttgctgcccatcactctacgttgtaca

SEQ ID NO: 198457 - DNA, 36 bp, Artificial Sequence
  Synthetic oligonucleotide
tgcccctccgggtccatccgtgcatgtttccttaca

SEQ ID NO: 198458 - DNA, 36 bp, Artificial Sequence
  Synthetic oligonucleotide
agtgccccctccatcgtgtcactgctggtctaacca

SEQ ID NO: 198459 - DNA, 36 bp, Artificial Sequence
  Synthetic oligonucleotide
tcagtagctgcccgttgtttgccgacctctcgccca

SEQ ID NO: 198460 - DNA, 35 bp, Artificial Sequence
  Synthetic oligonucleotide
gtcccccgccacttctgttcaagccccgtggccca

SEQ ID NO: 198461 - DNA, 36 bp, Artificial Sequence
  Synthetic oligonucleotide
acgctgcacagtgcgtctcggatttgctcccctcca

SEQ ID NO: 198462 - DNA, 36 bp, Artificial Sequence
  Synthetic oligonucleotide
acgtctctgcccctgctttagagccttactcccgca

SEQ ID NO: 198463 - DNA, 35 bp, Artificial Sequence
  Synthetic oligonucleotide
acaactagggaaggatagggtggggcaggggggca

SEQ ID NO: 198464 - DNA, 35 bp, Artificial Sequence
  Synthetic oligonucleotide
tccacccattattgctcatagcgtgctttcatgca

SEQ ID NO: 198465 - DNA, 34 bp, Artificial Sequence
  Synthetic oligonucleotide
gcacgatccccgttacgttaggctatccattgca

SEQ ID NO: 198466 - DNA, 36 bp, Artificial Sequence
  Synthetic oligonucleotide
tccacagcgcagagaattgtctcgttccgtttatca

SEQ ID NO: 198467 - DNA, 35 bp, Artificial Sequence
  Synthetic oligonucleotide
ggaggtaggaggggtcagctcggaggtggagctca

SEQ ID NO: 198468 - DNA, 36 bp, Artificial Sequence
  Synthetic oligonucleotide
gaggatcaacgagggagggcgggctatgacgagtca

SEQ ID NO: 198469 - DNA, 36 bp, Artificial Sequence
  Synthetic oligonucleotide
gacgaccctccctgtcagtgcgtttctcgtatttca

SEQ ID NO: 198470 - DNA, 35 bp, Artificial Sequence
  Synthetic oligonucleotide
tacacccccgaccacatgaatgtaagtggttttca

SEQ ID NO: 198471 - DNA, 37 bp, Artificial Sequence
  Synthetic oligonucleotide
ggagggcgatagggcgggggtacaaccagggaaaaga

SEQ ID NO: 198472 - DNA, 37 bp, Artificial Sequence
  Synthetic oligonucleotide
ataggtaacaagacggtgggtaagggcgggggtaaga

SEQ ID NO: 198473 - DNA, 37 bp, Artificial Sequence
  Synthetic oligonucleotide
attggggggggtaaggaggaagacatgaaactggaga

SEQ ID NO: 198474 - DNA, 37 bp, Artificial Sequence
  Synthetic oligonucleotide
gtgaggagggggatgatgatgtggaggcgcagaacga

SEQ ID NO: 198475 - DNA, 37 bp, Artificial Sequence
  Synthetic oligonucleotide
gcatcgtaatggtccacgggagggtgaggtgggccga

SEQ ID NO: 198476 - DNA, 37 bp, Artificial Sequence
  Synthetic oligonucleotide
atgctgtgtgaggggagggcctaagtgggtggcgcga

SEQ ID NO: 198477 - DNA, 37 bp, Artificial Sequence
  Synthetic oligonucleotide
tcatccaccccccgtttcgtctcgagttgacgtgcga

SEQ ID NO: 198478 - DNA, 35 bp, Artificial Sequence
  Synthetic oligonucleotide
atcacttgcgcagatacctacattgccctactcga

SEQ ID NO: 198479 - DNA, 37 bp, Artificial Sequence
  Synthetic oligonucleotide
tcgagcccctcgtgtgcttcacatccatcttactcga

SEQ ID NO: 198480 - DNA, 37 bp, Artificial Sequence
  Synthetic oligonucleotide
atgatgcgcatgtctgctatgcctaacctccgctcga

SEQ ID NO: 198481 - DNA, 37 bp, Artificial Sequence
  Synthetic oligonucleotide
tcccctccgtggtccgtgaagccgatccttccttcga

SEQ ID NO: 198482 - DNA, 37 bp, Artificial Sequence
  Synthetic oligonucleotide
accgccacgcacccgtcccgtcctggtccaccgagga

SEQ ID NO: 198483 - DNA, 37 bp, Artificial Sequence
  Synthetic oligonucleotide
gacttcccgccccttgagactttgcagttccgccgga

SEQ ID NO: 198484 - DNA, 37 bp, Artificial Sequence
  Synthetic oligonucleotide
tgtggggacaaggcgtaaggggagtcgaacggcggga

SEQ ID NO: 198485 - DNA, 38 bp, Artificial Sequence
  Synthetic oligonucleotide
attgtgggtgggtgtccatgggggacagttcgtgggga

SEQ ID NO: 198486 - DNA, 35 bp, Artificial Sequence
  Synthetic oligonucleotide
tcagatgtccctctcatattcccccgtcaatggga

SEQ ID NO: 198487 - DNA, 37 bp, Artificial Sequence
  Synthetic oligonucleotide
acgacagggatcggacctggggtgggtataggtggga

SEQ ID NO: 198488 - DNA, 37 bp, Artificial Sequence
  Synthetic oligonucleotide
ttcacatccctgttccagcttaagcagcccctctgga

SEQ ID NO: 198489 - DNA, 37 bp, Artificial Sequence
  Synthetic oligonucleotide
atacacatccgtgtcttaacataatcgcccccttgga

SEQ ID NO: 198490 - DNA, 38 bp, Artificial Sequence
  Synthetic oligonucleotide
aagtcgggatgggggggtgggcaataagtttagactga

SEQ ID NO: 198491 - DNA, 38 bp, Artificial Sequence
  Synthetic oligonucleotide
atgctcgaccagttctgttgcttgcgttctatccctga

SEQ ID NO: 198492 - DNA, 38 bp, Artificial Sequence
  Synthetic oligonucleotide
tagggcgaagggttaaacggggacacgaggcggagtga

SEQ ID NO: 198493 - DNA, 37 bp, Artificial Sequence
  Synthetic oligonucleotide
tgactccgcctccctcacgtctctaacaactgcgtga

SEQ ID NO: 198494 - DNA, 38 bp, Artificial Sequence
  Synthetic oligonucleotide
tccccatccgcaccagctgccttcatcgcctcgggtga

SEQ ID NO: 198495 - DNA, 38 bp, Artificial Sequence
  Synthetic oligonucleotide
gatgcccgaatacaagtgttccctcgcctccctattga

SEQ ID NO: 198496 - DNA, 36 bp, Artificial Sequence
  Synthetic oligonucleotide
tcacagacccaccctatctacctcgagcacgcttga

SEQ ID NO: 198497 - DNA, 38 bp, Artificial Sequence
  Synthetic oligonucleotide
gcgcccgcctcgctgcctttgagctagcttccctttga

SEQ ID NO: 198498 - DNA, 35 bp, Artificial Sequence
  Synthetic oligonucleotide
gtgccccgcccttccactcttttgcccgtctttga

SEQ ID NO: 198499 - DNA, 38 bp, Artificial Sequence
  Synthetic oligonucleotide
gagaggcaaagaggggggagccagggtggaaggtttga

SEQ ID NO: 198500 - DNA, 37 bp, Artificial Sequence
  Synthetic oligonucleotide
tgccccctcaatcgtgccaacttctcctcaggtttga

SEQ ID NO: 198501 - DNA, 35 bp, Artificial Sequence
  Synthetic oligonucleotide
ggagggacaggtgggggttgggcgaggcatcaata

SEQ ID NO: 198502 - DNA, 36 bp, Artificial Sequence
  Synthetic oligonucleotide
gaggagggaacggataatatgacggaaggtgacata

SEQ ID NO: 198503 - DNA, 36 bp, Artificial Sequence
  Synthetic oligonucleotide
gaggagtgctggggagcgggataggagtgaaggata

SEQ ID NO: 198504 - DNA, 35 bp, Artificial Sequence
  Synthetic oligonucleotide
gtgcgggggcggggctggtcaaggggggtggcgta

SEQ ID NO: 198505 - DNA, 35 bp, Artificial Sequence
  Synthetic oligonucleotide
gacagggggagggagtaggtacgggctagggtgta

SEQ ID NO: 198506 - DNA, 35 bp, Artificial Sequence
  Synthetic oligonucleotide
tgccgtgctcacccctatcagtgcacgtttcgaac

SEQ ID NO: 198507 - DNA, 35 bp, Artificial Sequence
  Synthetic oligonucleotide
agtctccgcacatagcgttttgcttcattccgcac

SEQ ID NO: 198508 - DNA, 35 bp, Artificial Sequence
  Synthetic oligonucleotide
acacgaacgctcagccgtatccctctattccctac

SEQ ID NO: 198509 - DNA, 35 bp, Artificial Sequence
  Synthetic oligonucleotide
tttggcccccctctgttgcagcacccgctatgtac

SEQ ID NO: 198510 - DNA, 35 bp, Artificial Sequence
  Synthetic oligonucleotide
acacaactcgcttgatgaatgctatcatccgtacc

SEQ ID NO: 198511 - DNA, 35 bp, Artificial Sequence
  Synthetic oligonucleotide
gcgctgtccccgctgctttgtctccgtttgtaccc

SEQ ID NO: 198512 - DNA, 35 bp, Artificial Sequence
  Synthetic oligonucleotide
atggccgtcaccgctgctctaacgttctgtccccc

SEQ ID NO: 198513 - DNA, 35 bp, Artificial Sequence
  Synthetic oligonucleotide
ggtttaccctcccctctgtaactagctgtgcgccc

SEQ ID NO: 198514 - DNA, 35 bp, Artificial Sequence
  Synthetic oligonucleotide
actacacctccgaactgttaacctgccagttagcc

SEQ ID NO: 198515 - DNA, 35 bp, Artificial Sequence
  Synthetic oligonucleotide
aagcacctttcccatcttcagtccatccagtcgcc

SEQ ID NO: 198516 - DNA, 35 bp, Artificial Sequence
  Synthetic oligonucleotide
taggatcgccggagttcctatcgttcctgttcgcc

SEQ ID NO: 198517 - DNA, 35 bp, Artificial Sequence
  Synthetic oligonucleotide
ttctaccgccttgtattaggtgcatttcgctctcc

SEQ ID NO: 198518 - DNA, 35 bp, Artificial Sequence
  Synthetic oligonucleotide
gtcgggtcgggtgggtacagggtagtggtttctcc

SEQ ID NO: 198519 - DNA, 35 bp, Artificial Sequence
  Synthetic oligonucleotide
aacagggcgcctctgcttcgtaccatccctagtcc

SEQ ID NO: 198520 - DNA, 35 bp, Artificial Sequence
  Synthetic oligonucleotide
gcaaaccgccggtcaatcggtttaactatctgtcc

SEQ ID NO: 198521 - DNA, 34 bp, Artificial Sequence
  Synthetic oligonucleotide
tactaggctcggacgaatactgcgccgttccatc

SEQ ID NO: 198522 - DNA, 35 bp, Artificial Sequence
  Synthetic oligonucleotide
gccacgctgagctacattgtcagcgcctataactc

SEQ ID NO: 198523 - DNA, 35 bp, Artificial Sequence
  Synthetic oligonucleotide
acatccgtgcgcacaatactgtctggcacttactc

SEQ ID NO: 198524 - DNA, 35 bp, Artificial Sequence
  Synthetic oligonucleotide
tcgattccggccaagcgtgtctcttcttctgcctc

SEQ ID NO: 198525 - DNA, 35 bp, Artificial Sequence
  Synthetic oligonucleotide
actacccaaccctgatcgtgcttcacgggctgctc

SEQ ID NO: 198526 - DNA, 35 bp, Artificial Sequence
  Synthetic oligonucleotide
tgcatgcctcatcttctctcgcccggccttctgtc

SEQ ID NO: 198527 - DNA, 35 bp, Artificial Sequence
  Synthetic oligonucleotide
atcaccatccgctttcgtttgacgacatttaattc

SEQ ID NO: 198528 - DNA, 35 bp, Artificial Sequence
  Synthetic oligonucleotide
ttgtccgcctgcgaaccgtttcatctgggttcttc

SEQ ID NO: 198529 - DNA, 35 bp, Artificial Sequence
  Synthetic oligonucleotide
tacgcactcttgcctctcttgtatgtcctttgttc

SEQ ID NO: 198530 - DNA, 35 bp, Artificial Sequence
  Synthetic oligonucleotide
aggacagaagggagcggttgggtgggagaggacag

SEQ ID NO: 198531 - DNA, 35 bp, Artificial Sequence
  Synthetic oligonucleotide
ggagggagggacgaggtaaggggaggcaagaccag

SEQ ID NO: 198532 - DNA, 35 bp, Artificial Sequence
  Synthetic oligonucleotide
gaggacaaggggttgaaaggagtacgggtaaagag

SEQ ID NO: 198533 - DNA, 35 bp, Artificial Sequence
  Synthetic oligonucleotide
gcattcacacgcctccttagatcctactcgccgag

SEQ ID NO: 198534 - DNA, 35 bp, Artificial Sequence
  Synthetic oligonucleotide
ttgttccacctcttgcgtgcctgcggtctgccccg

SEQ ID NO: 198535 - DNA, 35 bp, Artificial Sequence
  Synthetic oligonucleotide
gtggggccaaaggggaacggatgagagctggatcg

SEQ ID NO: 198536 - DNA, 35 bp, Artificial Sequence
  Synthetic oligonucleotide
tccactatcctcggatgtaagtatgcccaccctcg

SEQ ID NO: 198537 - DNA, 35 bp, Artificial Sequence
  Synthetic oligonucleotide
ttgccaaccgaccgtcctttcatcgcctttgctcg

SEQ ID NO: 198538 - DNA, 35 bp, Artificial Sequence
  Synthetic oligonucleotide
ttgggtgaggagggggaaacatgtgatgagtcagg

SEQ ID NO: 198539 - DNA, 35 bp, Artificial Sequence
  Synthetic oligonucleotide
tgcaatcgcgaaaggtgggcgagggtgggacgggg

SEQ ID NO: 198540 - DNA, 35 bp, Artificial Sequence
  Synthetic oligonucleotide
tacaggagaggggagagcggggcgtcatggcgggg

SEQ ID NO: 198541 - DNA, 35 bp, Artificial Sequence
  Synthetic oligonucleotide
tcaccaccatcacgttgtccatcatatctccttgg

SEQ ID NO: 198542 - DNA, 35 bp, Artificial Sequence
  Synthetic oligonucleotide
tcttgcctccatgttatccccatcattggtttttg

SEQ ID NO: 198543 - DNA, 35 bp, Artificial Sequence
  Synthetic oligonucleotide
tagtgggcagagttcgtactgcaccatcttgtaat

SEQ ID NO: 198544 - DNA, 35 bp, Artificial Sequence
  Synthetic oligonucleotide
gcccattgatcagcatgacgtccaacttcccccat

SEQ ID NO: 198545 - DNA, 35 bp, Artificial Sequence
  Synthetic oligonucleotide
gcccagcgcgattctgcactgcttctccttggtat

SEQ ID NO: 198546 - DNA, 35 bp, Artificial Sequence
  Synthetic oligonucleotide
atgcccctgccactgaattccgatactgtacaact

SEQ ID NO: 198547 - DNA, 35 bp, Artificial Sequence
  Synthetic oligonucleotide
gttcaactcacatctgtatacggccttcctatcct

SEQ ID NO: 198548 - DNA, 35 bp, Artificial Sequence
  Synthetic oligonucleotide
acacccccgcccctccgttttaagttgcggcctct

SEQ ID NO: 198549 - DNA, 35 bp, Artificial Sequence
  Synthetic oligonucleotide
tatccacgtcgccttggggagcctacaccctctct

SEQ ID NO: 198550 - DNA, 35 bp, Artificial Sequence
  Synthetic oligonucleotide
aagcaaaacgtgcttacgtggtcttggtcccttct

SEQ ID NO: 198551 - DNA, 35 bp, Artificial Sequence
  Synthetic oligonucleotide
gcaccattgctacccctgccacccgccccttgggt

SEQ ID NO: 198552 - DNA, 35 bp, Artificial Sequence
  Synthetic oligonucleotide
tcctccacccgttcggttaatgctcctagacatgt

SEQ ID NO: 198553 - DNA, 35 bp, Artificial Sequence
  Synthetic oligonucleotide
atacgcctgcccactgtggttccttctggttctgt

SEQ ID NO: 198554 - DNA, 35 bp, Artificial Sequence
  Synthetic oligonucleotide
atccacccgtcgcgactgttttatcgcacgtgatt

SEQ ID NO: 198555 - DNA, 35 bp, Artificial Sequence
  Synthetic oligonucleotide
accaacctcacatccgtccagcggctctatccgtt

SEQ ID NO: 198556 - DNA, 35 bp, Artificial Sequence
  Synthetic oligonucleotide
ttacgtcaccccgtctcgccgtgaacgtcactgtt

SEQ ID NO: 198557 - DNA, 36 bp, Artificial Sequence
  Synthetic oligonucleotide
ggggaaaggtaaagggaggatagacgcacacgagaa

SEQ ID NO: 198558 - DNA, 35 bp, Artificial Sequence
  Synthetic oligonucleotide
gttccctcccatgtttcttcaacctcttcttcgaa

SEQ ID NO: 198559 - DNA, 36 bp, Artificial Sequence
  Synthetic oligonucleotide
gatcggatgaaacaaaagggtggggggaaagaaaca

SEQ ID NO: 198560 - DNA, 36 bp, Artificial Sequence
  Synthetic oligonucleotide
gcagtagcagggcgtggggaacaggaagcggaaaca

SEQ ID NO: 198561 - DNA, 36 bp, Artificial Sequence
  Synthetic oligonucleotide
tacgcaccggtcatcgttgctattacttgctccaca

SEQ ID NO: 198562 - DNA, 35 bp, Artificial Sequence
  Synthetic oligonucleotide
gtatggcgccggctgctccgcctatcttgtctaca

SEQ ID NO: 198563 - DNA, 36 bp, Artificial Sequence
  Synthetic oligonucleotide
tgcatcctcctcaggcgtaacttactcctacgtaca

SEQ ID NO: 198564 - DNA, 35 bp, Artificial Sequence
  Synthetic oligonucleotide
gccgccatcccacctgcgtaaaaaccagcgatcca

SEQ ID NO: 198565 - DNA, 36 bp, Artificial Sequence
  Synthetic oligonucleotide
gatggagcgtggtggggaaggtggtggtcctgatca

SEQ ID NO: 198566 - DNA, 35 bp, Artificial Sequence
  Synthetic oligonucleotide
gccatgtcgactctgcctctcttcaatgaaactca

SEQ ID NO: 198567 - DNA, 35 bp, Artificial Sequence
  Synthetic oligonucleotide
gtcacctacccagtcgacctagatcctacctctca

SEQ ID NO: 198568 - DNA, 36 bp, Artificial Sequence
  Synthetic oligonucleotide
tactccgtgtccttattgcattttttcacgttctca

SEQ ID NO: 198569 - DNA, 36 bp, Artificial Sequence
  Synthetic oligonucleotide
agtcacacatccacccgtaatcgatacacaccttca

SEQ ID NO: 198570 - DNA, 32 bp, Artificial Sequence
  Synthetic oligonucleotide
gtccagggtcacaaatcggctctatcccttca

SEQ ID NO: 198571 - DNA, 36 bp, Artificial Sequence
  Synthetic oligonucleotide
gcgacgttcctgcctcatccgctgtgccctccttca

SEQ ID NO: 198572 - DNA, 34 bp, Artificial Sequence
  Synthetic oligonucleotide
ttgtagccaccctatttgggaatcccccgtttca

SEQ ID NO: 198573 - DNA, 37 bp, Artificial Sequence
  Synthetic oligonucleotide
gacataggggggaggaaatggagcattgtacacaaga

SEQ ID NO: 198574 - DNA, 37 bp, Artificial Sequence
  Synthetic oligonucleotide
gtagacgcaacggaagggagaagtgatggggcgaaga

SEQ ID NO: 198575 - DNA, 35 bp, Artificial Sequence
  Synthetic oligonucleotide
acgtcgagggggtgagagattaagggggggagaga

SEQ ID NO: 198576 - DNA, 36 bp, Artificial Sequence
  Synthetic oligonucleotide
taggggaggagggcgaggagagtcgtaggtccgaga

SEQ ID NO: 198577 - DNA, 37 bp, Artificial Sequence
  Synthetic oligonucleotide
tcccacccgcacacctgtcccttcacaggcgatacga

SEQ ID NO: 198578 - DNA, 37 bp, Artificial Sequence
  Synthetic oligonucleotide
gccatccgccttgttctgtctcccgcttgccttacga

SEQ ID NO: 198579 - DNA, 37 bp, Artificial Sequence
  Synthetic oligonucleotide
actcgcgatgcagcctgttattatcacctccgaccga

SEQ ID NO: 198580 - DNA, 36 bp, Artificial Sequence
  Synthetic oligonucleotide
gacccatctccagttccgatcagaactccgtaccga

SEQ ID NO: 198581 - DNA, 36 bp, Artificial Sequence
  Synthetic oligonucleotide
gccatgatccactgcgtaacgtccccttgcccccga

SEQ ID NO: 198582 - DNA, 37 bp, Artificial Sequence
  Synthetic oligonucleotide
aaaacagggatgggtggggcgggcgtttccagagcga

SEQ ID NO: 198583 - DNA, 37 bp, Artificial Sequence
  Synthetic oligonucleotide
taatcatggtgatggaggaggatggagggagtagcga

SEQ ID NO: 198584 - DNA, 37 bp, Artificial Sequence
  Synthetic oligonucleotide
tctagcctgtctgtgctccctcgccgactcttctcga

SEQ ID NO: 198585 - DNA, 36 bp, Artificial Sequence
  Synthetic oligonucleotide
gacgaggaacatgggggttttgcaatgatgggagga

SEQ ID NO: 198586 - DNA, 37 bp, Artificial Sequence
  Synthetic oligonucleotide
aagtcggggtcggggtggtagggtgggtgctttcgga

SEQ ID NO: 198587 - DNA, 35 bp, Artificial Sequence
  Synthetic oligonucleotide
gcaatgcacctcacctctcttgttcgaaaccggga

SEQ ID NO: 198588 - DNA, 37 bp, Artificial Sequence
  Synthetic oligonucleotide
aatagggcgggatgtcaataggagtacaagggcggga

SEQ ID NO: 198589 - DNA, 35 bp, Artificial Sequence
  Synthetic oligonucleotide
gcttgggcgggagaggggcaaatctcaacagggga

SEQ ID NO: 198590 - DNA, 37 bp, Artificial Sequence
  Synthetic oligonucleotide
aactgggggcacatggggacaaaatatcgggagggga

SEQ ID NO: 198591 - DNA, 37 bp, Artificial Sequence
  Synthetic oligonucleotide
tgacccgctgcattccgttcttgtagcgccacttgga

SEQ ID NO: 198592 - DNA, 35 bp, Artificial Sequence
  Synthetic oligonucleotide
tccacccattgtctttctcggctcacccctttgga

SEQ ID NO: 198593 - DNA, 38 bp, Artificial Sequence
  Synthetic oligonucleotide
gaaaacgatgagatgtggatgggggaggtgtggaatga

SEQ ID NO: 198594 - DNA, 37 bp, Artificial Sequence
  Synthetic oligonucleotide
gccgatccaccgccttactctcaagaacaggacatga

SEQ ID NO: 198595 - DNA, 38 bp, Artificial Sequence
  Synthetic oligonucleotide
tcccgccacacttactatgcatggcactcttctcatga

SEQ ID NO: 198596 - DNA, 38 bp, Artificial Sequence
  Synthetic oligonucleotide
tgagggcgtagggaggggggtggatttggacggtatga

SEQ ID NO: 198597 - DNA, 37 bp, Artificial Sequence
  Synthetic oligonucleotide
gatctgtcgccatccactggttccgtcccttttatga

SEQ ID NO: 198598 - DNA, 37 bp, Artificial Sequence
  Synthetic oligonucleotide
ggtggtcgtggggggggtagaagggcaggcgcactga

SEQ ID NO: 198599 - DNA, 29 bp, Artificial Sequence
  Synthetic oligonucleotide
attcccgctccgcccttccgccttcctga

SEQ ID NO: 198600 - DNA, 38 bp, Artificial Sequence
  Synthetic oligonucleotide
attgggcgggtcgggagtggggcaattggtgaccgtga

SEQ ID NO: 198601 - DNA, 35 bp, Artificial Sequence
  Synthetic oligonucleotide
gtgcggtagggggtagagttggaaaatgggtgtga

SEQ ID NO: 198602 - DNA, 38 bp, Artificial Sequence
  Synthetic oligonucleotide
ttaacctgcctctgcccttcgtaatatctgccagttga

SEQ ID NO: 198603 - DNA, 38 bp, Artificial Sequence
  Synthetic oligonucleotide
aagacaattcggaagggggaggatgggacaggagttga

SEQ ID NO: 198604 - DNA, 35 bp, Artificial Sequence
  Synthetic oligonucleotide
atccatgcactgtgttgtcccctcttcccatttga

SEQ ID NO: 198605 - DNA, 36 bp, Artificial Sequence
  Synthetic oligonucleotide
ggggatggccggcgaagcgggaagggtacgggtata

SEQ ID NO: 198606 - DNA, 36 bp, Artificial Sequence
  Synthetic oligonucleotide
accacatccactggccatagctacatgttccttata

SEQ ID NO: 198607 - DNA, 35 bp, Artificial Sequence
  Synthetic oligonucleotide
tcagagccgccgctgttcctatgccctatcaccta

SEQ ID NO: 198608 - DNA, 34 bp, Artificial Sequence
  Synthetic oligonucleotide
gtcgcccgctccatgcaggaccctatcctcgtta

SEQ ID NO: 198609 - DNA, 36 bp, Artificial Sequence
  Synthetic oligonucleotide
acccgccctgacccctgtatcgctccactgttgtta

SEQ ID NO: 198610 - DNA, 35 bp, Artificial Sequence
  Synthetic oligonucleotide
tgttgaccttacgctgatattggcaccttcctaac

SEQ ID NO: 198611 - DNA, 35 bp, Artificial Sequence
  Synthetic oligonucleotide
agaactgcgcacttccgcgtaaaactcctggccac

SEQ ID NO: 198612 - DNA, 35 bp, Artificial Sequence
  Synthetic oligonucleotide
ttgagggcgaactgcctggatctcttgttcttcac

SEQ ID NO: 198613 - DNA, 35 bp, Artificial Sequence
  Synthetic oligonucleotide
gctatgccgcattgccgtatggttttactttctac

SEQ ID NO: 198614 - DNA, 35 bp, Artificial Sequence
  Synthetic oligonucleotide
tcgacctcaccgctgtgcacggccaccggtcttac

SEQ ID NO: 198615 - DNA, 35 bp, Artificial Sequence
  Synthetic oligonucleotide
atctggccgataatgcgcgccttcctcgtaatccc

SEQ ID NO: 198616 - DNA, 35 bp, Artificial Sequence
  Synthetic oligonucleotide
tttacgtccggaccgtcactcgacaccctctggcc

SEQ ID NO: 198617 - DNA, 35 bp, Artificial Sequence
  Synthetic oligonucleotide
ggactgccttccgtaatggtcacagctcgatctcc

SEQ ID NO: 198618 - DNA, 35 bp, Artificial Sequence
  Synthetic oligonucleotide
tagacatacgctgtgatgccatacatcgttcttcc

SEQ ID NO: 198619 - DNA, 35 bp, Artificial Sequence
  Synthetic oligonucleotide
tttcacgctctacacactgctcgtctacgctccgc

SEQ ID NO: 198620 - DNA, 35 bp, Artificial Sequence
  Synthetic oligonucleotide
atttagcccatccaatctcgtggtccgttccctgc

SEQ ID NO: 198621 - DNA, 35 bp, Artificial Sequence
  Synthetic oligonucleotide
gctcgcaccgcctctagtcccgcgggttcctcctc

SEQ ID NO: 198622 - DNA, 35 bp, Artificial Sequence
  Synthetic oligonucleotide
tccgcaaccttccctggccgtgctgcaccaagctc

SEQ ID NO: 198623 - DNA, 35 bp, Artificial Sequence
  Synthetic oligonucleotide
acgtgtacgctatgtcggttattgcctgctccttc

SEQ ID NO: 198624 - DNA, 35 bp, Artificial Sequence
  Synthetic oligonucleotide
acccacaatccagtttgatactccatctttgcttc

SEQ ID NO: 198625 - DNA, 35 bp, Artificial Sequence
  Synthetic oligonucleotide
ttgtacgctcgcacagcttatctcgttcacctttc

SEQ ID NO: 198626 - DNA, 35 bp, Artificial Sequence
  Synthetic oligonucleotide
gagacaggcgcttaccctgttcatccttttgtttc

SEQ ID NO: 198627 - DNA, 33 bp, Artificial Sequence
  Synthetic oligonucleotide
ggatggttagcagctgctcgctcctcgtttttc

SEQ ID NO: 198628 - DNA, 35 bp, Artificial Sequence
  Synthetic oligonucleotide
gagacaagcggacacggtttgctggggggagaaag

SEQ ID NO: 198629 - DNA, 35 bp, Artificial Sequence
  Synthetic oligonucleotide
acacctcacatgccgtaccatacattgctaccaag

SEQ ID NO: 198630 - DNA, 35 bp, Artificial Sequence
  Synthetic oligonucleotide
tccaccctgtcaatcttaccccgcgttgccactcg

SEQ ID NO: 198631 - DNA, 35 bp, Artificial Sequence
  Synthetic oligonucleotide
tcgtccaccccattggccaacacctgcctcgctcg

SEQ ID NO: 198632 - DNA, 35 bp, Artificial Sequence
  Synthetic oligonucleotide
gtgaacggaagaggaaccaagggatgagtggaagg

SEQ ID NO: 198633 - DNA, 35 bp, Artificial Sequence
  Synthetic oligonucleotide
gttccacccccacgtgacgtcgcaaagcctgacgg

SEQ ID NO: 198634 - DNA, 35 bp, Artificial Sequence
  Synthetic oligonucleotide
acacccgcctttaacgtcactcacgctcccgccgg

SEQ ID NO: 198635 - DNA, 35 bp, Artificial Sequence
  Synthetic oligonucleotide
aatgggctccggaacctgcaatatcgtccttcctg

SEQ ID NO: 198636 - DNA, 35 bp, Artificial Sequence
  Synthetic oligonucleotide
accgccgtcctcctgggtccacctcattacagctg

SEQ ID NO: 198637 - DNA, 35 bp, Artificial Sequence
  Synthetic oligonucleotide
acacaccacctaacatgttcgccgttccgcccttg

SEQ ID NO: 198638 - DNA, 35 bp, Artificial Sequence
  Synthetic oligonucleotide
ataaggggggcacgggtaagagaggttgcgccaat

SEQ ID NO: 198639 - DNA, 35 bp, Artificial Sequence
  Synthetic oligonucleotide
tgaggtcgaacgtgctgcataccaatcctgcccat

SEQ ID NO: 198640 - DNA, 35 bp, Artificial Sequence
  Synthetic oligonucleotide
taagggcggtgttggggtggggaagggctttgcat

SEQ ID NO: 198641 - DNA, 35 bp, Artificial Sequence
  Synthetic oligonucleotide
acgtggagggacgggcaggagtggaggggaaggat

SEQ ID NO: 198642 - DNA, 35 bp, Artificial Sequence
  Synthetic oligonucleotide
gaagaacgaagggagaaggagcatcggaagggtat

SEQ ID NO: 198643 - DNA, 35 bp, Artificial Sequence
  Synthetic oligonucleotide
tcaccgcactcccaagttgactcctcagtttttat

SEQ ID NO: 198644 - DNA, 35 bp, Artificial Sequence
  Synthetic oligonucleotide
ttggccaccgcatgcctctgctactcgaccatact

SEQ ID NO: 198645 - DNA, 35 bp, Artificial Sequence
  Synthetic oligonucleotide
agccattgcctcctggttgtcccgctcccggtcct

SEQ ID NO: 198646 - DNA, 35 bp, Artificial Sequence
  Synthetic oligonucleotide
tcattgctcctgtggcgttaattccgcatccatct

SEQ ID NO: 198647 - DNA, 35 bp, Artificial Sequence
  Synthetic oligonucleotide
gtttatccgccgtccacccagcatagccctcacgt

SEQ ID NO: 198648 - DNA, 35 bp, Artificial Sequence
  Synthetic oligonucleotide
tacctgcctcatttcactccctctgttccttcggt

SEQ ID NO: 198649 - DNA, 35 bp, Artificial Sequence
  Synthetic oligonucleotide
gagagggctggagtagcggaggagcaatgctgggt

SEQ ID NO: 198650 - DNA, 35 bp, Artificial Sequence
  Synthetic oligonucleotide
tgcaccatgagcactgcgctgaacgacccaacctt

SEQ ID NO: 198651 - DNA, 35 bp, Artificial Sequence
  Synthetic oligonucleotide
gtgatcgccacaagtgactatatactccacacctt

SEQ ID NO: 198652 - DNA, 35 bp, Artificial Sequence
  Synthetic oligonucleotide
actccctccgccgacgtttctcatacctgagagtt

SEQ ID NO: 198653 - DNA, 35 bp, Artificial Sequence
  Synthetic oligonucleotide
gtgagtcgacctgcctgattttgctcgccaccttt

SEQ ID NO: 198654 - DNA, 36 bp, Artificial Sequence
  Synthetic oligonucleotide
acaccatgccactcaccccgccagtttgcaaataaa

SEQ ID NO: 198655 - DNA, 35 bp, Artificial Sequence
  Synthetic oligonucleotide
ttgtcatggctccgatgatttccgccctcctcaca

SEQ ID NO: 198656 - DNA, 35 bp, Artificial Sequence
  Synthetic oligonucleotide
atggtggagggggagggagggacgtgctagagaca

SEQ ID NO: 198657 - DNA, 36 bp, Artificial Sequence
  Synthetic oligonucleotide
tcaaggggggtgggaaaaatagcgggtcactagaca

SEQ ID NO: 198658 - DNA, 36 bp, Artificial Sequence
  Synthetic oligonucleotide
tacttcggtcgccgcctgctccatcctggctaacca

SEQ ID NO: 198659 - DNA, 37 bp, Artificial Sequence
  Synthetic oligonucleotide
gccactcgtacagtttgaccacatattccaccgtcca

SEQ ID NO: 198660 - DNA, 36 bp, Artificial Sequence
  Synthetic oligonucleotide
gttgcccgcgcggccctgttcaagctctccctcgca

SEQ ID NO: 198661 - DNA, 36 bp, Artificial Sequence
  Synthetic oligonucleotide
gtcggacactacctatgttaccctatccacctggca

SEQ ID NO: 198662 - DNA, 35 bp, Artificial Sequence
  Synthetic oligonucleotide
gacgacgtccctagcccactgtgccccgtccctca

SEQ ID NO: 198663 - DNA, 36 bp, Artificial Sequence
  Synthetic oligonucleotide
attcaccgcgctcctgttctatcctacttttggtca

SEQ ID NO: 198664 - DNA, 36 bp, Artificial Sequence
  Synthetic oligonucleotide
gcgatcctgcggctcactgagctacttctaccttca

SEQ ID NO: 198665 - DNA, 36 bp, Artificial Sequence
  Synthetic oligonucleotide
gcgcgaactgtgagatgcctttcttcgccgccttca

SEQ ID NO: 198666 - DNA, 35 bp, Artificial Sequence
  Synthetic oligonucleotide
gaataccccctcctttatgtgctaaggctccttca

SEQ ID NO: 198667 - DNA, 36 bp, Artificial Sequence
  Synthetic oligonucleotide
gcacatcaagttttattactgccctacgttcgttca

SEQ ID NO: 198668 - DNA, 36 bp, Artificial Sequence
  Synthetic oligonucleotide
ggatccgcgaactgcagagcccctttcgtactttca

SEQ ID NO: 198669 - DNA, 36 bp, Artificial Sequence
  Synthetic oligonucleotide
atccgtggtgccagacgctaagtccctcttttttca

SEQ ID NO: 198670 - DNA, 36 bp, Artificial Sequence
  Synthetic oligonucleotide
atgacggggactagggagccggggaaagtagacaga

SEQ ID NO: 198671 - DNA, 37 bp, Artificial Sequence
  Synthetic oligonucleotide
gtgtaagggaagggcgagtacgaatacaggctacaga

SEQ ID NO: 198672 - DNA, 35 bp, Artificial Sequence
  Synthetic oligonucleotide
gaaacaaggaagaggaggacacaatagaatgcaga

SEQ ID NO: 198673 - DNA, 37 bp, Artificial Sequence
  Synthetic oligonucleotide
gaacgaggcgtgaggcgtgacggggtgggttgggaga

SEQ ID NO: 198674 - DNA, 35 bp, Artificial Sequence
  Synthetic oligonucleotide
gtggacccatccccccgtcccaaatgcctccccga

SEQ ID NO: 198675 - DNA, 37 bp, Artificial Sequence
  Synthetic oligonucleotide
gaccgtcgataccatgttctatgcgccccgttcccga

SEQ ID NO: 198676 - DNA, 37 bp, Artificial Sequence
  Synthetic oligonucleotide
gtccaccgacgcttgctttgactcgtcctctctccga

SEQ ID NO: 198677 - DNA, 35 bp, Artificial Sequence
  Synthetic oligonucleotide
ggggtaacaaataggggtgcaggagggagaggcga

SEQ ID NO: 198678 - DNA, 37 bp, Artificial Sequence
  Synthetic oligonucleotide
atggacgaggaattggggaaaggaatggaaactgcga

SEQ ID NO: 198679 - DNA, 37 bp, Artificial Sequence
  Synthetic oligonucleotide
gaaccatcacatcccctttcagacatccgttcttcga

SEQ ID NO: 198680 - DNA, 37 bp, Artificial Sequence
  Synthetic oligonucleotide
tcccacggacagggaacggggggagggttctaacgga

SEQ ID NO: 198681 - DNA, 37 bp, Artificial Sequence
  Synthetic oligonucleotide
taaggctaggacagggaggggatcgggattggcggga

SEQ ID NO: 198682 - DNA, 37 bp, Artificial Sequence
  Synthetic oligonucleotide
tcaaatagcggcatggacgagttaaggggggagggga

SEQ ID NO: 198683 - DNA, 37 bp, Artificial Sequence
  Synthetic oligonucleotide
gttccgggctgggttgtttggggtgtcgctctgggga

SEQ ID NO: 198684 - DNA, 37 bp, Artificial Sequence
  Synthetic oligonucleotide
gacgacatgcgatcgctaggggatgggggggagtgga

SEQ ID NO: 198685 - DNA, 38 bp, Artificial Sequence
  Synthetic oligonucleotide
atcacggcgcaatcgttaatctacctctgcctccatga

SEQ ID NO: 198686 - DNA, 38 bp, Artificial Sequence
  Synthetic oligonucleotide
gccctaccctccgccttgattacgtttgcgctcgctga

SEQ ID NO: 198687 - DNA, 38 bp, Artificial Sequence
  Synthetic oligonucleotide
gtcaaagggcggaggagtcacggaggagcgggatctga

SEQ ID NO: 198688 - DNA, 38 bp, Artificial Sequence
  Synthetic oligonucleotide
agacgggcgggtaaggaggaatagggacgggcacgtga

SEQ ID NO: 198689 - DNA, 37 bp, Artificial Sequence
  Synthetic oligonucleotide
gaagtggcagactgggaggaagcaggattgggggtga

SEQ ID NO: 198690 - DNA, 38 bp, Artificial Sequence
  Synthetic oligonucleotide
gagaggacggtgaggggtgtgagagcgaagggtggtga

SEQ ID NO: 198691 - DNA, 38 bp, Artificial Sequence
  Synthetic oligonucleotide
tgtggaggagggggtggagtcgcgcagacccttggtga

SEQ ID NO: 198692 - DNA, 38 bp, Artificial Sequence
  Synthetic oligonucleotide
gcacacgcgttgtccttctctctctcgccggctattga

SEQ ID NO: 198693 - DNA, 38 bp, Artificial Sequence
  Synthetic oligonucleotide
tgatcaaccgctggtccttcgccgtctttcttacttga

SEQ ID NO: 198694 - DNA, 35 bp, Artificial Sequence
  Synthetic oligonucleotide
ttagcacccccgaactctttccctgagacgcttga

SEQ ID NO: 198695 - DNA, 37 bp, Artificial Sequence
  Synthetic oligonucleotide
aagaaacgaggaagggtgggatgggtcacagagttga

SEQ ID NO: 198696 - DNA, 36 bp, Artificial Sequence
  Synthetic oligonucleotide
tcctcgcctccccatgtatcccagtagtcctgttga

SEQ ID NO: 198697 - DNA, 35 bp, Artificial Sequence
  Synthetic oligonucleotide
agtgaatgcgggcggaagatcaggggcgggtttga

SEQ ID NO: 198698 - DNA, 36 bp, Artificial Sequence
  Synthetic oligonucleotide
gtgtacgagagggggatatagggacgccgaagaata

SEQ ID NO: 198699 - DNA, 35 bp, Artificial Sequence
  Synthetic oligonucleotide
tcatccactcgtcgtgtctgtatccgccgcccgta

SEQ ID NO: 198700 - DNA, 35 bp, Artificial Sequence
  Synthetic oligonucleotide
agcaagagcggtaagagaggcgagggagggaggta

SEQ ID NO: 198701 - DNA, 34 bp, Artificial Sequence
  Synthetic oligonucleotide
tcccacacacgcctgatcatccactcgctaggta

SEQ ID NO: 198702 - DNA, 36 bp, Artificial Sequence
  Synthetic oligonucleotide
gggaaaggactcagggcgggagggggtgtatgtgta

SEQ ID NO: 198703 - DNA, 36 bp, Artificial Sequence
  Synthetic oligonucleotide
tttgacccgcccattgccgtatgtcccctttgttta

SEQ ID NO: 198704 - DNA, 35 bp, Artificial Sequence
  Synthetic oligonucleotide
tgtcgactccgcctcccgtgttacggctttgttta

SEQ ID NO: 198705 - DNA, 35 bp, Artificial Sequence
  Synthetic oligonucleotide
gtccccccgctctgaattatttgttaccatgcaac

SEQ ID NO: 198706 - DNA, 35 bp, Artificial Sequence
  Synthetic oligonucleotide
gaggtatcccccgctgtgcgctgctctcgtcccac

SEQ ID NO: 198707 - DNA, 35 bp, Artificial Sequence
  Synthetic oligonucleotide
tcattcaacagctgtgccattccaccaagtcctac

SEQ ID NO: 198708 - DNA, 35 bp, Artificial Sequence
  Synthetic oligonucleotide
gcccgtcgacaacttcgatcccagctctctcttac

SEQ ID NO: 198709 - DNA, 35 bp, Artificial Sequence
  Synthetic oligonucleotide
tgcgcaccttccgcttctattgagtggcctacacc

SEQ ID NO: 198710 - DNA, 33 bp, Artificial Sequence
  Synthetic oligonucleotide
tcattacgtacgcaaggcaccttcggctttccc

SEQ ID NO: 198711 - DNA, 35 bp, Artificial Sequence
  Synthetic oligonucleotide
accgcctcactggctaccggcctgctccctgcgcc

SEQ ID NO: 198712 - DNA, 35 bp, Artificial Sequence
  Synthetic oligonucleotide
ttttgcagtcgacgtccacgtttttgccacgttcc

SEQ ID NO: 198713 - DNA, 35 bp, Artificial Sequence
  Synthetic oligonucleotide
tccgacagcaacactattcggccgaccgcctccgc

SEQ ID NO: 198714 - DNA, 35 bp, Artificial Sequence
  Synthetic oligonucleotide
gacacgcctcacatccgttgcacacccccattcgc

SEQ ID NO: 198715 - DNA, 35 bp, Artificial Sequence
  Synthetic oligonucleotide
gaggaaggggggagtacttccgagcaggtgaaggc

SEQ ID NO: 198716 - DNA, 35 bp, Artificial Sequence
  Synthetic oligonucleotide
gcccagttccgccagcttatcccacatgccattgc

SEQ ID NO: 198717 - DNA, 35 bp, Artificial Sequence
  Synthetic oligonucleotide
ttcacccccatggtatatcccatcatgcctcttgc

SEQ ID NO: 198718 - DNA, 35 bp, Artificial Sequence
  Synthetic oligonucleotide
tacatcgccccccctggaaggcacttggccacatc

SEQ ID NO: 198719 - DNA, 35 bp, Artificial Sequence
  Synthetic oligonucleotide
tgcatccaaaccatgttaaccggccactcgtcctc

SEQ ID NO: 198720 - DNA, 35 bp, Artificial Sequence
  Synthetic oligonucleotide
gcacccatccgttgttctccgcaattgtcccgctc

SEQ ID NO: 198721 - DNA, 35 bp, Artificial Sequence
  Synthetic oligonucleotide
gacagtgcagatatactccagtttcctcttgcttc

SEQ ID NO: 198722 - DNA, 35 bp, Artificial Sequence
  Synthetic oligonucleotide
tgttacacatgtactaccgtgctccttcggggttc

SEQ ID NO: 198723 - DNA, 35 bp, Artificial Sequence
  Synthetic oligonucleotide
ttcgccactcccccagcgtgtctgtggctcttttc

SEQ ID NO: 198724 - DNA, 35 bp, Artificial Sequence
  Synthetic oligonucleotide
tcgataccggcatttggcacatccccactctcaag

SEQ ID NO: 198725 - DNA, 35 bp, Artificial Sequence
  Synthetic oligonucleotide
acgtgagaaggaggtggggggtggcacggttgaag

SEQ ID NO: 198726 - DNA, 35 bp, Artificial Sequence
  Synthetic oligonucleotide
ttgaggagggggcggggggcgatgaaaagcagcag

SEQ ID NO: 198727 - DNA, 35 bp, Artificial Sequence
  Synthetic oligonucleotide
gaggggaggccgaaggggtacgggtgggttatcag

SEQ ID NO: 198728 - DNA, 35 bp, Artificial Sequence
  Synthetic oligonucleotide
atctggtcccatctgtagcactctcgacttaatag

SEQ ID NO: 198729 - DNA, 35 bp, Artificial Sequence
  Synthetic oligonucleotide
gccccccccaccaatgatataggcccgcgcattag

SEQ ID NO: 198730 - DNA, 35 bp, Artificial Sequence
  Synthetic oligonucleotide
gtactgcacgaactatgcctccaacaccctattag

SEQ ID NO: 198731 - DNA, 34 bp, Artificial Sequence
  Synthetic oligonucleotide
tgtcccccctctcgttgtctttagtcaataaacg

SEQ ID NO: 198732 - DNA, 35 bp, Artificial Sequence
  Synthetic oligonucleotide
gcctccactactatgctgtgccccgctccactacg

SEQ ID NO: 198733 - DNA, 35 bp, Artificial Sequence
  Synthetic oligonucleotide
gtgtggcgggggggttttgcggatggcacatcgcg

SEQ ID NO: 198734 - DNA, 35 bp, Artificial Sequence
  Synthetic oligonucleotide
acatgcccgcaaattcatccctgctttccttcagg

SEQ ID NO: 198735 - DNA, 35 bp, Artificial Sequence
  Synthetic oligonucleotide
tccacggtagagagggtgggaactaggggtaacgg

SEQ ID NO: 198736 - DNA, 35 bp, Artificial Sequence
  Synthetic oligonucleotide
gaacagaccgagtgaggggctaggaacgtggaggg

SEQ ID NO: 198737 - DNA, 35 bp, Artificial Sequence
  Synthetic oligonucleotide
tgtagtgggagtggggtggactgcatgtgggcggg

SEQ ID NO: 198738 - DNA, 35 bp, Artificial Sequence
  Synthetic oligonucleotide
gaccacaagccgtccgtcactcgcgccctttcatg

SEQ ID NO: 198739 - DNA, 35 bp, Artificial Sequence
  Synthetic oligonucleotide
tccacgtctccatttgccggcctagaacaccgctg

SEQ ID NO: 198740 - DNA, 35 bp, Artificial Sequence
  Synthetic oligonucleotide
gtcaccaccccgggtttcgatgatctcctttagtg

SEQ ID NO: 198741 - DNA, 35 bp, Artificial Sequence
  Synthetic oligonucleotide
ttgctagcatctctaggtcgcccttgtctcaccat

SEQ ID NO: 198742 - DNA, 35 bp, Artificial Sequence
  Synthetic oligonucleotide
accagcacggcggtggggggggatgaacgtagcat

SEQ ID NO: 198743 - DNA, 35 bp, Artificial Sequence
  Synthetic oligonucleotide
tcaccgcacccgctatcttaccttcaacaaggcat

SEQ ID NO: 198744 - DNA, 35 bp, Artificial Sequence
  Synthetic oligonucleotide
atcgacgttcagccgcctccgagcaattctctcat

SEQ ID NO: 198745 - DNA, 35 bp, Artificial Sequence
  Synthetic oligonucleotide
ggtcgatcgccttgtcgcttatctctgtccctgat

SEQ ID NO: 198746 - DNA, 35 bp, Artificial Sequence
  Synthetic oligonucleotide
tgcctcacgcaatttctgaccagcaacatccacct

SEQ ID NO: 198747 - DNA, 35 bp, Artificial Sequence
  Synthetic oligonucleotide
gcaacctccgggtgacgtgccatttgcccttccct

SEQ ID NO: 198748 - DNA, 33 bp, Artificial Sequence
  Synthetic oligonucleotide
gcatcctactctttcctcgtctctttcgtgcct

SEQ ID NO: 198749 - DNA, 35 bp, Artificial Sequence
  Synthetic oligonucleotide
gctcgcctacgctaggtgatacttcgctacctcct

SEQ ID NO: 198750 - DNA, 35 bp, Artificial Sequence
  Synthetic oligonucleotide
actcagacgccttgccgtttatcgccttgtcctct

SEQ ID NO: 198751 - DNA, 35 bp, Artificial Sequence
  Synthetic oligonucleotide
ttgccgggccgggagggattatagtggggcttcgt

SEQ ID NO: 198752 - DNA, 35 bp, Artificial Sequence
  Synthetic oligonucleotide
aatggagggacgggctgttggcgagctgggatggt

SEQ ID NO: 198753 - DNA, 35 bp, Artificial Sequence
  Synthetic oligonucleotide
gagcacgtctaacgcctgtccgccctgccttttgt

SEQ ID NO: 198754 - DNA, 35 bp, Artificial Sequence
  Synthetic oligonucleotide
tacacctcccaagactcctcagacaaagcttttgt

SEQ ID NO: 198755 - DNA, 35 bp, Artificial Sequence
  Synthetic oligonucleotide
tcccgcctcccacccggtatggtcacaggctcctt

SEQ ID NO: 198756 - DNA, 35 bp, Artificial Sequence
  Synthetic oligonucleotide
ttactgcccgggcactgcgtagctacttccctgtt

SEQ ID NO: 198757 - DNA, 35 bp, Artificial Sequence
  Synthetic oligonucleotide
atctccccgcgaacttgttaagccgttttcatcaa

SEQ ID NO: 198758 - DNA, 36 bp, Artificial Sequence
  Synthetic oligonucleotide
aatccatcaccctgccttctctaagggacctgtcaa

SEQ ID NO: 198759 - DNA, 36 bp, Artificial Sequence
  Synthetic oligonucleotide
gagagggccacaaggtggggtgacgagtgtggggaa

SEQ ID NO: 198760 - DNA, 36 bp, Artificial Sequence
  Synthetic oligonucleotide
tccccagccggctttctgcatacacgcatccttgaa

SEQ ID NO: 198761 - DNA, 35 bp, Artificial Sequence
  Synthetic oligonucleotide
tgcacaggggcactatcgggggaggaggggtctaa

SEQ ID NO: 198762 - DNA, 36 bp, Artificial Sequence
  Synthetic oligonucleotide
gagatgtcggggtggtacaaagggagctgggagtaa

SEQ ID NO: 198763 - DNA, 35 bp, Artificial Sequence
  Synthetic oligonucleotide
aagggcataccgtacctcatgtccctgggtttaca

SEQ ID NO: 198764 - DNA, 32 bp, Artificial Sequence
  Synthetic oligonucleotide
gatgccaaactccatttgtttgtgaaacacca

SEQ ID NO: 198765 - DNA, 36 bp, Artificial Sequence
  Synthetic oligonucleotide
ttcaccatcaaatcggtattcagtcacactgtccca

SEQ ID NO: 198766 - DNA, 36 bp, Artificial Sequence
  Synthetic oligonucleotide
tttgatgcgcgaatgtatacaacatctcccccgcca

SEQ ID NO: 198767 - DNA, 36 bp, Artificial Sequence
  Synthetic oligonucleotide
tgtcgttccgcccacctcgtgcttaaggtgcttcca

SEQ ID NO: 198768 - DNA, 36 bp, Artificial Sequence
  Synthetic oligonucleotide
tcccatcgctaagctggctgtacctccattcccgca

SEQ ID NO: 198769 - DNA, 35 bp, Artificial Sequence
  Synthetic oligonucleotide
agtgccgtacgggaggggatgctatcaggggggca

SEQ ID NO: 198770 - DNA, 36 bp, Artificial Sequence
  Synthetic oligonucleotide
gagcaagtcaatctgcactatctcaccagccttgca

SEQ ID NO: 198771 - DNA, 35 bp, Artificial Sequence
  Synthetic oligonucleotide
ttcacccacacacacgagcaacaccgttcgcttca

SEQ ID NO: 198772 - DNA, 37 bp, Artificial Sequence
  Synthetic oligonucleotide
gatggggacaatgcaatattagggggacggggaaaga

SEQ ID NO: 198773 - DNA, 35 bp, Artificial Sequence
  Synthetic oligonucleotide
ggtaaagcgtgagggcgggggagtaggactgcaga

SEQ ID NO: 198774 - DNA, 37 bp, Artificial Sequence
  Synthetic oligonucleotide
ttacagccgtgctttgtctgttctacccgccggccga

SEQ ID NO: 198775 - DNA, 37 bp, Artificial Sequence
  Synthetic oligonucleotide
atacctaggcgtccgacatgcctttacacctcctcga

SEQ ID NO: 198776 - DNA, 37 bp, Artificial Sequence
  Synthetic oligonucleotide
gtccaacctcacctttgttccacgaattttatttcga

SEQ ID NO: 198777 - DNA, 37 bp, Artificial Sequence
  Synthetic oligonucleotide
gatgcatggcgggacaaggggaatgggcgagtcggga

SEQ ID NO: 198778 - DNA, 37 bp, Artificial Sequence
  Synthetic oligonucleotide
gagtggcggtaaaaagggtgacaaagggggtagggga

SEQ ID NO: 198779 - DNA, 38 bp, Artificial Sequence
  Synthetic oligonucleotide
gagtaggtgcagacgcggagtgaggagggcgaaaatga

SEQ ID NO: 198780 - DNA, 38 bp, Artificial Sequence
  Synthetic oligonucleotide
tgaaggtgtggagagggaccaatagagagggagaatga

SEQ ID NO: 198781 - DNA, 38 bp, Artificial Sequence
  Synthetic oligonucleotide
gaaagagggcactagggacaaggacgaacggggaatga

SEQ ID NO: 198782 - DNA, 38 bp, Artificial Sequence
  Synthetic oligonucleotide
agaggagaggtggggggaagaagaagcgtatggaatga

SEQ ID NO: 198783 - DNA, 37 bp, Artificial Sequence
  Synthetic oligonucleotide
accacacgcgcatccccgggtttctagtactacctga

SEQ ID NO: 198784 - DNA, 38 bp, Artificial Sequence
  Synthetic oligonucleotide
gggagggaggggccgggatgtatggtatgtaggcctga

SEQ ID NO: 198785 - DNA, 38 bp, Artificial Sequence
  Synthetic oligonucleotide
gaacaggtacggacacgaggatgggagtggggaagtga

SEQ ID NO: 198786 - DNA, 37 bp, Artificial Sequence
  Synthetic oligonucleotide
gcaccgaccgttctaccctcttcagttctcggcgtga

SEQ ID NO: 198787 - DNA, 38 bp, Artificial Sequence
  Synthetic oligonucleotide
tgcgggaggtgcgggttagaagggagcaatgaaggtga

SEQ ID NO: 198788 - DNA, 37 bp, Artificial Sequence
  Synthetic oligonucleotide
agggcacatccctgttccgttcactctgtcctattga

SEQ ID NO: 198789 - DNA, 37 bp, Artificial Sequence
  Synthetic oligonucleotide
tgagagtcgctcccgtagtacccccccctgttgttga

SEQ ID NO: 198790 - DNA, 37 bp, Artificial Sequence
  Synthetic oligonucleotide
gtgctgcctccgccttctgttcgttgcctctttttga

SEQ ID NO: 198791 - DNA, 35 bp, Artificial Sequence
  Synthetic oligonucleotide
aaccgctgccgcactgccgcgtacttatcttccta

SEQ ID NO: 198792 - DNA, 36 bp, Artificial Sequence
  Synthetic oligonucleotide
atgatgctcctctgcttcactaactaactggatcta

SEQ ID NO: 198793 - DNA, 36 bp, Artificial Sequence
  Synthetic oligonucleotide
acgtataggggggggggggcataatggggtattgta

SEQ ID NO: 198794 - DNA, 35 bp, Artificial Sequence
  Synthetic oligonucleotide
aagacactaggagggggaggggagggaacgttgta

SEQ ID NO: 198795 - DNA, 35 bp, Artificial Sequence
  Synthetic oligonucleotide
taccccttactgtgccagacttccgtcgctacaac

SEQ ID NO: 198796 - DNA, 35 bp, Artificial Sequence
  Synthetic oligonucleotide
tcaaggctggtgtgcgccgttccccacgttctaac

SEQ ID NO: 198797 - DNA, 35 bp, Artificial Sequence
  Synthetic oligonucleotide
aacgcctccctctgccatttcccactcgtagacac

SEQ ID NO: 198798 - DNA, 35 bp, Artificial Sequence
  Synthetic oligonucleotide
acctaccgccgacggttaattaaccatccatgcac

SEQ ID NO: 198799 - DNA, 35 bp, Artificial Sequence
  Synthetic oligonucleotide
taccagcgctcgctatgtacccctcgagtcccacc

SEQ ID NO: 198800 - DNA, 35 bp, Artificial Sequence
  Synthetic oligonucleotide
gcgcctcgacccaagtcttccggagccattccacc

SEQ ID NO: 198801 - DNA, 31 bp, Artificial Sequence
  Synthetic oligonucleotide
tgcaaggtccacttcgatggatcacgccccc

SEQ ID NO: 198802 - DNA, 35 bp, Artificial Sequence
  Synthetic oligonucleotide
gcacgcaccacttgagttagtccgttctttccccc

SEQ ID NO: 198803 - DNA, 35 bp, Artificial Sequence
  Synthetic oligonucleotide
atctggccgatactgcgcgccttccttgtaatccc

SEQ ID NO: 198804 - DNA, 35 bp, Artificial Sequence
  Synthetic oligonucleotide
acgcaccccactgtcgcgcctacagaccagccgcc

SEQ ID NO: 198805 - DNA, 35 bp, Artificial Sequence
  Synthetic oligonucleotide
acgatagctacatcagtaatactactcacctcgcc

SEQ ID NO: 198806 - DNA, 35 bp, Artificial Sequence
  Synthetic oligonucleotide
agcgctgcaatgagttctgatccttcctcgctgcc

SEQ ID NO: 198807 - DNA, 35 bp, Artificial Sequence
  Synthetic oligonucleotide
gccgcaaccttccgtcttgctcttcaggagttgcc

SEQ ID NO: 198808 - DNA, 35 bp, Artificial Sequence
  Synthetic oligonucleotide
aagtcaccctccgctgttctgtgtccccttttgcc

SEQ ID NO: 198809 - DNA, 35 bp, Artificial Sequence
  Synthetic oligonucleotide
tcctgtacgaccaatacggtaacgctccactgtcc

SEQ ID NO: 198810 - DNA, 35 bp, Artificial Sequence
  Synthetic oligonucleotide
gcccatgcccactatcctgtttttgccacacttcc

SEQ ID NO: 198811 - DNA, 35 bp, Artificial Sequence
  Synthetic oligonucleotide
acaacacccgccatccgttctcatcacgcacacgc

SEQ ID NO: 198812 - DNA, 35 bp, Artificial Sequence
  Synthetic oligonucleotide
ttcatcgcccgtctcctccggctttacctcttggc

SEQ ID NO: 198813 - DNA, 35 bp, Artificial Sequence
  Synthetic oligonucleotide
tgacaccctgatgtcgccctcgattctgtctatgc

SEQ ID NO: 198814 - DNA, 35 bp, Artificial Sequence
  Synthetic oligonucleotide
tactgactgccctctgtaactactcaaaactgtgc

SEQ ID NO: 198815 - DNA, 35 bp, Artificial Sequence
  Synthetic oligonucleotide
tccgccatcccacgctccctacttgcacgctgtgc

SEQ ID NO: 198816 - DNA, 34 bp, Artificial Sequence
  Synthetic oligonucleotide
atgcggggcttccgctagttatctgtctccttgc

SEQ ID NO: 198817 - DNA, 35 bp, Artificial Sequence
  Synthetic oligonucleotide
gcacgaaagtgccgccttagtacatccgcttcctc

SEQ ID NO: 198818 - DNA, 35 bp, Artificial Sequence
  Synthetic oligonucleotide
tatctcgtacgtccaagcccatctcgcccacgctc

SEQ ID NO: 198819 - DNA, 35 bp, Artificial Sequence
  Synthetic oligonucleotide
tgggacgtacacatccagttgactctacctcgctc

SEQ ID NO: 198820 - DNA, 35 bp, Artificial Sequence
  Synthetic oligonucleotide
tttgccgcccccgaattatatgcccctcttacgtc

SEQ ID NO: 198821 - DNA, 35 bp, Artificial Sequence
  Synthetic oligonucleotide
ggaccccgcaatctgcctccgacacgctctcgttc

SEQ ID NO: 198822 - DNA, 35 bp, Artificial Sequence
  Synthetic oligonucleotide
tccgtacgctccaactttctgttcatggcctgttc

SEQ ID NO: 198823 - DNA, 36 bp, Artificial Sequence
  Synthetic oligonucleotide
tctgacgtcgcactacgcctatcatcccctccttag

SEQ ID NO: 198824 - DNA, 35 bp, Artificial Sequence
  Synthetic oligonucleotide
gcaaggagtcgtgggggcttttagagagggtggcg

SEQ ID NO: 198825 - DNA, 35 bp, Artificial Sequence
  Synthetic oligonucleotide
actgagatggcgtgggtgggagctaaagacgtggg

SEQ ID NO: 198826 - DNA, 35 bp, Artificial Sequence
  Synthetic oligonucleotide
tctgggcacgggagggtcatcgggcacatgaaatg

SEQ ID NO: 198827 - DNA, 35 bp, Artificial Sequence
  Synthetic oligonucleotide
tgaaggacgagagagtggtgttggcggagaggatg

SEQ ID NO: 198828 - DNA, 35 bp, Artificial Sequence
  Synthetic oligonucleotide
gtgtcatccagctatcatttttcgcactggccctg

SEQ ID NO: 198829 - DNA, 35 bp, Artificial Sequence
  Synthetic oligonucleotide
taccatgccgttctctatgtgccccttcgttcctg

SEQ ID NO: 198830 - DNA, 34 bp, Artificial Sequence
  Synthetic oligonucleotide
gacacccccgccccctacggtacagattattcat

SEQ ID NO: 198831 - DNA, 31 bp, Artificial Sequence
  Synthetic oligonucleotide
ttaggcataggccttaccacctttccgctat

SEQ ID NO: 198832 - DNA, 25 bp, Artificial Sequence
  Synthetic oligonucleotide
gagtcctcgcaaacctctaccacct

SEQ ID NO: 198833 - DNA, 35 bp, Artificial Sequence
  Synthetic oligonucleotide
taggcgaacgcactcggcttgtcttatatccccct

SEQ ID NO: 198834 - DNA, 35 bp, Artificial Sequence
  Synthetic oligonucleotide
atcgagagtccgcccaattgacgtttctggcccct

SEQ ID NO: 198835 - DNA, 34 bp, Artificial Sequence
  Synthetic oligonucleotide
tcgccatccctctgacagccttgtcctaccgcct

SEQ ID NO: 198836 - DNA, 35 bp, Artificial Sequence
  Synthetic oligonucleotide
accgcacgtcattccgctacaccccgcaccttgct

SEQ ID NO: 198837 - DNA, 35 bp, Artificial Sequence
  Synthetic oligonucleotide
tcacacctcactgtgccacccacaccccctctggt

SEQ ID NO: 198838 - DNA, 34 bp, Artificial Sequence
  Synthetic oligonucleotide
gggagggggatggatgcgggagtgcaaaatgtgt

SEQ ID NO: 198839 - DNA, 35 bp, Artificial Sequence
  Synthetic oligonucleotide
taggtgcgcctgtctttgattgatcccccgccatt

SEQ ID NO: 198840 - DNA, 35 bp, Artificial Sequence
  Synthetic oligonucleotide
gagagcgcatcatacccgtacgccgacccgccctt

SEQ ID NO: 198841 - DNA, 36 bp, Artificial Sequence
  Synthetic oligonucleotide
tccgcacccagctgtatcatcgtatgcctctcacaa

SEQ ID NO: 198842 - DNA, 36 bp, Artificial Sequence
  Synthetic oligonucleotide
aagggggggaacgaaggctggtgaatggtggatgaa

SEQ ID NO: 198843 - DNA, 35 bp, Artificial Sequence
  Synthetic oligonucleotide
gcacgtgcgcccgctgcctttccttaggggcctaa

SEQ ID NO: 198844 - DNA, 35 bp, Artificial Sequence
  Synthetic oligonucleotide
aacatcacaccttgtctccagttttagtgaacaca

SEQ ID NO: 198845 - DNA, 35 bp, Artificial Sequence
  Synthetic oligonucleotide
gagcctcgaatgcgcatacactttcccctgtcaca

SEQ ID NO: 198846 - DNA, 36 bp, Artificial Sequence
  Synthetic oligonucleotide
tgaccgttctcctggccgtgaccaatccctgtccca

SEQ ID NO: 198847 - DNA, 36 bp, Artificial Sequence
  Synthetic oligonucleotide
gcatgaggcatccatgccgatatatactcatctcca

SEQ ID NO: 198848 - DNA, 35 bp, Artificial Sequence
  Synthetic oligonucleotide
tccgcgccccgcaggtcatatccggttccttagca

SEQ ID NO: 198849 - DNA, 35 bp, Artificial Sequence
  Synthetic oligonucleotide
tatcatccagagccaagaaggggaggggagatgca

SEQ ID NO: 198850 - DNA, 36 bp, Artificial Sequence
  Synthetic oligonucleotide
atcccaccgcagtcagtagcctgtcttcatgcctca

SEQ ID NO: 198851 - DNA, 35 bp, Artificial Sequence
  Synthetic oligonucleotide
ttcgccttacgcacttgccattcgagccccgctca

SEQ ID NO: 198852 - DNA, 35 bp, Artificial Sequence
  Synthetic oligonucleotide
gcatggttcgcgctttttgtccacgttccttttca

SEQ ID NO: 198853 - DNA, 37 bp, Artificial Sequence
  Synthetic oligonucleotide
atggaaatggagtgatgggcaagggagggtcatcaga

SEQ ID NO: 198854 - DNA, 37 bp, Artificial Sequence
  Synthetic oligonucleotide
tcatcccccttctttcgtgctatcgacactcgagaga

SEQ ID NO: 198855 - DNA, 35 bp, Artificial Sequence
  Synthetic oligonucleotide
gcaccagacgtaattgcgcccttcttcatcaccga

SEQ ID NO: 198856 - DNA, 36 bp, Artificial Sequence
  Synthetic oligonucleotide
gagggtgcgagtgggggctatgggtctggggatcga

SEQ ID NO: 198857 - DNA, 38 bp, Artificial Sequence
  Synthetic oligonucleotide
tcctgtgcgcccacgaacatgtaattgcccatcctcga

SEQ ID NO: 198858 - DNA, 35 bp, Artificial Sequence
  Synthetic oligonucleotide
tagacgggaggaagggaacccgggaaaaagaagga

SEQ ID NO: 198859 - DNA, 35 bp, Artificial Sequence
  Synthetic oligonucleotide
atgggggaggtgctgggaaggagcacaagtaagga

SEQ ID NO: 198860 - DNA, 36 bp, Artificial Sequence
  Synthetic oligonucleotide
acagagggaagggttctacgggggggattgccagga

SEQ ID NO: 198861 - DNA, 37 bp, Artificial Sequence
  Synthetic oligonucleotide
atccaccccatcttcgtgaagcgcctgtcatcgcgga

SEQ ID NO: 198862 - DNA, 37 bp, Artificial Sequence
  Synthetic oligonucleotide
aacctcgcctcgctttcatcgtttgtcccatcctgga

SEQ ID NO: 198863 - DNA, 37 bp, Artificial Sequence
  Synthetic oligonucleotide
gatagtgcatgatgtggctacccctcctctctctgga

SEQ ID NO: 198864 - DNA, 38 bp, Artificial Sequence
  Synthetic oligonucleotide
tcgaaaggggagtgaatggggggtgcgggacaacatga

SEQ ID NO: 198865 - DNA, 38 bp, Artificial Sequence
  Synthetic oligonucleotide
tccacaccccctcgatatgaagctccattagaccctga

SEQ ID NO: 198866 - DNA, 38 bp, Artificial Sequence
  Synthetic oligonucleotide
ttgtgtcatcgctcagcgtctctttcactccagtctga

SEQ ID NO: 198867 - DNA, 38 bp, Artificial Sequence
  Synthetic oligonucleotide
tgtggtggcagagaggggagcgggtggtggcactgtga

SEQ ID NO: 198868 - DNA, 37 bp, Artificial Sequence
  Synthetic oligonucleotide
aacgccccctcgcatgtactttctatggtccccttga

SEQ ID NO: 198869 - DNA, 37 bp, Artificial Sequence
  Synthetic oligonucleotide
gagatgctgcccaatgttccaccgtcgcactccttga

SEQ ID NO: 198870 - DNA, 38 bp, Artificial Sequence
  Synthetic oligonucleotide
gaaagtccaggaagaagggggctcgaagggttagttga

SEQ ID NO: 198871 - DNA, 36 bp, Artificial Sequence
  Synthetic oligonucleotide
gcgacaagggccaccttgcctacggttccacccata

SEQ ID NO: 198872 - DNA, 35 bp, Artificial Sequence
  Synthetic oligonucleotide
acctatcgctccgtggctctgtaccgtgatcccta

SEQ ID NO: 198873 - DNA, 36 bp, Artificial Sequence
  Synthetic oligonucleotide
tcgagcggtgggagggtgggtcacatcgactctcta

SEQ ID NO: 198874 - DNA, 36 bp, Artificial Sequence
  Synthetic oligonucleotide
atccatcccatccatttgtccagacgatgcctcgta

SEQ ID NO: 198875 - DNA, 36 bp, Artificial Sequence
  Synthetic oligonucleotide
gggggcagttgctcgggtggggatgcaatgggggta

SEQ ID NO: 198876 - DNA, 36 bp, Artificial Sequence
  Synthetic oligonucleotide
tacgacccacgcctaattatctcttcatgccatgta

SEQ ID NO: 198877 - DNA, 34 bp, Artificial Sequence
  Synthetic oligonucleotide
gaccaacctccttgccgtttactttggactatta

SEQ ID NO: 198878 - DNA, 35 bp, Artificial Sequence
  Synthetic oligonucleotide
acaacatgtccagcccatccttcccgaggcactta

SEQ ID NO: 198879 - DNA, 36 bp, Artificial Sequence
  Synthetic oligonucleotide
gacaagtcgctgggatttcctccgtcgctcctctta

SEQ ID NO: 198880 - DNA, 35 bp, Artificial Sequence
  Synthetic oligonucleotide
ttagacgctctcgtgctgttccctcttcgcgttta

SEQ ID NO: 198881 - DNA, 35 bp, Artificial Sequence
  Synthetic oligonucleotide
gacaatcgtccgccctggcaaggacctcaccacac

SEQ ID NO: 198882 - DNA, 35 bp, Artificial Sequence
  Synthetic oligonucleotide
gcaacaaccgaccagcgagttcttcgtggctacac

SEQ ID NO: 198883 - DNA, 35 bp, Artificial Sequence
  Synthetic oligonucleotide
tggacaggcgtttatgagtgcacccatcgctccac

SEQ ID NO: 198884 - DNA, 35 bp, Artificial Sequence
  Synthetic oligonucleotide
ttgacggacacggcaacggctctttacggttctac

SEQ ID NO: 198885 - DNA, 35 bp, Artificial Sequence
  Synthetic oligonucleotide
gttggacgcgtttgctgcattctactccaccgacc

SEQ ID NO: 198886 - DNA, 35 bp, Artificial Sequence
  Synthetic oligonucleotide
aatacatcggccacatgctttcatctcccgtgacc

SEQ ID NO: 198887 - DNA, 35 bp, Artificial Sequence
  Synthetic oligonucleotide
atccatcgccagcctcttgcttcatcggtcacccc

SEQ ID NO: 198888 - DNA, 35 bp, Artificial Sequence
  Synthetic oligonucleotide
atcacagcctctatgggcacttcccgctccatccc

SEQ ID NO: 198889 - DNA, 35 bp, Artificial Sequence
  Synthetic oligonucleotide
gacgcaccgtctgggtccgtcgacgcgtgcctccc

SEQ ID NO: 198890 - DNA, 35 bp, Artificial Sequence
  Synthetic oligonucleotide
agccccgacgccatcccgagagccttggagctccc

SEQ ID NO: 198891 - DNA, 35 bp, Artificial Sequence
  Synthetic oligonucleotide
ggatcgcgcagatcattgtctctttgtctctggcc

SEQ ID NO: 198892 - DNA, 35 bp, Artificial Sequence
  Synthetic oligonucleotide
gtcactctgtcggtgtcgtttttttccctcgatcc

SEQ ID NO: 198893 - DNA, 35 bp, Artificial Sequence
  Synthetic oligonucleotide
gacgcatgaccgtcgcgctacagttcacccggtcc

SEQ ID NO: 198894 - DNA, 35 bp, Artificial Sequence
  Synthetic oligonucleotide
gaccctgcctttaaccttgtctatcatagtggtcc

SEQ ID NO: 198895 - DNA, 35 bp, Artificial Sequence
  Synthetic oligonucleotide
gttcacgtgatcgccctcaacatagcgtaccttcc

SEQ ID NO: 198896 - DNA, 35 bp, Artificial Sequence
  Synthetic oligonucleotide
aacacttcaccatgccgcactcaaggcctcgttcc

SEQ ID NO: 198897 - DNA, 35 bp, Artificial Sequence
  Synthetic oligonucleotide
atgccatcgtcaacccctatcgctcacgtcacagc

SEQ ID NO: 198898 - DNA, 35 bp, Artificial Sequence
  Synthetic oligonucleotide
gccaccgaatcgggtagcgcttcactctctatcgc

SEQ ID NO: 198899 - DNA, 35 bp, Artificial Sequence
  Synthetic oligonucleotide
tagggcgactcagagggacgatgggagggtcgggc

SEQ ID NO: 198900 - DNA, 35 bp, Artificial Sequence
  Synthetic oligonucleotide
tccacgcagttacactttcgagttgagtcccctgc

SEQ ID NO: 198901 - DNA, 35 bp, Artificial Sequence
  Synthetic oligonucleotide
ttgacgctcactcagggcaagcgcaccgaaccatc

SEQ ID NO: 198902 - DNA, 35 bp, Artificial Sequence
  Synthetic oligonucleotide
tgcgatggcccagttcgtctttttcctcctggatc

SEQ ID NO: 198903 - DNA, 35 bp, Artificial Sequence
  Synthetic oligonucleotide
tcagccacctgtcgtttttctgttccgtacttatc

SEQ ID NO: 198904 - DNA, 35 bp, Artificial Sequence
  Synthetic oligonucleotide
aaggtgcacgcatcacaatgcgcttaacgcccctc

SEQ ID NO: 198905 - DNA, 35 bp, Artificial Sequence
  Synthetic oligonucleotide
tgtgacgttgctccccgattacagattctgccctc

SEQ ID NO: 198906 - DNA, 35 bp, Artificial Sequence
  Synthetic oligonucleotide
aacgacgccatctattttatttcgtaccgctcctc

SEQ ID NO: 198907 - DNA, 35 bp, Artificial Sequence
  Synthetic oligonucleotide
ttggctggcatagtctcttcgcgccggtctttctc

SEQ ID NO: 198908 - DNA, 36 bp, Artificial Sequence
  Synthetic oligonucleotide
atgcactcagtcccgattcgtcgcattttggttgtc

SEQ ID NO: 198909 - DNA, 35 bp, Artificial Sequence
  Synthetic oligonucleotide
ttggtctcgccgcacatctgcccccccctaggttc

SEQ ID NO: 198910 - DNA, 35 bp, Artificial Sequence
  Synthetic oligonucleotide
acaccaggcgcccatgcttcctcctccgtatggag

SEQ ID NO: 198911 - DNA, 35 bp, Artificial Sequence
  Synthetic oligonucleotide
gggcgggtgggaaggggtgtaagctgccttctgag

SEQ ID NO: 198912 - DNA, 35 bp, Artificial Sequence
  Synthetic oligonucleotide
gtgtctctcatccatcaccacctcgcctcctgtag

SEQ ID NO: 198913 - DNA, 35 bp, Artificial Sequence
  Synthetic oligonucleotide
tcagtgtctcattgcctaatgcatcctcccgcacg

SEQ ID NO: 198914 - DNA, 35 bp, Artificial Sequence
  Synthetic oligonucleotide
gtcaaatgcccaccactgttgtctactcgcctacg

SEQ ID NO: 198915 - DNA, 35 bp, Artificial Sequence
  Synthetic oligonucleotide
gaccgcctgccacacatcttccatacgccactccg

SEQ ID NO: 198916 - DNA, 35 bp, Artificial Sequence
  Synthetic oligonucleotide
ggccacccactttgtttcatcgttcgcgatctccg

SEQ ID NO: 198917 - DNA, 35 bp, Artificial Sequence
  Synthetic oligonucleotide
ttccagtcctccaccaggtgtcatgctcccgcgcg

SEQ ID NO: 198918 - DNA, 35 bp, Artificial Sequence
  Synthetic oligonucleotide
tatgcaccctctcataacatcgtatttagtcccgg

SEQ ID NO: 198919 - DNA, 35 bp, Artificial Sequence
  Synthetic oligonucleotide
tgagacggtcgaacgaggaggggggatgtgatcgg

SEQ ID NO: 198920 - DNA, 35 bp, Artificial Sequence
  Synthetic oligonucleotide
tatagtagccacagggaggtaagggggcgggaggg

SEQ ID NO: 198921 - DNA, 35 bp, Artificial Sequence
  Synthetic oligonucleotide
gtccgccttaattgctcgacgcatccactacctgg

SEQ ID NO: 198922 - DNA, 35 bp, Artificial Sequence
  Synthetic oligonucleotide
tcgaccccggccccgtctaacgcaacgcaccctgg

SEQ ID NO: 198923 - DNA, 35 bp, Artificial Sequence
  Synthetic oligonucleotide
atccgcacgtgctggtcctgacaactccattcctg

SEQ ID NO: 198924 - DNA, 35 bp, Artificial Sequence
  Synthetic oligonucleotide
gacgctggaggcacgtgaatggggggggtttagtg

SEQ ID NO: 198925 - DNA, 35 bp, Artificial Sequence
  Synthetic oligonucleotide
tcacggcgtagggaaaggtggagggcggatacgtg

SEQ ID NO: 198926 - DNA, 35 bp, Artificial Sequence
  Synthetic oligonucleotide
tccagcgcaatcgtggagtatcgggggggagggtg

SEQ ID NO: 198927 - DNA, 35 bp, Artificial Sequence
  Synthetic oligonucleotide
gtccaaacggcctattgctccagcccaccctattg

SEQ ID NO: 198928 - DNA, 35 bp, Artificial Sequence
  Synthetic oligonucleotide
gaacgctgatcgatcttcgacgtgtcctgttccat

SEQ ID NO: 198929 - DNA, 35 bp, Artificial Sequence
  Synthetic oligonucleotide
gacaccatctgtctctgccgatacccagcccacct

SEQ ID NO: 198930 - DNA, 35 bp, Artificial Sequence
  Synthetic oligonucleotide
acgtacgtcaactgctccctcgtggccctccatct

SEQ ID NO: 198931 - DNA, 35 bp, Artificial Sequence
  Synthetic oligonucleotide
gctgggcaccaatatgtgtgtgttccatccattct

SEQ ID NO: 198932 - DNA, 35 bp, Artificial Sequence
  Synthetic oligonucleotide
acgaacggggaggagtgggaccaggtgggcacagt

SEQ ID NO: 198933 - DNA, 35 bp, Artificial Sequence
  Synthetic oligonucleotide
gtcccatccaccctcccacaggacaaacctgaggt

SEQ ID NO: 198934 - DNA, 35 bp, Artificial Sequence
  Synthetic oligonucleotide
tggaggagggagcaatggtacttagggggtgtggt

SEQ ID NO: 198935 - DNA, 35 bp, Artificial Sequence
  Synthetic oligonucleotide
gccatcccccgaaccgtgcaattgagaattcttgt

SEQ ID NO: 198936 - DNA, 35 bp, Artificial Sequence
  Synthetic oligonucleotide
gtgagcctccaacccctctgcttaggcccgctatt

SEQ ID NO: 198937 - DNA, 35 bp, Artificial Sequence
  Synthetic oligonucleotide
attccacgcacctcccatgctgtccacttgtcctt

SEQ ID NO: 198938 - DNA, 35 bp, Artificial Sequence
  Synthetic oligonucleotide
gccatacagcccgcagcttttcctcacccttggtt

SEQ ID NO: 198939 - DNA, 36 bp, Artificial Sequence
  Synthetic oligonucleotide
gacgattaccgggaagggttacgggtgggttaccaa

SEQ ID NO: 198940 - DNA, 36 bp, Artificial Sequence
  Synthetic oligonucleotide
atgtgccctccgcccttgaattgtccttgctagcaa

SEQ ID NO: 198941 - DNA, 36 bp, Artificial Sequence
  Synthetic oligonucleotide
gacaatgccacagtatgttgcttcctcttgccctaa

SEQ ID NO: 198942 - DNA, 35 bp, Artificial Sequence
  Synthetic oligonucleotide
acatccatcgccgcactatgcaccggacatagtaa

SEQ ID NO: 198943 - DNA, 36 bp, Artificial Sequence
  Synthetic oligonucleotide
tgacctggacagtttgtcttttgccactcctcgaca

SEQ ID NO: 198944 - DNA, 35 bp, Artificial Sequence
  Synthetic oligonucleotide
gacacctcctgtgcagtcagactcgcggtcgccca

SEQ ID NO: 198945 - DNA, 36 bp, Artificial Sequence
  Synthetic oligonucleotide
gtgtcacgcggtatgttatgtttcacgctctggcca

SEQ ID NO: 198946 - DNA, 37 bp, Artificial Sequence
  Synthetic oligonucleotide
gcacactcgagtcgtacagtccctccgcatacccgca

SEQ ID NO: 198947 - DNA, 36 bp, Artificial Sequence
  Synthetic oligonucleotide
tgccaccgcctgctctgccccccttcgaactatgca

SEQ ID NO: 198948 - DNA, 36 bp, Artificial Sequence
  Synthetic oligonucleotide
ttgccgtccaatcatgtttcttcaccttctcctgca

SEQ ID NO: 198949 - DNA, 36 bp, Artificial Sequence
  Synthetic oligonucleotide
tttgcattccatctgggcgtttcacctactgctgca

SEQ ID NO: 198950 - DNA, 36 bp, Artificial Sequence
  Synthetic oligonucleotide
tcagcctcccggtcgtaccaatagatcccttcatca

SEQ ID NO: 198951 - DNA, 29 bp, Artificial Sequence
  Synthetic oligonucleotide
tctcgaccggtcggtggctctttccctca

SEQ ID NO: 198952 - DNA, 36 bp, Artificial Sequence
  Synthetic oligonucleotide
gacgctacctctcgtcaatcactcgcattggattca

SEQ ID NO: 198953 - DNA, 36 bp, Artificial Sequence
  Synthetic oligonucleotide
tgctgctgagtatcgttcatccccgtcctgtcttca

SEQ ID NO: 198954 - DNA, 36 bp, Artificial Sequence
  Synthetic oligonucleotide
tgaccaggccagcaaccgttccatcactgtgtttca

SEQ ID NO: 198955 - DNA, 37 bp, Artificial Sequence
  Synthetic oligonucleotide
gggtgggcgtaggggggggtggtacggatcagtaaga

SEQ ID NO: 198956 - DNA, 33 bp, Artificial Sequence
  Synthetic oligonucleotide
agcatgagggggaagcgggtgtgctgatgtaga

SEQ ID NO: 198957 - DNA, 36 bp, Artificial Sequence
  Synthetic oligonucleotide
tgcgccgggacctgcgttcttccatcctgctgacga

SEQ ID NO: 198958 - DNA, 37 bp, Artificial Sequence
  Synthetic oligonucleotide
gtgaccccccgctggatgctcgcccctctacttacga

SEQ ID NO: 198959 - DNA, 35 bp, Artificial Sequence
  Synthetic oligonucleotide
ttcacatccatggtcgtatcactccatcttaccga

SEQ ID NO: 198960 - DNA, 37 bp, Artificial Sequence
  Synthetic oligonucleotide
agtccccgccctcactgagatcacagccacatcccga

SEQ ID NO: 198961 - DNA, 37 bp, Artificial Sequence
  Synthetic oligonucleotide
gagcacagtccttattagttcatcgcccctccgccga

SEQ ID NO: 198962 - DNA, 37 bp, Artificial Sequence
  Synthetic oligonucleotide
gatacgtgggacggggtaacataggagagaaggccga

SEQ ID NO: 198963 - DNA, 36 bp, Artificial Sequence
  Synthetic oligonucleotide
gagtaactgacggggggcatgggcgacaaccggcga

SEQ ID NO: 198964 - DNA, 37 bp, Artificial Sequence
  Synthetic oligonucleotide
gctcagcccatcccacctttaacgcacagcctgtcga

SEQ ID NO: 198965 - DNA, 37 bp, Artificial Sequence
  Synthetic oligonucleotide
aagaggggagtggggagatggggggcgactacttcga

SEQ ID NO: 198966 - DNA, 36 bp, Artificial Sequence
  Synthetic oligonucleotide
ttcgccctcatctatagttttactacaccttttcga

SEQ ID NO: 198967 - DNA, 36 bp, Artificial Sequence
  Synthetic oligonucleotide
gtaagggtgacggtaaggagggggtgtcagaaagga

SEQ ID NO: 198968 - DNA, 37 bp, Artificial Sequence
  Synthetic oligonucleotide
aggggaggaaccggaggcgactaagaacgagggagga

SEQ ID NO: 198969 - DNA, 35 bp, Artificial Sequence
  Synthetic oligonucleotide
gagaaggggcattgggctcggggcggtacgtagga

SEQ ID NO: 198970 - DNA, 36 bp, Artificial Sequence
  Synthetic oligonucleotide
gtaagagtgggacgggaatcgggggcagttacggga

SEQ ID NO: 198971 - DNA, 36 bp, Artificial Sequence
  Synthetic oligonucleotide
gatcgacggaagggaaaatgagatggataggcggga

SEQ ID NO: 198972 - DNA, 37 bp, Artificial Sequence
  Synthetic oligonucleotide
gtacgaggtgcgggtagtcactgagggagggatggga

SEQ ID NO: 198973 - DNA, 37 bp, Artificial Sequence
  Synthetic oligonucleotide
tacgccacccgcaaacggcaatcccccgtcctctgga

SEQ ID NO: 198974 - DNA, 38 bp, Artificial Sequence
  Synthetic oligonucleotide
gccaccccgcctcatactattcatacggcattgcatga

SEQ ID NO: 198975 - DNA, 37 bp, Artificial Sequence
  Synthetic oligonucleotide
gaagagaggatgggaatcaaacaaaggaggacgatga

SEQ ID NO: 198976 - DNA, 38 bp, Artificial Sequence
  Synthetic oligonucleotide
tagcgacggcgaggaatatggggcgggggctgagctga

SEQ ID NO: 198977 - DNA, 38 bp, Artificial Sequence
  Synthetic oligonucleotide
aactctcgccgccatgtatggagcgccactccctctga

SEQ ID NO: 198978 - DNA, 37 bp, Artificial Sequence
  Synthetic oligonucleotide
acgagcgaacccccctgcctctactcaacggttctga

SEQ ID NO: 198979 - DNA, 38 bp, Artificial Sequence
  Synthetic oligonucleotide
gtcgaagcacgtagagggacaaaaggatcgagcagtga

SEQ ID NO: 198980 - DNA, 38 bp, Artificial Sequence
  Synthetic oligonucleotide
accactgcagctgagcctacactttcgcccatccgtga

SEQ ID NO: 198981 - DNA, 38 bp, Artificial Sequence
  Synthetic oligonucleotide
gctacctcatacgtccacccatcttgagtccctcgtga

SEQ ID NO: 198982 - DNA, 38 bp, Artificial Sequence
  Synthetic oligonucleotide
tgagacaggagggatagatgacacggcagaaacggtga

SEQ ID NO: 198983 - DNA, 37 bp, Artificial Sequence
  Synthetic oligonucleotide
ggacgggggagacgcgatggggactaggaaagggtga

SEQ ID NO: 198984 - DNA, 37 bp, Artificial Sequence
  Synthetic oligonucleotide
gttccatccgccaatcgctccagttctccgagggtga

SEQ ID NO: 198985 - DNA, 37 bp, Artificial Sequence
  Synthetic oligonucleotide
tcgtgcccaggtctttttgccgttacctcatccttga

SEQ ID NO: 198986 - DNA, 38 bp, Artificial Sequence
  Synthetic oligonucleotide
tctgatcgccccatccttgtgctcgttagtcttcttga

SEQ ID NO: 198987 - DNA, 38 bp, Artificial Sequence
  Synthetic oligonucleotide
aacacgcgctctgcctgcgaaccctagaacctctttga

SEQ ID NO: 198988 - DNA, 36 bp, Artificial Sequence
  Synthetic oligonucleotide
acatgccgcctccctcctcatgttttgcaagcccta

SEQ ID NO: 198989 - DNA, 35 bp, Artificial Sequence
  Synthetic oligonucleotide
aaactgcgaggtcgtgggatatgggtggggaagta

SEQ ID NO: 198990 - DNA, 36 bp, Artificial Sequence
  Synthetic oligonucleotide
gttagccccgcctccctgatttggagcctgcacgta

SEQ ID NO: 198991 - DNA, 35 bp, Artificial Sequence
  Synthetic oligonucleotide
tacacctgccccatcgtgacacctgtcagccatta

SEQ ID NO: 198992 - DNA, 36 bp, Artificial Sequence
  Synthetic oligonucleotide
gccctctgcatcaaggtctctggcccaccactttta

SEQ ID NO: 198993 - DNA, 35 bp, Artificial Sequence
  Synthetic oligonucleotide
tgcaccgacgccattctcgttgggatgttctccac

SEQ ID NO: 198994 - DNA, 35 bp, Artificial Sequence
  Synthetic oligonucleotide
ggagcacagtctcacgtagtaacaccctctatcac

SEQ ID NO: 198995 - DNA, 34 bp, Artificial Sequence
  Synthetic oligonucleotide
gcaacccaagcgggtttttagccctcctcttcac

SEQ ID NO: 198996 - DNA, 35 bp, Artificial Sequence
  Synthetic oligonucleotide
gccacctctgttttgctcgatacgagcacacttac

SEQ ID NO: 198997 - DNA, 35 bp, Artificial Sequence
  Synthetic oligonucleotide
ggggagggatgaagggggggatattcaggggcacc

SEQ ID NO: 198998 - DNA, 35 bp, Artificial Sequence
  Synthetic oligonucleotide
acacaccgccggccggttttacccccactttgacc

SEQ ID NO: 198999 - DNA, 35 bp, Artificial Sequence
  Synthetic oligonucleotide
tgcccatccgtagcgatatcggtctgacctctacc

SEQ ID NO: 199000 - DNA, 35 bp, Artificial Sequence
  Synthetic oligonucleotide
gaccgaccagcccttcgttcccagttatagttacc

SEQ ID NO: 199001 - DNA, 36 bp, Artificial Sequence
  Synthetic oligonucleotide
atcgacctcgcctccattcgtctccttccacgtgcc

SEQ ID NO: 199002 - DNA, 35 bp, Artificial Sequence
  Synthetic oligonucleotide
agaccaacgccgagcctatcatcgtcacaccctcc

SEQ ID NO: 199003 - DNA, 35 bp, Artificial Sequence
  Synthetic oligonucleotide
gcacagtcttaggcgcccctccctctcggcatggc

SEQ ID NO: 199004 - DNA, 35 bp, Artificial Sequence
  Synthetic oligonucleotide
gttgcacgatcacctgcttcctccgtataccgctc

SEQ ID NO: 199005 - DNA, 35 bp, Artificial Sequence
  Synthetic oligonucleotide
acacaccatgtgtcataatcactgtgcccgctctc

SEQ ID NO: 199006 - DNA, 35 bp, Artificial Sequence
  Synthetic oligonucleotide
aacaaccgtctagctcgctcgttccacggtacttc

SEQ ID NO: 199007 - DNA, 35 bp, Artificial Sequence
  Synthetic oligonucleotide
tgcggtaccccggtagttctctatcaacacccttc

SEQ ID NO: 199008 - DNA, 35 bp, Artificial Sequence
  Synthetic oligonucleotide
gcacccgccttggcatagcacatcctccctccttc

SEQ ID NO: 199009 - DNA, 35 bp, Artificial Sequence
  Synthetic oligonucleotide
gaaccaccgttgactcatctaaccctagggtcttc

SEQ ID NO: 199010 - DNA, 35 bp, Artificial Sequence
  Synthetic oligonucleotide
tgcaccacctgcctgacttcgagtgctccttgttc

SEQ ID NO: 199011 - DNA, 35 bp, Artificial Sequence
  Synthetic oligonucleotide
tcatcactgtttccctcctcgtcactcagctagcg

SEQ ID NO: 199012 - DNA, 35 bp, Artificial Sequence
  Synthetic oligonucleotide
gagtgggtggagggtaggaagcgatcggatatagg

SEQ ID NO: 199013 - DNA, 35 bp, Artificial Sequence
  Synthetic oligonucleotide
tacggaggaaaatgacgatcggggcgaaggggggg

SEQ ID NO: 199014 - DNA, 35 bp, Artificial Sequence
  Synthetic oligonucleotide
acgacgctccctcctacctctctctagagacctgg

SEQ ID NO: 199015 - DNA, 35 bp, Artificial Sequence
  Synthetic oligonucleotide
tttcatccgttccagtttcatacttcctctccatg

SEQ ID NO: 199016 - DNA, 35 bp, Artificial Sequence
  Synthetic oligonucleotide
tgttccatccgtgccgtatttccctagttcctctg

SEQ ID NO: 199017 - DNA, 35 bp, Artificial Sequence
  Synthetic oligonucleotide
tgtctccgacaggctgccctgagcctccacccgtg

SEQ ID NO: 199018 - DNA, 35 bp, Artificial Sequence
  Synthetic oligonucleotide
ttgggggtggaggtgagaaaggtcggtaggaggtg

SEQ ID NO: 199019 - DNA, 35 bp, Artificial Sequence
  Synthetic oligonucleotide
gcaaaccgcattggcgcagttctagtccccccttg

SEQ ID NO: 199020 - DNA, 35 bp, Artificial Sequence
  Synthetic oligonucleotide
aacgcaggggtgggaaggcgaagaggaagtgtttg

SEQ ID NO: 199021 - DNA, 35 bp, Artificial Sequence
  Synthetic oligonucleotide
ggggccgacctttgcctgatgccgttgctcttaat

SEQ ID NO: 199022 - DNA, 35 bp, Artificial Sequence
  Synthetic oligonucleotide
tcatacccgcatcctaacatcgcgccatcaccgat

SEQ ID NO: 199023 - DNA, 35 bp, Artificial Sequence
  Synthetic oligonucleotide
tcacgactagaggggcgggaggagggatgttggat

SEQ ID NO: 199024 - DNA, 35 bp, Artificial Sequence
  Synthetic oligonucleotide
gtgatgattcgaacgctgcgtacgttgcacctcct

SEQ ID NO: 199025 - DNA, 35 bp, Artificial Sequence
  Synthetic oligonucleotide
gaccatctcggcactgttttatacagtttatctct

SEQ ID NO: 199026 - DNA, 35 bp, Artificial Sequence
  Synthetic oligonucleotide
actcccgaagcccctgcctgtctcattacgtttct

SEQ ID NO: 199027 - DNA, 35 bp, Artificial Sequence
  Synthetic oligonucleotide
gcatgcctgggctcgttcatagtcctttctttatt

SEQ ID NO: 199028 - DNA, 35 bp, Artificial Sequence
  Synthetic oligonucleotide
agtcgggagggctgggtaagacagagggttttatt

SEQ ID NO: 199029 - DNA, 35 bp, Artificial Sequence
  Synthetic oligonucleotide
gcccacctgcgacggtctcccccgacgactcactt

SEQ ID NO: 199030 - DNA, 35 bp, Artificial Sequence
  Synthetic oligonucleotide
acaactccgcgcccacaacggtacgtaaaatcttt

SEQ ID NO: 199031 - DNA, 35 bp, Artificial Sequence
  Synthetic oligonucleotide
gccaactgggcgaaaggggggggaacgggcggaaa

SEQ ID NO: 199032 - DNA, 36 bp, Artificial Sequence
  Synthetic oligonucleotide
aatgcgggcgtagggaggggagatgagagaggtaaa

SEQ ID NO: 199033 - DNA, 36 bp, Artificial Sequence
  Synthetic oligonucleotide
gaccccgttatgtgttatcccagcgtcccgtgccaa

SEQ ID NO: 199034 - DNA, 36 bp, Artificial Sequence
  Synthetic oligonucleotide
tgatggggagggggagagctttagaaaggcggagaa

SEQ ID NO: 199035 - DNA, 35 bp, Artificial Sequence
  Synthetic oligonucleotide
gcatcccgttgcaataccatccgccataccatgaa

SEQ ID NO: 199036 - DNA, 35 bp, Artificial Sequence
  Synthetic oligonucleotide
tatcgcccgactgcaactctttatcgatccactaa

SEQ ID NO: 199037 - DNA, 35 bp, Artificial Sequence
  Synthetic oligonucleotide
gacctcctctaccgtgttcaagccatggtgcttaa

SEQ ID NO: 199038 - DNA, 35 bp, Artificial Sequence
  Synthetic oligonucleotide
tagcgaagcacccatgtacgtcgccccgctcttaa

SEQ ID NO: 199039 - DNA, 34 bp, Artificial Sequence
  Synthetic oligonucleotide
tcacaactgctacagggcccttcacacttcttaa

SEQ ID NO: 199040 - DNA, 36 bp, Artificial Sequence
  Synthetic oligonucleotide
acgatcgtagctggggggggtacgggtgagaagaca

SEQ ID NO: 199041 - DNA, 36 bp, Artificial Sequence
  Synthetic oligonucleotide
attcacacgaggggacgaagggagcagagagagaca

SEQ ID NO: 199042 - DNA, 36 bp, Artificial Sequence
  Synthetic oligonucleotide
tgcgtcaacagccgcccgtatttcgtcatcaaacca

SEQ ID NO: 199043 - DNA, 35 bp, Artificial Sequence
  Synthetic oligonucleotide
accccgcgtggaccgagtgtctcaatgtcccccca

SEQ ID NO: 199044 - DNA, 36 bp, Artificial Sequence
  Synthetic oligonucleotide
aactgcctcccgactcgagtaccttatcagtcatca

SEQ ID NO: 199045 - DNA, 35 bp, Artificial Sequence
  Synthetic oligonucleotide
taccacgcgcatccctttattcctgtatttcatca

SEQ ID NO: 199046 - DNA, 37 bp, Artificial Sequence
  Synthetic oligonucleotide
acgcctccactgtcctctattgccgtcgtccacaaga

SEQ ID NO: 199047 - DNA, 37 bp, Artificial Sequence
  Synthetic oligonucleotide
gtgggtggggggaaggcgttgtagatcgagtcagaga

SEQ ID NO: 199048 - DNA, 37 bp, Artificial Sequence
  Synthetic oligonucleotide
gaaagggaccagacaggagaggagagatctgggacga

SEQ ID NO: 199049 - DNA, 37 bp, Artificial Sequence
  Synthetic oligonucleotide
gcttagccgtccctgttatcccgcctgaaatccccga

SEQ ID NO: 199050 - DNA, 35 bp, Artificial Sequence
  Synthetic oligonucleotide
atcccgcacatccgttagttctctattcatcccga

SEQ ID NO: 199051 - DNA, 37 bp, Artificial Sequence
  Synthetic oligonucleotide
tgtccgccacccgtgtctaaatcgcgccatactccga

SEQ ID NO: 199052 - DNA, 35 bp, Artificial Sequence
  Synthetic oligonucleotide
tcccgcctctagcagatgcgttcctccaccatcga

SEQ ID NO: 199053 - DNA, 36 bp, Artificial Sequence
  Synthetic oligonucleotide
atgccatcagactgtatttccgttcaaccctctcga

SEQ ID NO: 199054 - DNA, 36 bp, Artificial Sequence
  Synthetic oligonucleotide
gaagggacggtataggaaatggagtggagtaaagga

SEQ ID NO: 199055 - DNA, 36 bp, Artificial Sequence
  Synthetic oligonucleotide
tagaagcagggaataacacggggaactggagaagga

SEQ ID NO: 199056 - DNA, 37 bp, Artificial Sequence
  Synthetic oligonucleotide
ggggggaagtaggtggggaacttgtgcagtcaacgga

SEQ ID NO: 199057 - DNA, 37 bp, Artificial Sequence
  Synthetic oligonucleotide
aaccaaggaaggggagggatgtgcggtgggcgcggga

SEQ ID NO: 199058 - DNA, 37 bp, Artificial Sequence
  Synthetic oligonucleotide
gctcacctcggtcttatcccccacatcagtttactga

SEQ ID NO: 199059 - DNA, 37 bp, Artificial Sequence
  Synthetic oligonucleotide
ttgatccacgacgtaatctcattcctgtccttcctga

SEQ ID NO: 199060 - DNA, 38 bp, Artificial Sequence
  Synthetic oligonucleotide
tttgtccaccctgcgtcccgtctagatcccgcccgtga

SEQ ID NO: 199061 - DNA, 36 bp, Artificial Sequence
  Synthetic oligonucleotide
acatgtcatcgctacctgccctcgacgcctccgtga

SEQ ID NO: 199062 - DNA, 38 bp, Artificial Sequence
  Synthetic oligonucleotide
tagttcaggccctatctgtaatcgcttatccctcgtga

SEQ ID NO: 199063 - DNA, 38 bp, Artificial Sequence
  Synthetic oligonucleotide
tccgaaccgttgatagtaccggcctccccctttattga

SEQ ID NO: 199064 - DNA, 37 bp, Artificial Sequence
  Synthetic oligonucleotide
tgttgccgtcgctgggttccgccccctcgcatcttga

SEQ ID NO: 199065 - DNA, 38 bp, Artificial Sequence
  Synthetic oligonucleotide
tgatcaccgcacatcggctttttgacacctctagttga

SEQ ID NO: 199066 - DNA, 35 bp, Artificial Sequence
  Synthetic oligonucleotide
gtccccatcattcgcttaaccagccacgttatata

SEQ ID NO: 199067 - DNA, 35 bp, Artificial Sequence
  Synthetic oligonucleotide
tcagaccttcccctcgtgctgtgcggggcactata

SEQ ID NO: 199068 - DNA, 36 bp, Artificial Sequence
  Synthetic oligonucleotide
gtggatcacgccggctgaccatcctcctgtgcccta

SEQ ID NO: 199069 - DNA, 34 bp, Artificial Sequence
  Synthetic oligonucleotide
gtcccatctaggccccttctccgtcatgagtgta

SEQ ID NO: 199070 - DNA, 36 bp, Artificial Sequence
  Synthetic oligonucleotide
acccccccgctgtgtttctactatcaacagcactta

SEQ ID NO: 199071 - DNA, 35 bp, Artificial Sequence
  Synthetic oligonucleotide
agcccccgccttgtgtcacgcaccaccctcactta

SEQ ID NO: 199072 - DNA, 35 bp, Artificial Sequence
  Synthetic oligonucleotide
ttgacacagtccagtccacttatcgctacttctta

SEQ ID NO: 199073 - DNA, 36 bp, Artificial Sequence
  Synthetic oligonucleotide
gaaacgacggaaacgggatgggcgggtggaaagtta

SEQ ID NO: 199074 - DNA, 35 bp, Artificial Sequence
  Synthetic oligonucleotide
acaatgagggggggggggggctggataggtggaac

SEQ ID NO: 199075 - DNA, 35 bp, Artificial Sequence
  Synthetic oligonucleotide
gtccgcccctcacctgtagcaatcatcgttatcac

SEQ ID NO: 199076 - DNA, 35 bp, Artificial Sequence
  Synthetic oligonucleotide
accgcccgactcccacctgtctatggttctcatac

SEQ ID NO: 199077 - DNA, 35 bp, Artificial Sequence
  Synthetic oligonucleotide
gtcacgcaatcgctttgaacctgtgattttcaccc

SEQ ID NO: 199078 - DNA, 35 bp, Artificial Sequence
  Synthetic oligonucleotide
ttagcagagcttgtccgtcgattttgtgctccccc

SEQ ID NO: 199079 - DNA, 35 bp, Artificial Sequence
  Synthetic oligonucleotide
agacccacatgcattatgcctattttggacgcccc

SEQ ID NO: 199080 - DNA, 35 bp, Artificial Sequence
  Synthetic oligonucleotide
aacaacgcactcatggtctgctccgctctcttccc

SEQ ID NO: 199081 - DNA, 35 bp, Artificial Sequence
  Synthetic oligonucleotide
tgtgtcccccgaactgttttctcgcccgtaccgcc

SEQ ID NO: 199082 - DNA, 35 bp, Artificial Sequence
  Synthetic oligonucleotide
gctccatcttcgtcagtacatgtacccctcgcgcc

SEQ ID NO: 199083 - DNA, 35 bp, Artificial Sequence
  Synthetic oligonucleotide
tcgcactcccagcacccgttttatttgccccggcc

SEQ ID NO: 199084 - DNA, 35 bp, Artificial Sequence
  Synthetic oligonucleotide
gcaaccgagtcagcagcccactaccccgtacatcc

SEQ ID NO: 199085 - DNA, 35 bp, Artificial Sequence
  Synthetic oligonucleotide
tatgcccatccgcacgtttgccctactctgaccgc

SEQ ID NO: 199086 - DNA, 35 bp, Artificial Sequence
  Synthetic oligonucleotide
gacgagcgctagaatcttctatttttgcaccccgc

SEQ ID NO: 199087 - DNA, 35 bp, Artificial Sequence
  Synthetic oligonucleotide
gaaaacaaagggagggggtaaaaagcaggcgtcgc

SEQ ID NO: 199088 - DNA, 35 bp, Artificial Sequence
  Synthetic oligonucleotide
tgaccccctccgtcatgctctcatatccagcctgc

SEQ ID NO: 199089 - DNA, 35 bp, Artificial Sequence
  Synthetic oligonucleotide
tcacgcttctgtgtcgtttgttacccggcgctctc

SEQ ID NO: 199090 - DNA, 35 bp, Artificial Sequence
  Synthetic oligonucleotide
tcacacctatcacctatgtcgtttggctcacggtc

SEQ ID NO: 199091 - DNA, 35 bp, Artificial Sequence
  Synthetic oligonucleotide
tgcatgcctcagcttctctctcccggccttctgtc

SEQ ID NO: 199092 - DNA, 35 bp, Artificial Sequence
  Synthetic oligonucleotide
tgagcccacacatcctatcctgttctcaccgtgtc

SEQ ID NO: 199093 - DNA, 35 bp, Artificial Sequence
  Synthetic oligonucleotide
gtgggtcaagttatatgccggcgcactccccattc

SEQ ID NO: 199094 - DNA, 35 bp, Artificial Sequence
  Synthetic oligonucleotide
gactcagctcatcacgttcttgttgcacctctaag

SEQ ID NO: 199095 - DNA, 35 bp, Artificial Sequence
  Synthetic oligonucleotide
atgcggagtgcccgccccccttgagccctgaccag

SEQ ID NO: 199096 - DNA, 35 bp, Artificial Sequence
  Synthetic oligonucleotide
gtaggggggcacaggagagtcattagaaagtgcag

SEQ ID NO: 199097 - DNA, 35 bp, Artificial Sequence
  Synthetic oligonucleotide
tggaaagggggggagtggatttgggagtttaatag

SEQ ID NO: 199098 - DNA, 35 bp, Artificial Sequence
  Synthetic oligonucleotide
aatgccggctcactctttgatattgctcaccccgg

SEQ ID NO: 199099 - DNA, 35 bp, Artificial Sequence
  Synthetic oligonucleotide
gcgcaccctctttcggtacgacctggtatgccctg

SEQ ID NO: 199100 - DNA, 35 bp, Artificial Sequence
  Synthetic oligonucleotide
ttccacccgtcgcgcgaattcgcctcgtcatcctg

SEQ ID NO: 199101 - DNA, 35 bp, Artificial Sequence
  Synthetic oligonucleotide
acaggaggatgacggaaggaggccagaaatgggtg

SEQ ID NO: 199102 - DNA, 35 bp, Artificial Sequence
  Synthetic oligonucleotide
ttattagcggagggcgattagcggagggaaggcat

SEQ ID NO: 199103 - DNA, 35 bp, Artificial Sequence
  Synthetic oligonucleotide
ataggtggtcgggggaaggtaagggagtgggctat

SEQ ID NO: 199104 - DNA, 35 bp, Artificial Sequence
  Synthetic oligonucleotide
gacaaatcctcgttgctttattccggccttttact

SEQ ID NO: 199105 - DNA, 35 bp, Artificial Sequence
  Synthetic oligonucleotide
accagcgagctccataccgcacgcgcactgcccct

SEQ ID NO: 199106 - DNA, 35 bp, Artificial Sequence
  Synthetic oligonucleotide
tcgcaggtcggctgagtacttaccgccgttcccct

SEQ ID NO: 199107 - DNA, 35 bp, Artificial Sequence
  Synthetic oligonucleotide
gcacacaaggctgttaatccatcgtttttcctcct

SEQ ID NO: 199108 - DNA, 35 bp, Artificial Sequence
  Synthetic oligonucleotide
gactagctgcctgcgagcgctttctatcctctcct

SEQ ID NO: 199109 - DNA, 35 bp, Artificial Sequence
  Synthetic oligonucleotide
atggacgcctcgcatgcgctgcccccacctttgct

SEQ ID NO: 199110 - DNA, 35 bp, Artificial Sequence
  Synthetic oligonucleotide
tgtacatcatacgtgtcctgtcctgttaattctct

SEQ ID NO: 199111 - DNA, 35 bp, Artificial Sequence
  Synthetic oligonucleotide
ttagcctcgccctgaattctaccaatatactgtct

SEQ ID NO: 199112 - DNA, 35 bp, Artificial Sequence
  Synthetic oligonucleotide
gattcccccgcttaactggctttgctccgagacgt

SEQ ID NO: 199113 - DNA, 35 bp, Artificial Sequence
  Synthetic oligonucleotide
atgagggtgaaggcaggagtaggagcgagaggggt

SEQ ID NO: 199114 - DNA, 35 bp, Artificial Sequence
  Synthetic oligonucleotide
accatccgcacattctttcagcctatagaacttgt

SEQ ID NO: 199115 - DNA, 35 bp, Artificial Sequence
  Synthetic oligonucleotide
actcaccctccgttcgccccaattagacgaccgtt

SEQ ID NO: 199116 - DNA, 35 bp, Artificial Sequence
  Synthetic oligonucleotide
tgcaccagatgtctaacacgcggtatctccctttt

SEQ ID NO: 199117 - DNA, 36 bp, Artificial Sequence
  Synthetic oligonucleotide
acgaaacaatgggagggataacgggcgggagcgaaa

SEQ ID NO: 199118 - DNA, 35 bp, Artificial Sequence
  Synthetic oligonucleotide
tgtgcaaccttatatccgtaaatccgccgcccgaa

SEQ ID NO: 199119 - DNA, 36 bp, Artificial Sequence
  Synthetic oligonucleotide
ttggcacaccacctctgcacgtccaccaccacggaa

SEQ ID NO: 199120 - DNA, 36 bp, Artificial Sequence
  Synthetic oligonucleotide
tgccgtagctggcctccgttttcgccattttgcaca

SEQ ID NO: 199121 - DNA, 35 bp, Artificial Sequence
  Synthetic oligonucleotide
gtgttggggagggtactgggcgaacgggacataca

SEQ ID NO: 199122 - DNA, 36 bp, Artificial Sequence
  Synthetic oligonucleotide
gcccgcttgccctccgatgccactgaccccgtacca

SEQ ID NO: 199123 - DNA, 36 bp, Artificial Sequence
  Synthetic oligonucleotide
tcatccaccgcatactgtcctagtcttatcattcca

SEQ ID NO: 199124 - DNA, 36 bp, Artificial Sequence
  Synthetic oligonucleotide
ttgcgatagccggttcgctgttcttcgttccttcca

SEQ ID NO: 199125 - DNA, 36 bp, Artificial Sequence
  Synthetic oligonucleotide
aacaagggggaggacattgtaataaacgggcgggca

SEQ ID NO: 199126 - DNA, 35 bp, Artificial Sequence
  Synthetic oligonucleotide
gaggaacgggcaaggcaatgggcgtggggggggca

SEQ ID NO: 199127 - DNA, 35 bp, Artificial Sequence
  Synthetic oligonucleotide
gcgccggccgtcgcttcgtatcgccccgccaatca

SEQ ID NO: 199128 - DNA, 35 bp, Artificial Sequence
  Synthetic oligonucleotide
gtgggggtggtcgggtgtagtcgttcggggactca

SEQ ID NO: 199129 - DNA, 36 bp, Artificial Sequence
  Synthetic oligonucleotide
ggatgtctccgctcgtttaatcactgcccttcgtca

SEQ ID NO: 199130 - DNA, 35 bp, Artificial Sequence
  Synthetic oligonucleotide
tcaaggggcagacgtataggggcgggaggttcaga

SEQ ID NO: 199131 - DNA, 35 bp, Artificial Sequence
  Synthetic oligonucleotide
agcacgccctgccctgatagtaatgctccccacga

SEQ ID NO: 199132 - DNA, 36 bp, Artificial Sequence
  Synthetic oligonucleotide
tgactcgctcggcccccaattgctgcgcttccacga

SEQ ID NO: 199133 - DNA, 37 bp, Artificial Sequence
  Synthetic oligonucleotide
gcgtacggccacctgtcaactacactcctcctcacga

SEQ ID NO: 199134 - DNA, 37 bp, Artificial Sequence
  Synthetic oligonucleotide
gacaactcgttcgcgcttattcggtcccccctgacga

SEQ ID NO: 199135 - DNA, 37 bp, Artificial Sequence
  Synthetic oligonucleotide
tgcatcgttctgtttcttccgccgctgtgctacccga

SEQ ID NO: 199136 - DNA, 37 bp, Artificial Sequence
  Synthetic oligonucleotide
tccacatgaccgctgctttcttattaactcgttccga

SEQ ID NO: 199137 - DNA, 37 bp, Artificial Sequence
  Synthetic oligonucleotide
agagggacgcgtaggggcggagaggacggaagagcga

SEQ ID NO: 199138 - DNA, 37 bp, Artificial Sequence
  Synthetic oligonucleotide
gctcacgtcaaccggctcagctctccgcctcaatcga

SEQ ID NO: 199139 - DNA, 37 bp, Artificial Sequence
  Synthetic oligonucleotide
tatgggcgaagcggggtggggatctggcggtgaagga

SEQ ID NO: 199140 - DNA, 37 bp, Artificial Sequence
  Synthetic oligonucleotide
tacgcgagagagcagggagggggagtgcaccatagga

SEQ ID NO: 199141 - DNA, 37 bp, Artificial Sequence
  Synthetic oligonucleotide
aacattgacgggaggagtggagggcgaccggcgcgga

SEQ ID NO: 199142 - DNA, 35 bp, Artificial Sequence
  Synthetic oligonucleotide
ggagcacggctttaagggaaaagggggagaaggga

SEQ ID NO: 199143 - DNA, 37 bp, Artificial Sequence
  Synthetic oligonucleotide
tcgccggtcgggatggatagatcgtgggcgggaggga

SEQ ID NO: 199144 - DNA, 37 bp, Artificial Sequence
  Synthetic oligonucleotide
accgggaggaagaaactggaggagtcgagaccgggga

SEQ ID NO: 199145 - DNA, 35 bp, Artificial Sequence
  Synthetic oligonucleotide
acgagaggggggctctatagtgggtgggaaatgga

SEQ ID NO: 199146 - DNA, 37 bp, Artificial Sequence
  Synthetic oligonucleotide
tagtacgggatgggggggaggagtagtcgccattgga

SEQ ID NO: 199147 - DNA, 38 bp, Artificial Sequence
  Synthetic oligonucleotide
tcatctagcccccctcggtactcacaacggtctcatga

SEQ ID NO: 199148 - DNA, 37 bp, Artificial Sequence
  Synthetic oligonucleotide
gacgtcgccgcctactcataacgtagtaacaccctga

SEQ ID NO: 199149 - DNA, 36 bp, Artificial Sequence
  Synthetic oligonucleotide
gggagaagcggcgggggggaggggaggcaggtctga

SEQ ID NO: 199150 - DNA, 38 bp, Artificial Sequence
  Synthetic oligonucleotide
tatgggaggtaagcgggggggtaaaagacgtcgagtga

SEQ ID NO: 199151 - DNA, 36 bp, Artificial Sequence
  Synthetic oligonucleotide
tgcaacagatcccctgtgttcccccgtgccaatcta

SEQ ID NO: 199152 - DNA, 36 bp, Artificial Sequence
  Synthetic oligonucleotide
ggatgggcgcgaaaagcggggagggagcatcgcgta

SEQ ID NO: 199153 - DNA, 35 bp, Artificial Sequence
  Synthetic oligonucleotide
gtaagcgtaagggaggggaagaagggaggctatta

SEQ ID NO: 199154 - DNA, 35 bp, Artificial Sequence
  Synthetic oligonucleotide
tcactacgccggactctcctgctctgtatccctta

SEQ ID NO: 199155 - DNA, 35 bp, Artificial Sequence
  Synthetic oligonucleotide
tccctccgccccatattggtattccagcgctacac

SEQ ID NO: 199156 - DNA, 35 bp, Artificial Sequence
  Synthetic oligonucleotide
gctcgcccgtccttagtacgcacctgtttcaccac

SEQ ID NO: 199157 - DNA, 35 bp, Artificial Sequence
  Synthetic oligonucleotide
ttagcccctctgatctctagtcccgcctgtaccac

SEQ ID NO: 199158 - DNA, 35 bp, Artificial Sequence
  Synthetic oligonucleotide
gtgaccgcgtgtcttgcgccgttatatcaacccac

SEQ ID NO: 199159 - DNA, 35 bp, Artificial Sequence
  Synthetic oligonucleotide
tccccgtggcacccatgttcatctacctcctccac

SEQ ID NO: 199160 - DNA, 35 bp, Artificial Sequence
  Synthetic oligonucleotide
tcatgatgtgcacgccacgtcctcaacacctagac

SEQ ID NO: 199161 - DNA, 34 bp, Artificial Sequence
  Synthetic oligonucleotide
tcaggagggagggtggggacatgggttgatttac

SEQ ID NO: 199162 - DNA, 35 bp, Artificial Sequence
  Synthetic oligonucleotide
aaatgcgtcccccatcgcacgagtagcccttcacc

SEQ ID NO: 199163 - DNA, 35 bp, Artificial Sequence
  Synthetic oligonucleotide
tcatgtcgcgccggctctctctgcgttcacttacc

SEQ ID NO: 199164 - DNA, 35 bp, Artificial Sequence
  Synthetic oligonucleotide
gacctcacaagagactgtctctatgcctggccccc

SEQ ID NO: 199165 - DNA, 35 bp, Artificial Sequence
  Synthetic oligonucleotide
gtgagcacctcagcggtttctcccatctgttgccc

SEQ ID NO: 199166 - DNA, 35 bp, Artificial Sequence
  Synthetic oligonucleotide
gtgtacgtgcgtgtactggtccctttcgtgccgcc

SEQ ID NO: 199167 - DNA, 35 bp, Artificial Sequence
  Synthetic oligonucleotide
aaccgccattggtcattattacgcgcgccctggcc

SEQ ID NO: 199168 - DNA, 35 bp, Artificial Sequence
  Synthetic oligonucleotide
gacacgacgattatggcctccacttccaatctgcc

SEQ ID NO: 199169 - DNA, 35 bp, Artificial Sequence
  Synthetic oligonucleotide
gttgtcgccctcacctagagctaaaactggtctcc

SEQ ID NO: 199170 - DNA, 35 bp, Artificial Sequence
  Synthetic oligonucleotide
tacggaagtacgccctgctttgatccctcctgtcc

SEQ ID NO: 199171 - DNA, 35 bp, Artificial Sequence
  Synthetic oligonucleotide
tcatacctcgtggaacggtagtggaaccttattcc

SEQ ID NO: 199172 - DNA, 35 bp, Artificial Sequence
  Synthetic oligonucleotide
agcatcctcctccgttcctataggcgctaataagc

SEQ ID NO: 199173 - DNA, 34 bp, Artificial Sequence
  Synthetic oligonucleotide
aacatccgcacctatcatcgattactggcttggc

SEQ ID NO: 199174 - DNA, 35 bp, Artificial Sequence
  Synthetic oligonucleotide
acccctccgcatcctcgaaatgtcgcttgacatgc

SEQ ID NO: 199175 - DNA, 35 bp, Artificial Sequence
  Synthetic oligonucleotide
tcgttgccacagacccgttcttttcgccactcatc

SEQ ID NO: 199176 - DNA, 35 bp, Artificial Sequence
  Synthetic oligonucleotide
gcatgcgcaaatgtttttcgcttcttccgtgcctc

SEQ ID NO: 199177 - DNA, 35 bp, Artificial Sequence
  Synthetic oligonucleotide
ttcgtggggaaccctgctttagcgccctacttctc

SEQ ID NO: 199178 - DNA, 35 bp, Artificial Sequence
  Synthetic oligonucleotide
ggacatccgtccgaagcccacgcctcactgccgtc

SEQ ID NO: 199179 - DNA, 35 bp, Artificial Sequence
  Synthetic oligonucleotide
gagcctcgaggtcgatcttagtaatctgccccttc

SEQ ID NO: 199180 - DNA, 35 bp, Artificial Sequence
  Synthetic oligonucleotide
gcatgtacgaccccttgcgatttgcagagcccttc

SEQ ID NO: 199181 - DNA, 35 bp, Artificial Sequence
  Synthetic oligonucleotide
agtgcctctgtccgtacccgctttggcccttcttc

SEQ ID NO: 199182 - DNA, 35 bp, Artificial Sequence
  Synthetic oligonucleotide
tacggtcgccgtggtgctctactcctgcccatttc

SEQ ID NO: 199183 - DNA, 35 bp, Artificial Sequence
  Synthetic oligonucleotide
taagtgtaccgtcgctctaattgtcctcctccacg

SEQ ID NO: 199184 - DNA, 35 bp, Artificial Sequence
  Synthetic oligonucleotide
gacacttcctcctgcgctcactccgtactgctacg

SEQ ID NO: 199185 - DNA, 35 bp, Artificial Sequence
  Synthetic oligonucleotide
tccatccatcaatgtccagccctataatgatcccg

SEQ ID NO: 199186 - DNA, 34 bp, Artificial Sequence
  Synthetic oligonucleotide
atgccgggggggttcaaaggtcagtgaggatggg

SEQ ID NO: 199187 - DNA, 35 bp, Artificial Sequence
  Synthetic oligonucleotide
tccagactcccgcctcattctcgcctcttgccatg

SEQ ID NO: 199188 - DNA, 35 bp, Artificial Sequence
  Synthetic oligonucleotide
tcctccgcgcgctctgttccgaattgttccacttg

SEQ ID NO: 199189 - DNA, 35 bp, Artificial Sequence
  Synthetic oligonucleotide
gtcacgacacctgcctaccctttgtgtccagcttg

SEQ ID NO: 199190 - DNA, 35 bp, Artificial Sequence
  Synthetic oligonucleotide
gagcccttccacccgtcctcctgagacaggtcact

SEQ ID NO: 199191 - DNA, 35 bp, Artificial Sequence
  Synthetic oligonucleotide
tgcgcaatcgccagcttacataccgccgtacccct

SEQ ID NO: 199192 - DNA, 35 bp, Artificial Sequence
  Synthetic oligonucleotide
gagccaacctctatgtcgaaaccctcctagattct

SEQ ID NO: 199193 - DNA, 35 bp, Artificial Sequence
  Synthetic oligonucleotide
gccacccgcctcattggccaccgaccttctagagt

SEQ ID NO: 199194 - DNA, 35 bp, Artificial Sequence
  Synthetic oligonucleotide
atgtgcaaacctcaattcgtactaacacctctagt

SEQ ID NO: 199195 - DNA, 35 bp, Artificial Sequence
  Synthetic oligonucleotide
ttggtctcgcattcggccctgttctcgttttattt

SEQ ID NO: 199196 - DNA, 35 bp, Artificial Sequence
  Synthetic oligonucleotide
acgaccgcccccgcatttagtacctgttgcctttt

SEQ ID NO: 199197 - DNA, 36 bp, Artificial Sequence
  Synthetic oligonucleotide
tcctgcccggtccgccttcttgggccatcttacaaa

SEQ ID NO: 199198 - DNA, 36 bp, Artificial Sequence
  Synthetic oligonucleotide
gatggtggggagagaggtcacgagcagtggggcaaa

SEQ ID NO: 199199 - DNA, 36 bp, Artificial Sequence
  Synthetic oligonucleotide
tgcacgtcgatctccgcccgttcagctcttacgaaa

SEQ ID NO: 199200 - DNA, 36 bp, Artificial Sequence
  Synthetic oligonucleotide
tcatccgcacatgcacgtccttatcgctctttacaa

SEQ ID NO: 199201 - DNA, 36 bp, Artificial Sequence
  Synthetic oligonucleotide
gtgaagggggacggacaggggtagagcgcgtcgcaa

SEQ ID NO: 199202 - DNA, 35 bp, Artificial Sequence
  Synthetic oligonucleotide
tagaggtggggggggcacgcaagggaagtaggcaa

SEQ ID NO: 199203 - DNA, 35 bp, Artificial Sequence
  Synthetic oligonucleotide
tgtcattagccgtgtacatgcccctctccgttcaa

SEQ ID NO: 199204 - DNA, 36 bp, Artificial Sequence
  Synthetic oligonucleotide
atatcagggcagtgagacagggaagggggcatggaa

SEQ ID NO: 199205 - DNA, 35 bp, Artificial Sequence
  Synthetic oligonucleotide
tggtcacgccgttagcttatcacctgccttcacca

SEQ ID NO: 199206 - DNA, 35 bp, Artificial Sequence
  Synthetic oligonucleotide
taaacgtctccgcccgttccttctcgactcgccca

SEQ ID NO: 199207 - DNA, 36 bp, Artificial Sequence
  Synthetic oligonucleotide
gtttgccaggtctgatacaactccaccgcctccgca

SEQ ID NO: 199208 - DNA, 36 bp, Artificial Sequence
  Synthetic oligonucleotide
aaagagtgaatggtgggatgaaggcggagaggcgca

SEQ ID NO: 199209 - DNA, 37 bp, Artificial Sequence
  Synthetic oligonucleotide
ggtgagaacgaagaaagaaaggacaaacaggaagaga

SEQ ID NO: 199210 - DNA, 36 bp, Artificial Sequence
  Synthetic oligonucleotide
gaaggaatggggaggtatagtgaagacggggggaga

SEQ ID NO: 199211 - DNA, 37 bp, Artificial Sequence
  Synthetic oligonucleotide
gcactgccacctgtggttaattccacccccacgtaga

SEQ ID NO: 199212 - DNA, 37 bp, Artificial Sequence
  Synthetic oligonucleotide
gggaaagacaaaagataggaagggggccggacgtaga

SEQ ID NO: 199213 - DNA, 37 bp, Artificial Sequence
  Synthetic oligonucleotide
gcccaccctcacctgacactcatgacgatccggtaga

SEQ ID NO: 199214 - DNA, 34 bp, Artificial Sequence
  Synthetic oligonucleotide
agacgccgatcagcattttaactcccacctccga

SEQ ID NO: 199215 - DNA, 37 bp, Artificial Sequence
  Synthetic oligonucleotide
tggggcgccagccggtctcttatcatcacctcctcga

SEQ ID NO: 199216 - DNA, 37 bp, Artificial Sequence
  Synthetic oligonucleotide
gacagggggggagtgggacaggtacaggtgcgtagga

SEQ ID NO: 199217 - DNA, 37 bp, Artificial Sequence
  Synthetic oligonucleotide
tagccgaacaggcctagcatgcgacctcccttccgga

SEQ ID NO: 199218 - DNA, 35 bp, Artificial Sequence
  Synthetic oligonucleotide
gagggggcagtgccggggggcggaagtaaacggga

SEQ ID NO: 199219 - DNA, 37 bp, Artificial Sequence
  Synthetic oligonucleotide
acaccgcattactgaacttattgcctatccctgggga

SEQ ID NO: 199220 - DNA, 36 bp, Artificial Sequence
  Synthetic oligonucleotide
gtgagggtggaggagtgagctggggagacgcgatga

SEQ ID NO: 199221 - DNA, 38 bp, Artificial Sequence
  Synthetic oligonucleotide
gaatctgcgcatctgccccttgagcctccaccgtatga

SEQ ID NO: 199222 - DNA, 37 bp, Artificial Sequence
  Synthetic oligonucleotide
gtctgcccctgaggctgcggaaactgtcctctcctga

SEQ ID NO: 199223 - DNA, 37 bp, Artificial Sequence
  Synthetic oligonucleotide
tgaagctcattagtactaccctctcaccgcttgctga

SEQ ID NO: 199224 - DNA, 38 bp, Artificial Sequence
  Synthetic oligonucleotide
gccacaagctcgggagggaaagggattgggatgtctga

SEQ ID NO: 199225 - DNA, 36 bp, Artificial Sequence
  Synthetic oligonucleotide
gccatcacccgtgctcgttcatcaccagtttagtga

SEQ ID NO: 199226 - DNA, 38 bp, Artificial Sequence
  Synthetic oligonucleotide
tagtgcacagttgcctacctattcgtcttcacgcgtga

SEQ ID NO: 199227 - DNA, 38 bp, Artificial Sequence
  Synthetic oligonucleotide
atcgagcggccgatagagtgaggggcggaagggcgtga

SEQ ID NO: 199228 - DNA, 38 bp, Artificial Sequence
  Synthetic oligonucleotide
tgtccagaaggcctagtgtgtttcctcctgccccttga

SEQ ID NO: 199229 - DNA, 37 bp, Artificial Sequence
  Synthetic oligonucleotide
gcccacactacgcgtatgcggtttgtacctcccttga

SEQ ID NO: 199230 - DNA, 36 bp, Artificial Sequence
  Synthetic oligonucleotide
tcacccacctatccttgtatccctgtatggttaata

SEQ ID NO: 199231 - DNA, 36 bp, Artificial Sequence
  Synthetic oligonucleotide
tagccctcgatcgccctagccacgttctcttaacta

SEQ ID NO: 199232 - DNA, 35 bp, Artificial Sequence
  Synthetic oligonucleotide
ggacgggggggagggggtagataggaacgtggcta

SEQ ID NO: 199233 - DNA, 35 bp, Artificial Sequence
  Synthetic oligonucleotide
atcgctcccccatctgcataggtccacattcctta

SEQ ID NO: 199234 - DNA, 35 bp, Artificial Sequence
  Synthetic oligonucleotide
tgtacaacgctcctgtcgctattcaagtattccac

SEQ ID NO: 199235 - DNA, 35 bp, Artificial Sequence
  Synthetic oligonucleotide
ggaccgaccgccctgttcactagttatcagactac

SEQ ID NO: 199236 - DNA, 35 bp, Artificial Sequence
  Synthetic oligonucleotide
gtgcatcgacctcgtgctagctacccgtctcctac

SEQ ID NO: 199237 - DNA, 36 bp, Artificial Sequence
  Synthetic oligonucleotide
acaaatgcagccgtctgcgcatgtcttgcattttac

SEQ ID NO: 199238 - DNA, 35 bp, Artificial Sequence
  Synthetic oligonucleotide
atctccggcgtaccaactgtcctctggtcctatcc

SEQ ID NO: 199239 - DNA, 35 bp, Artificial Sequence
  Synthetic oligonucleotide
actgctacaactgttccggaccgttccttgcctcc

SEQ ID NO: 199240 - DNA, 35 bp, Artificial Sequence
  Synthetic oligonucleotide
tgtccactctcacacagttatgtggcttcccttcc

SEQ ID NO: 199241 - DNA, 35 bp, Artificial Sequence
  Synthetic oligonucleotide
acactcggtgatcatgtcgagtccccctcctttcc

SEQ ID NO: 199242 - DNA, 35 bp, Artificial Sequence
  Synthetic oligonucleotide
tgatactcgccattggtctcccaccagccgtttcc

SEQ ID NO: 199243 - DNA, 35 bp, Artificial Sequence
  Synthetic oligonucleotide
ggactcgccgtacgcttattctcctcaccagtagc

SEQ ID NO: 199244 - DNA, 35 bp, Artificial Sequence
  Synthetic oligonucleotide
acagtgcgcgcctctgcttccaccgcccttaacgc

SEQ ID NO: 199245 - DNA, 35 bp, Artificial Sequence
  Synthetic oligonucleotide
tacagtcagatggttcctgtgtcctcttcctacgc

SEQ ID NO: 199246 - DNA, 35 bp, Artificial Sequence
  Synthetic oligonucleotide
gaaacagtcgcggcggagagcggggaggagatggc

SEQ ID NO: 199247 - DNA, 35 bp, Artificial Sequence
  Synthetic oligonucleotide
atccgcttgctgcgcttcttgcacccacttcatgc

SEQ ID NO: 199248 - DNA, 35 bp, Artificial Sequence
  Synthetic oligonucleotide
agctcgcccgccgtaaagaccctccttgttccatc

SEQ ID NO: 199249 - DNA, 35 bp, Artificial Sequence
  Synthetic oligonucleotide
gaaacaaagagaggtgggaaaaagtgagagtcatc

SEQ ID NO: 199250 - DNA, 35 bp, Artificial Sequence
  Synthetic oligonucleotide
gtccacgttcataaacggtgttcgtcccccttatc

SEQ ID NO: 199251 - DNA, 35 bp, Artificial Sequence
  Synthetic oligonucleotide
tgcacacccgtcgatagacccgtttcccctccctc

SEQ ID NO: 199252 - DNA, 35 bp, Artificial Sequence
  Synthetic oligonucleotide
gtctagccctgcttacagatttcctggtcgtcctc

SEQ ID NO: 199253 - DNA, 35 bp, Artificial Sequence
  Synthetic oligonucleotide
tacagtcgatccgcccccctctgtttaagccgctc

SEQ ID NO: 199254 - DNA, 35 bp, Artificial Sequence
  Synthetic oligonucleotide
ttggcactcgctcccccattatatgtctccgtctc

SEQ ID NO: 199255 - DNA, 35 bp, Artificial Sequence
  Synthetic oligonucleotide
tgccaccgctcataggctaagtccgcaatcctgtc

SEQ ID NO: 199256 - DNA, 35 bp, Artificial Sequence
  Synthetic oligonucleotide
gacacgtccaagacgggggaaggaagaggagaacg

SEQ ID NO: 199257 - DNA, 35 bp, Artificial Sequence
  Synthetic oligonucleotide
tgagacagcgagggaggggacggcgcgggttcacg

SEQ ID NO: 199258 - DNA, 35 bp, Artificial Sequence
  Synthetic oligonucleotide
atcgcaaccgccaagactcgcaaactcttccaccg

SEQ ID NO: 199259 - DNA, 35 bp, Artificial Sequence
  Synthetic oligonucleotide
ggaggtggaagggggtaaagaggctggtggccccg

SEQ ID NO: 199260 - DNA, 35 bp, Artificial Sequence
  Synthetic oligonucleotide
agtcccacgacacgtcatatcaatacaccctctcg

SEQ ID NO: 199261 - DNA, 35 bp, Artificial Sequence
  Synthetic oligonucleotide
gggtggaggagaagaagtaaggtcagacgcgcatg

SEQ ID NO: 199262 - DNA, 35 bp, Artificial Sequence
  Synthetic oligonucleotide
ttgatgctcaatttcccttacccactcgcttcctg

SEQ ID NO: 199263 - DNA, 35 bp, Artificial Sequence
  Synthetic oligonucleotide
gcaatcgccgctctgagtctgaatctccctcgttg

SEQ ID NO: 199264 - DNA, 35 bp, Artificial Sequence
  Synthetic oligonucleotide
tcgtggcccactgtgcgtcgcttttatccaccaat

SEQ ID NO: 199265 - DNA, 35 bp, Artificial Sequence
  Synthetic oligonucleotide
aactcccctcgccgaattgagcgtttcttgcgaat

SEQ ID NO: 199266 - DNA, 35 bp, Artificial Sequence
  Synthetic oligonucleotide
gggtgcaccaacagattgggtggtgtgggggggat

SEQ ID NO: 199267 - DNA, 35 bp, Artificial Sequence
  Synthetic oligonucleotide
tcacctactctagtgagtcatactccctgtttact

SEQ ID NO: 199268 - DNA, 35 bp, Artificial Sequence
  Synthetic oligonucleotide
aagtgcacatcctggcctaccacgacaatcaccct

SEQ ID NO: 199269 - DNA, 35 bp, Artificial Sequence
  Synthetic oligonucleotide
taccatggcacctgtgttaacacattccacactct

SEQ ID NO: 199270 - DNA, 35 bp, Artificial Sequence
  Synthetic oligonucleotide
gactcctcgccgcatgaaaaaaaccgtccctaagt

SEQ ID NO: 199271 - DNA, 34 bp, Artificial Sequence
  Synthetic oligonucleotide
ttgtcacaccatggccgtttgcactttctatagt

SEQ ID NO: 199272 - DNA, 35 bp, Artificial Sequence
  Synthetic oligonucleotide
aacaactcgcgccagtttctgccgtgcccctagtt

SEQ ID NO: 199273 - DNA, 35 bp, Artificial Sequence
  Synthetic oligonucleotide
tcacgccgcctctgcataaaaaatactgttccgtt

SEQ ID NO: 199274 - DNA, 35 bp, Artificial Sequence
  Synthetic oligonucleotide
tccgtgtccctccccacagagaccgccttttcgtt

SEQ ID NO: 199275 - DNA, 35 bp, Artificial Sequence
  Synthetic oligonucleotide
accacagtgttccatcagtcaattgcctcgccttt

SEQ ID NO: 199276 - DNA, 35 bp, Artificial Sequence
  Synthetic oligonucleotide
gagccggagacaaggagatcatgggggggcaacaa

SEQ ID NO: 199277 - DNA, 35 bp, Artificial Sequence
  Synthetic oligonucleotide
gtgcaactccccccctgcataccgataggagccaa

SEQ ID NO: 199278 - DNA, 36 bp, Artificial Sequence
  Synthetic oligonucleotide
gcggagggttaaggggggaagctaacagggaacgaa

SEQ ID NO: 199279 - DNA, 35 bp, Artificial Sequence
  Synthetic oligonucleotide
gtgggagggtgggagcacagtggtgaacagaggaa

SEQ ID NO: 199280 - DNA, 35 bp, Artificial Sequence
  Synthetic oligonucleotide
taaggaggcgggggtgacgggttcggagcgcggaa

SEQ ID NO: 199281 - DNA, 36 bp, Artificial Sequence
  Synthetic oligonucleotide
ggtatccccaggctccactcgactcttcgctcaaca

SEQ ID NO: 199282 - DNA, 35 bp, Artificial Sequence
  Synthetic oligonucleotide
gcacatcacctctttgtcttggtgccatccctaca

SEQ ID NO: 199283 - DNA, 36 bp, Artificial Sequence
  Synthetic oligonucleotide
aacgcctgtcgcggggttatactcgccccccttaca

SEQ ID NO: 199284 - DNA, 35 bp, Artificial Sequence
  Synthetic oligonucleotide
tgtgccattcggtcgcctgtccacttacgtttaca

SEQ ID NO: 199285 - DNA, 36 bp, Artificial Sequence
  Synthetic oligonucleotide
taccgccaggtaacaaatgcttaagttccttcacca

SEQ ID NO: 199286 - DNA, 36 bp, Artificial Sequence
  Synthetic oligonucleotide
tgccctccatccactaagccatttgccccgttgcca

SEQ ID NO: 199287 - DNA, 36 bp, Artificial Sequence
  Synthetic oligonucleotide
tacacagtcactcctgcatcacagcgtgctttgcca

SEQ ID NO: 199288 - DNA, 35 bp, Artificial Sequence
  Synthetic oligonucleotide
gactggagaatggaggggaaggggatggactggca

SEQ ID NO: 199289 - DNA, 35 bp, Artificial Sequence
  Synthetic oligonucleotide
gaccccgccgctgagtctcatggctcgctccctca

SEQ ID NO: 199290 - DNA, 35 bp, Artificial Sequence
  Synthetic oligonucleotide
atacgggcggagggggaaagcgcgtcttgggttca

SEQ ID NO: 199291 - DNA, 37 bp, Artificial Sequence
  Synthetic oligonucleotide
acgagggggccaggggagggacgagatttactgcaga

SEQ ID NO: 199292 - DNA, 37 bp, Artificial Sequence
  Synthetic oligonucleotide
tgactgcccatctgctacgtcagtatagttccaccga

SEQ ID NO: 199293 - DNA, 36 bp, Artificial Sequence
  Synthetic oligonucleotide
tccctacaccttaccgatctgtgacttactgttcga

SEQ ID NO: 199294 - DNA, 37 bp, Artificial Sequence
  Synthetic oligonucleotide
atagagcgtagggggaggggcggtgtgagcggaagga

SEQ ID NO: 199295 - DNA, 36 bp, Artificial Sequence
  Synthetic oligonucleotide
gaagacggagggaagtgggggtctgtttcagtagga

SEQ ID NO: 199296 - DNA, 36 bp, Artificial Sequence
  Synthetic oligonucleotide
gccacaaccctcttctatctgtcggaccgacccgga

SEQ ID NO: 199297 - DNA, 35 bp, Artificial Sequence
  Synthetic oligonucleotide
tggggagagcctgggggcgaaggggacgggtcgga

SEQ ID NO: 199298 - DNA, 29 bp, Artificial Sequence
  Synthetic oligonucleotide
tcagggcacaggggggggccgaagcggga

SEQ ID NO: 199299 - DNA, 35 bp, Artificial Sequence
  Synthetic oligonucleotide
gatagcgtggaacgtacgggaatggacggggggga

SEQ ID NO: 199300 - DNA, 35 bp, Artificial Sequence
  Synthetic oligonucleotide
aaacgaggggcaaagtggtagtatgggggatggga

SEQ ID NO: 199301 - DNA, 38 bp, Artificial Sequence
  Synthetic oligonucleotide
acaacgcgagcgcggatagtgggagggagggataatga

SEQ ID NO: 199302 - DNA, 37 bp, Artificial Sequence
  Synthetic oligonucleotide
gcaccatatccagccgccgccacgtacagtcgcatga

SEQ ID NO: 199303 - DNA, 38 bp, Artificial Sequence
  Synthetic oligonucleotide
tgcaacatcggagccgtttctattgcccatcctcatga

SEQ ID NO: 199304 - DNA, 37 bp, Artificial Sequence
  Synthetic oligonucleotide
tcatgcactgccccttttgctactcgtgacacactga

SEQ ID NO: 199305 - DNA, 38 bp, Artificial Sequence
  Synthetic oligonucleotide
ataggcggacggcgggggcaaggtggcggtttcactga

SEQ ID NO: 199306 - DNA, 37 bp, Artificial Sequence
  Synthetic oligonucleotide
aagccagttgggagaagggaatgaacaagtggcgtga

SEQ ID NO: 199307 - DNA, 38 bp, Artificial Sequence
  Synthetic oligonucleotide
gaacgggagggaagggtagagcctagtcagctcggtga

SEQ ID NO: 199308 - DNA, 38 bp, Artificial Sequence
  Synthetic oligonucleotide
gaagacggtggaggagggagaagcatgcgagggtttga

SEQ ID NO: 199309 - DNA, 38 bp, Artificial Sequence
  Synthetic oligonucleotide
atgccccctgcagacggctactctctctcaccttttga

SEQ ID NO: 199310 - DNA, 36 bp, Artificial Sequence
  Synthetic oligonucleotide
tcagaaggggctggaagggaaggttggtaggctata

SEQ ID NO: 199311 - DNA, 36 bp, Artificial Sequence
  Synthetic oligonucleotide
actcgcccctctccctgctgtctaaacttttgacta

SEQ ID NO: 199312 - DNA, 36 bp, Artificial Sequence
  Synthetic oligonucleotide
acataccaccttcctatacggtgtcttacagttcta

SEQ ID NO: 199313 - DNA, 34 bp, Artificial Sequence
  Synthetic oligonucleotide
gtgacaccccactggcactcatccccgaccatta

SEQ ID NO: 199314 - DNA, 35 bp, Artificial Sequence
  Synthetic oligonucleotide
tctccctgcccacccgtatcattgactattaccac

SEQ ID NO: 199315 - DNA, 35 bp, Artificial Sequence
  Synthetic oligonucleotide
tcgtgcctccttgggttggtttaatctcctggcac

SEQ ID NO: 199316 - DNA, 35 bp, Artificial Sequence
  Synthetic oligonucleotide
ttcacgggaagggtgggggtgactaaggggccacc

SEQ ID NO: 199317 - DNA, 35 bp, Artificial Sequence
  Synthetic oligonucleotide
ttatcccacgcggcctacctgctgctaccaaaccc

SEQ ID NO: 199318 - DNA, 35 bp, Artificial Sequence
  Synthetic oligonucleotide
ttcttgcccccgcctgttatcactaggtctccccc

SEQ ID NO: 199319 - DNA, 35 bp, Artificial Sequence
  Synthetic oligonucleotide
attagccgccccatctcctccatctgagccagccc

SEQ ID NO: 199320 - DNA, 35 bp, Artificial Sequence
  Synthetic oligonucleotide
gtgccatggcctgcctccgtacgactcagtttccc

SEQ ID NO: 199321 - DNA, 35 bp, Artificial Sequence
  Synthetic oligonucleotide
ggtccagcccacttccgcttcactacaagcacgcc

SEQ ID NO: 199322 - DNA, 35 bp, Artificial Sequence
  Synthetic oligonucleotide
accccaccctcgcatctgtgacgagtcgactcgcc

SEQ ID NO: 199323 - DNA, 35 bp, Artificial Sequence
  Synthetic oligonucleotide
gttgcgtgcggtcgccggtcacccacaagccatcc

SEQ ID NO: 199324 - DNA, 35 bp, Artificial Sequence
  Synthetic oligonucleotide
tccaccgctcggcctggccataccttacttcgtcc

SEQ ID NO: 199325 - DNA, 35 bp, Artificial Sequence
  Synthetic oligonucleotide
acgtgcccagccggccgccccgatcccatgcaagc

SEQ ID NO: 199326 - DNA, 35 bp, Artificial Sequence
  Synthetic oligonucleotide
acccgtccttcttgaaatgttcctgtctctgccgc

SEQ ID NO: 199327 - DNA, 35 bp, Artificial Sequence
  Synthetic oligonucleotide
ctcacaccgttgccccaccgactgcctacccgtgc

SEQ ID NO: 199328 - DNA, 35 bp, Artificial Sequence
  Synthetic oligonucleotide
aaccacgctgccgtcgctcgctttatcttccgtgc

SEQ ID NO: 199329 - DNA, 35 bp, Artificial Sequence
  Synthetic oligonucleotide
atgtgcccgctccttgccgctttatgtagcccatc

SEQ ID NO: 199330 - DNA, 35 bp, Artificial Sequence
  Synthetic oligonucleotide
atcacaccgcgccccatctggatagactgggcatc

SEQ ID NO: 199331 - DNA, 35 bp, Artificial Sequence
  Synthetic oligonucleotide
tttgccgccgcccttcgtgtgaccccgcaccactc

SEQ ID NO: 199332 - DNA, 35 bp, Artificial Sequence
  Synthetic oligonucleotide
tggacgcccgtcctgtttccgtcgttcttaaattc

SEQ ID NO: 199333 - DNA, 35 bp, Artificial Sequence
  Synthetic oligonucleotide
gtcaacatgccaaatgctgatcgaaacacaccttc

SEQ ID NO: 199334 - DNA, 35 bp, Artificial Sequence
  Synthetic oligonucleotide
aaccaacacctcacgccgttgacactgagacctag

SEQ ID NO: 199335 - DNA, 35 bp, Artificial Sequence
  Synthetic oligonucleotide
tcgccaatccgttggtattcgcccacatccgctcg

SEQ ID NO: 199336 - DNA, 35 bp, Artificial Sequence
  Synthetic oligonucleotide
gagtaggacggaccaaagaatagggagagcacagg

SEQ ID NO: 199337 - DNA, 35 bp, Artificial Sequence
  Synthetic oligonucleotide
gcaaccagccactcgttttaatcgcttcccttagg

SEQ ID NO: 199338 - DNA, 35 bp, Artificial Sequence
  Synthetic oligonucleotide
agcgcttgaccgatggtcccactccttctcctcgg

SEQ ID NO: 199339 - DNA, 35 bp, Artificial Sequence
  Synthetic oligonucleotide
atcagacggccgggtggagtgggcggtgttgaggg

SEQ ID NO: 199340 - DNA, 35 bp, Artificial Sequence
  Synthetic oligonucleotide
tatttcagcgccgatcacttacccctccgctatgg

SEQ ID NO: 199341 - DNA, 35 bp, Artificial Sequence
  Synthetic oligonucleotide
gacggagagtgccggaagtggtggaacgggggtgg

SEQ ID NO: 199342 - DNA, 35 bp, Artificial Sequence
  Synthetic oligonucleotide
ttcgcctcggtcccccttcactatcggacgccgtg

SEQ ID NO: 199343 - DNA, 34 bp, Artificial Sequence
  Synthetic oligonucleotide
gagcggcgaagctcagtccctttgtacccccttg

SEQ ID NO: 199344 - DNA, 35 bp, Artificial Sequence
  Synthetic oligonucleotide
gcacctcgcaatttgaccgcactgttcgccgttat

SEQ ID NO: 199345 - DNA, 35 bp, Artificial Sequence
  Synthetic oligonucleotide
ttgtagcacatcggttatggcctgctccccccact

SEQ ID NO: 199346 - DNA, 35 bp, Artificial Sequence
  Synthetic oligonucleotide
gatgcgcgtctgttgcattatgtccatctctcact

SEQ ID NO: 199347 - DNA, 35 bp, Artificial Sequence
  Synthetic oligonucleotide
tgaccctccaggctagtagaccctatgcattccct

SEQ ID NO: 199348 - DNA, 35 bp, Artificial Sequence
  Synthetic oligonucleotide
tgtcggggaaggggtaggatggaggaggataagct

SEQ ID NO: 199349 - DNA, 35 bp, Artificial Sequence
  Synthetic oligonucleotide
gttgatgacgtggttgcttttcccttgccttcgct

SEQ ID NO: 199350 - DNA, 35 bp, Artificial Sequence
  Synthetic oligonucleotide
acggaaaggccccaccctcgttatctgttctatct

SEQ ID NO: 199351 - DNA, 35 bp, Artificial Sequence
  Synthetic oligonucleotide
tgaccacgccgacgtctctatcgccagttttatct

SEQ ID NO: 199352 - DNA, 35 bp, Artificial Sequence
  Synthetic oligonucleotide
ttcgggcacgcaacgcttatttacttgggctctct

SEQ ID NO: 199353 - DNA, 35 bp, Artificial Sequence
  Synthetic oligonucleotide
atggggaggggggggtgcaaggtccagattatagt

SEQ ID NO: 199354 - DNA, 35 bp, Artificial Sequence
  Synthetic oligonucleotide
tgcatagcgccgttcgctgtttacccggtctctgt

SEQ ID NO: 199355 - DNA, 35 bp, Artificial Sequence
  Synthetic oligonucleotide
gtcctgccctgactacctcttaagattaccattgt

SEQ ID NO: 199356 - DNA, 35 bp, Artificial Sequence
  Synthetic oligonucleotide
tcgcggtccccacttgccattgcctcgtcctccaa

SEQ ID NO: 199357 - DNA, 35 bp, Artificial Sequence
  Synthetic oligonucleotide
gatagagtgaaggtacggagggggactggtaggaa

SEQ ID NO: 199358 - DNA, 35 bp, Artificial Sequence
  Synthetic oligonucleotide
atcagtcacgtgtgggaagggggaaggaggtctaa

SEQ ID NO: 199359 - DNA, 36 bp, Artificial Sequence
  Synthetic oligonucleotide
gcccagacgctgtggtgtgggtgggaatgggattaa

SEQ ID NO: 199360 - DNA, 36 bp, Artificial Sequence
  Synthetic oligonucleotide
acaccattgccctgaatcttgttatgcctacgttaa

SEQ ID NO: 199361 - DNA, 35 bp, Artificial Sequence
  Synthetic oligonucleotide
tccaacagcgctttacctcggtccgtgcccaaaca

SEQ ID NO: 199362 - DNA, 36 bp, Artificial Sequence
  Synthetic oligonucleotide
ggatccagggagggtgggacaagtgcgggctctaca

SEQ ID NO: 199363 - DNA, 35 bp, Artificial Sequence
  Synthetic oligonucleotide
ttgggcatacagtacttcatcgcgtgctttctcca

SEQ ID NO: 199364 - DNA, 36 bp, Artificial Sequence
  Synthetic oligonucleotide
agagaggaggcatagggggagagtcggttgctggca

SEQ ID NO: 199365 - DNA, 35 bp, Artificial Sequence
  Synthetic oligonucleotide
tagcacggcgaggggggggggtcacattccatgca

SEQ ID NO: 199366 - DNA, 37 bp, Artificial Sequence
  Synthetic oligonucleotide
aagaggcaacagacggggggcgaagggtgcaggaaga

SEQ ID NO: 199367 - DNA, 37 bp, Artificial Sequence
  Synthetic oligonucleotide
tgagaggacggcagtcgggggtacacggaaggagaga

SEQ ID NO: 199368 - DNA, 37 bp, Artificial Sequence
  Synthetic oligonucleotide
ttccaccgccctccgcacataagtccatgaaatgaga

SEQ ID NO: 199369 - DNA, 37 bp, Artificial Sequence
  Synthetic oligonucleotide
gagggggggaagtagtggttaggacagctgtgaacga

SEQ ID NO: 199370 - DNA, 37 bp, Artificial Sequence
  Synthetic oligonucleotide
gtgggaccgggcggggagggcctccttgtgattacga

SEQ ID NO: 199371 - DNA, 37 bp, Artificial Sequence
  Synthetic oligonucleotide
acgtaccctcctgctacccccctttggcatcacccga

SEQ ID NO: 199372 - DNA, 37 bp, Artificial Sequence
  Synthetic oligonucleotide
agaggccaccagccgtttccttcaactcgtctcccga

SEQ ID NO: 199373 - DNA, 37 bp, Artificial Sequence
  Synthetic oligonucleotide
gctgttgtgggttaggacgggaggaaaagatgggcga

SEQ ID NO: 199374 - DNA, 37 bp, Artificial Sequence
  Synthetic oligonucleotide
tcatccccaattgctgtttccctcggttccgtatcga

SEQ ID NO: 199375 - DNA, 31 bp, Artificial Sequence
  Synthetic oligonucleotide
tcatacacgcctccccaccgcttcgcttcga

SEQ ID NO: 199376 - DNA, 37 bp, Artificial Sequence
  Synthetic oligonucleotide
gttgcgtggcatgaggtgcgggcggggatggaacgga

SEQ ID NO: 199377 - DNA, 37 bp, Artificial Sequence
  Synthetic oligonucleotide
tggagggtggttgtgggaagggccgatcttctccgga

SEQ ID NO: 199378 - DNA, 37 bp, Artificial Sequence
  Synthetic oligonucleotide
gagcgggggaaacaaaagtataagaggtggggcggga

SEQ ID NO: 199379 - DNA, 36 bp, Artificial Sequence
  Synthetic oligonucleotide
gacgggaggggtaggggagtaccgaagactggggga

SEQ ID NO: 199380 - DNA, 36 bp, Artificial Sequence
  Synthetic oligonucleotide
acatgtccctgctactagattgcgcccttcacctga

SEQ ID NO: 199381 - DNA, 38 bp, Artificial Sequence
  Synthetic oligonucleotide
tgtagctgtcacaccttgttctatcttgccttccctga

SEQ ID NO: 199382 - DNA, 37 bp, Artificial Sequence
  Synthetic oligonucleotide
tacatgcccaacgcttattatctgtccgccaaattga

SEQ ID NO: 199383 - DNA, 37 bp, Artificial Sequence
  Synthetic oligonucleotide
aatggagggaggggcacataagggcaagggttattga

SEQ ID NO: 199384 - DNA, 38 bp, Artificial Sequence
  Synthetic oligonucleotide
ggaatggcccactgtcgtctacacgttactccccttga

SEQ ID NO: 199385 - DNA, 38 bp, Artificial Sequence
  Synthetic oligonucleotide
accgagacaggacgatcaaggggcaggagagaagttga

SEQ ID NO: 199386 - DNA, 38 bp, Artificial Sequence
  Synthetic oligonucleotide
tgcacatcgctccactccgataaacgccctttctttga

SEQ ID NO: 199387 - DNA, 36 bp, Artificial Sequence
  Synthetic oligonucleotide
ggttcgccgccttatcttgtccctgctgtctaaata

SEQ ID NO: 199388 - DNA, 35 bp, Artificial Sequence
  Synthetic oligonucleotide
gttgcgcctgacctcgctctttacgcctttccata

SEQ ID NO: 199389 - DNA, 36 bp, Artificial Sequence
  Synthetic oligonucleotide
ttccaacgcccactatcggtttcagccaccccccta

SEQ ID NO: 199390 - DNA, 35 bp, Artificial Sequence
  Synthetic oligonucleotide
tcacatgccacctacgtctcgtctatttaactcta

SEQ ID NO: 199391 - DNA, 36 bp, Artificial Sequence
  Synthetic oligonucleotide
atcccacaccgattttgcagtctaattggccctcta

SEQ ID NO: 199392 - DNA, 36 bp, Artificial Sequence
  Synthetic oligonucleotide
tcaccggacagatcgtctcctccagggtttcttcta

SEQ ID NO: 199393 - DNA, 36 bp, Artificial Sequence
  Synthetic oligonucleotide
ttgagccgctgtgacaatgccgcccttctttcatta

SEQ ID NO: 199394 - DNA, 35 bp, Artificial Sequence
  Synthetic oligonucleotide
gttgcgggccgacagcacctctatgcttaccctac

SEQ ID NO: 199395 - DNA, 35 bp, Artificial Sequence
  Synthetic oligonucleotide
gtacgcctcccgcctttgcctgttgccacgcaccc

SEQ ID NO: 199396 - DNA, 35 bp, Artificial Sequence
  Synthetic oligonucleotide
gcctgccagattgtaaccttgtatcatttctcgcc

SEQ ID NO: 199397 - DNA, 35 bp, Artificial Sequence
  Synthetic oligonucleotide
tggacgacgctctattcctttacttgtctcgggcc

SEQ ID NO: 199398 - DNA, 35 bp, Artificial Sequence
  Synthetic oligonucleotide
tgcgatcctctcccacctgattaagcccctgtgcc

SEQ ID NO: 199399 - DNA, 35 bp, Artificial Sequence
  Synthetic oligonucleotide
gtccccctccgaccatttatgtcgcagttccatcc

SEQ ID NO: 199400 - DNA, 34 bp, Artificial Sequence
  Synthetic oligonucleotide
atcgcattgccggctctgttttgcgcagccctcc

SEQ ID NO: 199401 - DNA, 34 bp, Artificial Sequence
  Synthetic oligonucleotide
gcacagccgttcagcctactcctctagggcctcc

SEQ ID NO: 199402 - DNA, 35 bp, Artificial Sequence
  Synthetic oligonucleotide
tacgccgcccagttggtttccgccgccacttctcc

SEQ ID NO: 199403 - DNA, 35 bp, Artificial Sequence
  Synthetic oligonucleotide
gaccgaacgtcccgccacatcgttactctcatagc

SEQ ID NO: 199404 - DNA, 35 bp, Artificial Sequence
  Synthetic oligonucleotide
tacaccccgcctttcgtatcctcgagacccaccgc

SEQ ID NO: 199405 - DNA, 35 bp, Artificial Sequence
  Synthetic oligonucleotide
gaacctgactcccgatacaaatgcctgcctggggc

SEQ ID NO: 199406 - DNA, 37 bp, Artificial Sequence
  Synthetic oligonucleotide
tagtccccccacgtgtgcctacgcgtacgagttctgc

SEQ ID NO: 199407 - DNA, 35 bp, Artificial Sequence
  Synthetic oligonucleotide
acgatcctcggccttctacgtattaacaatccatc

SEQ ID NO: 199408 - DNA, 35 bp, Artificial Sequence
  Synthetic oligonucleotide
ttgcgtgctcgggtcgatccactgccatccttatc

SEQ ID NO: 199409 - DNA, 35 bp, Artificial Sequence
  Synthetic oligonucleotide
ttcaccgcattcggtttgttacgctctggtacctc

SEQ ID NO: 199410 - DNA, 35 bp, Artificial Sequence
  Synthetic oligonucleotide
gtcaactcagtagcacgtctttgtcttccatcctc

SEQ ID NO: 199411 - DNA, 35 bp, Artificial Sequence
  Synthetic oligonucleotide
gtgtagcctttcttgatcgtcttcctcggtttctc

SEQ ID NO: 199412 - DNA, 35 bp, Artificial Sequence
  Synthetic oligonucleotide
attcacaccctcagcctcacctcacacggacagtc

SEQ ID NO: 199413 - DNA, 35 bp, Artificial Sequence
  Synthetic oligonucleotide
accgccgcccataatctttcacagcgaataccttc

SEQ ID NO: 199414 - DNA, 35 bp, Artificial Sequence
  Synthetic oligonucleotide
aatgcactcgccgctaaccgtagagggcacccttc

SEQ ID NO: 199415 - DNA, 35 bp, Artificial Sequence
  Synthetic oligonucleotide
ttcgtcaccccaatcctttagtgccacctgataag

SEQ ID NO: 199416 - DNA, 35 bp, Artificial Sequence
  Synthetic oligonucleotide
cgcagggtaggggaggagataagtggggggttaag

SEQ ID NO: 199417 - DNA, 35 bp, Artificial Sequence
  Synthetic oligonucleotide
atgcctccgtccgcgccacctcgttcctaccccag

SEQ ID NO: 199418 - DNA, 35 bp, Artificial Sequence
  Synthetic oligonucleotide
gctacgcccgcagagtatcttgaccccccattcag

SEQ ID NO: 199419 - DNA, 35 bp, Artificial Sequence
  Synthetic oligonucleotide
gggggcaacgcgtgagaagggcggcggtgggtgag

SEQ ID NO: 199420 - DNA, 35 bp, Artificial Sequence
  Synthetic oligonucleotide
atacggaagaggtgcataaggaggggggagcaggg

SEQ ID NO: 199421 - DNA, 35 bp, Artificial Sequence
  Synthetic oligonucleotide
ttggaggggacgatggcagggggagggcgtgatgg

SEQ ID NO: 199422 - DNA, 35 bp, Artificial Sequence
  Synthetic oligonucleotide
ttgtcatgcagtcacgttcccgtaccacccttctg

SEQ ID NO: 199423 - DNA, 34 bp, Artificial Sequence
  Synthetic oligonucleotide
atctcgctcccggtcacaggctcaataatctcat

SEQ ID NO: 199424 - DNA, 35 bp, Artificial Sequence
  Synthetic oligonucleotide
gaacggagccagacagctcttcttcttttcgccct

SEQ ID NO: 199425 - DNA, 35 bp, Artificial Sequence
  Synthetic oligonucleotide
ccatcatttgactcggactttcatgcttgactcct

SEQ ID NO: 199426 - DNA, 35 bp, Artificial Sequence
  Synthetic oligonucleotide
gcatcacctcgcctgtcttccctggtccaccttct

SEQ ID NO: 199427 - DNA, 35 bp, Artificial Sequence
  Synthetic oligonucleotide
gtacacacgatgccgactcgctccgccttccttct

SEQ ID NO: 199428 - DNA, 35 bp, Artificial Sequence
  Synthetic oligonucleotide
gccccagagggaagggaggaaagggcgccaggagt

SEQ ID NO: 199429 - DNA, 35 bp, Artificial Sequence
  Synthetic oligonucleotide
tcaggcccttcacttctgtatcgctagctttgggt

SEQ ID NO: 199430 - DNA, 35 bp, Artificial Sequence
  Synthetic oligonucleotide
tccagccgaagcgacaccatgactcagctccactt

SEQ ID NO: 199431 - DNA, 35 bp, Artificial Sequence
  Synthetic oligonucleotide
atgccattcgcgtatccgccagtttttcgtgcctt

SEQ ID NO: 199432 - DNA, 35 bp, Artificial Sequence
  Synthetic oligonucleotide
acgccactaccgtcgttcgtcacttttcctcggtt

SEQ ID NO: 199433 - DNA, 36 bp, Artificial Sequence
  Synthetic oligonucleotide
gacggggagagggatgtgaggcgtatagggtgggaa

SEQ ID NO: 199434 - DNA, 36 bp, Artificial Sequence
  Synthetic oligonucleotide
gaagaggggactagggaacgggacacaagttgaaca

SEQ ID NO: 199435 - DNA, 35 bp, Artificial Sequence
  Synthetic oligonucleotide
gcgtagcgcggaaatcgttcgcttctacacccaca

SEQ ID NO: 199436 - DNA, 36 bp, Artificial Sequence
  Synthetic oligonucleotide
gatgcggtccacatccgtgcctttccccttgttaca

SEQ ID NO: 199437 - DNA, 36 bp, Artificial Sequence
  Synthetic oligonucleotide
tgtcatcactggccgtactttaccaccgctccgcca

SEQ ID NO: 199438 - DNA, 35 bp, Artificial Sequence
  Synthetic oligonucleotide
tctttacgtatagcttcggcccttgtcccctgcca

SEQ ID NO: 199439 - DNA, 35 bp, Artificial Sequence
  Synthetic oligonucleotide
gagacgaatggaggagaaaatggatcgcgaaggca

SEQ ID NO: 199440 - DNA, 36 bp, Artificial Sequence
  Synthetic oligonucleotide
gatggagaggaggtagtaacgtgagccaggggatca

SEQ ID NO: 199441 - DNA, 36 bp, Artificial Sequence
  Synthetic oligonucleotide
agtgggggggtcgcggggggcaatagcagaatcaga

SEQ ID NO: 199442 - DNA, 37 bp, Artificial Sequence
  Synthetic oligonucleotide
atccgggtgacggtgggggaaagagcacagatgtaga

SEQ ID NO: 199443 - DNA, 37 bp, Artificial Sequence
  Synthetic oligonucleotide
ggggggacgtgggtgggtagttgaaccgtccgtacga

SEQ ID NO: 199444 - DNA, 35 bp, Artificial Sequence
  Synthetic oligonucleotide
gccacccgctcaacctcgatgagtgcccttaccga

SEQ ID NO: 199445 - DNA, 36 bp, Artificial Sequence
  Synthetic oligonucleotide
gaaccaccgttctggcccatcattgaacgtctccga

SEQ ID NO: 199446 - DNA, 37 bp, Artificial Sequence
  Synthetic oligonucleotide
atccccgccgcagtccgcctgtctctttcagtatcga

SEQ ID NO: 199447 - DNA, 37 bp, Artificial Sequence
  Synthetic oligonucleotide
tagcaccggctctggctgctattaccccactcctcga

SEQ ID NO: 199448 - DNA, 37 bp, Artificial Sequence
  Synthetic oligonucleotide
ggggagggtcaggggagtggggaggaaatgagaagga

SEQ ID NO: 199449 - DNA, 35 bp, Artificial Sequence
  Synthetic oligonucleotide
gccgaccttccatctttattcacagtcccaccgga

SEQ ID NO: 199450 - DNA, 37 bp, Artificial Sequence
  Synthetic oligonucleotide
ttggtgagggtggggtaatgagcatggacgaagggga

SEQ ID NO: 199451 - DNA, 36 bp, Artificial Sequence
  Synthetic oligonucleotide
gaagggagaaggggaaagtgatggagaactctggga

SEQ ID NO: 199452 - DNA, 37 bp, Artificial Sequence
  Synthetic oligonucleotide
agtgagggagagagggaaaaagcgtcaggactctgga

SEQ ID NO: 199453 - DNA, 35 bp, Artificial Sequence
  Synthetic oligonucleotide
gagtgtatgactgggggtcgaggaggaggggtgga

SEQ ID NO: 199454 - DNA, 38 bp, Artificial Sequence
  Synthetic oligonucleotide
ggaagggaggagtggagtaaggggcggtgggcacatga

SEQ ID NO: 199455 - DNA, 37 bp, Artificial Sequence
  Synthetic oligonucleotide
agtgggaggggcatggctgagcagggattagggatga

SEQ ID NO: 199456 - DNA, 38 bp, Artificial Sequence
  Synthetic oligonucleotide
tcaaaggaccgaagtggatgaatggaagggggggatga

SEQ ID NO: 199457 - DNA, 37 bp, Artificial Sequence
  Synthetic oligonucleotide
tagtgcctccatgtcgtgttcaccctcgctccactga

SEQ ID NO: 199458 - DNA, 37 bp, Artificial Sequence
  Synthetic oligonucleotide
aacgaggcggtcccatgtttcactataccttccctga

SEQ ID NO: 199459 - DNA, 38 bp, Artificial Sequence
  Synthetic oligonucleotide
gaggaccggcatatgttatctaacccccgcctgcctga

SEQ ID NO: 199460 - DNA, 35 bp, Artificial Sequence
  Synthetic oligonucleotide
acctcctccgctcgtaagtctgccacgggtgctga

SEQ ID NO: 199461 - DNA, 38 bp, Artificial Sequence
  Synthetic oligonucleotide
tcccgccctagctgctgtctacgtacctttttctctga

SEQ ID NO: 199462 - DNA, 36 bp, Artificial Sequence
  Synthetic oligonucleotide
tgacgcgtgaggggcagggaaggattagattggtga

SEQ ID NO: 199463 - DNA, 37 bp, Artificial Sequence
  Synthetic oligonucleotide
tgatatgcgaacagggaggaaagcaggtaggatgtga

SEQ ID NO: 199464 - DNA, 38 bp, Artificial Sequence
  Synthetic oligonucleotide
gacaagggtagggagggtcctagggggagagcctgtga

SEQ ID NO: 199465 - DNA, 38 bp, Artificial Sequence
  Synthetic oligonucleotide
ttggcctcctgctagttccaccgtcctgtactctgtga

SEQ ID NO: 199466 - DNA, 38 bp, Artificial Sequence
  Synthetic oligonucleotide
aaggggcggagggtggtgcgggtactgtggtgtattga

SEQ ID NO: 199467 - DNA, 36 bp, Artificial Sequence
  Synthetic oligonucleotide
acacctcccctcctagcctttgagacaggtgcttga

SEQ ID NO: 199468 - DNA, 35 bp, Artificial Sequence
  Synthetic oligonucleotide
atccagaagggaggggatcggggaaggggctacta

SEQ ID NO: 199469 - DNA, 34 bp, Artificial Sequence
  Synthetic oligonucleotide
tctagcgcatatctaccgaacggtccctcaccta

SEQ ID NO: 199470 - DNA, 35 bp, Artificial Sequence
  Synthetic oligonucleotide
tccattgcaaatggcgttaaatttcctgcccgcta

SEQ ID NO: 199471 - DNA, 35 bp, Artificial Sequence
  Synthetic oligonucleotide
ttgtgctcaccgttgcgcccgtatctgttttcgta

SEQ ID NO: 199472 - DNA, 36 bp, Artificial Sequence
  Synthetic oligonucleotide
gccgcctcatccacgcgtcctatgcttgccccggta

SEQ ID NO: 199473 - DNA, 36 bp, Artificial Sequence
  Synthetic oligonucleotide
gccatgtagttgccggcgcacaatccccctccggta

SEQ ID NO: 199474 - DNA, 35 bp, Artificial Sequence
  Synthetic oligonucleotide
aacaaggtaggaggggagagtgacacactgtggta

SEQ ID NO: 199475 - DNA, 35 bp, Artificial Sequence
  Synthetic oligonucleotide
gaggaacgaacgggggggctagggagcaggttgta

SEQ ID NO: 199476 - DNA, 35 bp, Artificial Sequence
  Synthetic oligonucleotide
agtcggtgccgccacttgcgctacaccatccatta

SEQ ID NO: 199477 - DNA, 36 bp, Artificial Sequence
  Synthetic oligonucleotide
acgtgccaggaccagttcgttcttctcccgttatta

SEQ ID NO: 199478 - DNA, 36 bp, Artificial Sequence
  Synthetic oligonucleotide
tgatgttgacgtgcctgctttccgtgtcttccgtta

SEQ ID NO: 199479 - DNA, 35 bp, Artificial Sequence
  Synthetic oligonucleotide
ttcactcccgccggtattcacacttcctcgattta

SEQ ID NO: 199480 - DNA, 35 bp, Artificial Sequence
  Synthetic oligonucleotide
gtcccaccggacagacgtactttattttggtcaac

SEQ ID NO: 199481 - DNA, 35 bp, Artificial Sequence
  Synthetic oligonucleotide
tcacgtcgtcaagtatgccccgcctgtccctgcac

SEQ ID NO: 199482 - DNA, 35 bp, Artificial Sequence
  Synthetic oligonucleotide
aactgtacggcgtccacgttactatttcgcttcac

SEQ ID NO: 199483 - DNA, 35 bp, Artificial Sequence
  Synthetic oligonucleotide
atcgtcacccgccgacacccgcgtactttcgatac

SEQ ID NO: 199484 - DNA, 35 bp, Artificial Sequence
  Synthetic oligonucleotide
ggaggggacggggaaggaagggcccgggaaccacc

SEQ ID NO: 199485 - DNA, 35 bp, Artificial Sequence
  Synthetic oligonucleotide
gtcaacttcccgtatgttcttcgtcgcccactacc

SEQ ID NO: 199486 - DNA, 34 bp, Artificial Sequence
  Synthetic oligonucleotide
tagctccccctgttagttcgtcctgtcacttacc

SEQ ID NO: 199487 - DNA, 35 bp, Artificial Sequence
  Synthetic oligonucleotide
gatcaccgagctttcgggacgccttctactgcccc

SEQ ID NO: 199488 - DNA, 35 bp, Artificial Sequence
  Synthetic oligonucleotide
aatcgtgcgcgcggctggtccgcttccatttgccc

SEQ ID NO: 199489 - DNA, 35 bp, Artificial Sequence
  Synthetic oligonucleotide
acgtcccgcccgttggtgtcccagccgtggccgcc

SEQ ID NO: 199490 - DNA, 35 bp, Artificial Sequence
  Synthetic oligonucleotide
tcgtgcccgaattcgtgtgcatcactatcacctcc

SEQ ID NO: 199491 - DNA, 35 bp, Artificial Sequence
  Synthetic oligonucleotide
ttaccctcgccccatgcactaaggcgaccccccgc

SEQ ID NO: 199492 - DNA, 34 bp, Artificial Sequence
  Synthetic oligonucleotide
taccgcactgtctagttacccacaatgccctcgc

SEQ ID NO: 199493 - DNA, 35 bp, Artificial Sequence
  Synthetic oligonucleotide
tcgctagcccaccaccatggtcacgtcttaacatc

SEQ ID NO: 199494 - DNA, 35 bp, Artificial Sequence
  Synthetic oligonucleotide
gtgccacgacgtttcctgcttattccgaccctgtc

SEQ ID NO: 199495 - DNA, 35 bp, Artificial Sequence
  Synthetic oligonucleotide
tcgatcgcactgctgcccgcccatattcccagttc

SEQ ID NO: 199496 - DNA, 35 bp, Artificial Sequence
  Synthetic oligonucleotide
attgagagcgcacttctgtatggtttcgccttttc

SEQ ID NO: 199497 - DNA, 35 bp, Artificial Sequence
  Synthetic oligonucleotide
tgcccgattcacatggtctccacgccgccctaccg

SEQ ID NO: 199498 - DNA, 35 bp, Artificial Sequence
  Synthetic oligonucleotide
tcagtaacgctcaatggccacgcccgctcgccccg

SEQ ID NO: 199499 - DNA, 35 bp, Artificial Sequence
  Synthetic oligonucleotide
ttgcgtctcgtctccgtgtcactcactccgtcccg

SEQ ID NO: 199500 - DNA, 35 bp, Artificial Sequence
  Synthetic oligonucleotide
gacatgaccgttgcactagctcctcacttacattg

SEQ ID NO: 199501 - DNA, 35 bp, Artificial Sequence
  Synthetic oligonucleotide
ttggatcggtgtcgatggttctcttccactccttg

SEQ ID NO: 199502 - DNA, 35 bp, Artificial Sequence
  Synthetic oligonucleotide
gcaccgtgctgctgtccctttgctcattcctccat

SEQ ID NO: 199503 - DNA, 35 bp, Artificial Sequence
  Synthetic oligonucleotide
ttctgggcctcacctggcgcagcttgcccattact

SEQ ID NO: 199504 - DNA, 35 bp, Artificial Sequence
  Synthetic oligonucleotide
tgtgcaccattcgatccgactatgctacccaccct

SEQ ID NO: 199505 - DNA, 35 bp, Artificial Sequence
  Synthetic oligonucleotide
gatacatcagatagccttccgtccctgccgtgcct

SEQ ID NO: 199506 - DNA, 35 bp, Artificial Sequence
  Synthetic oligonucleotide
atcacgcaagtgattaatactcctacacacctcct

SEQ ID NO: 199507 - DNA, 35 bp, Artificial Sequence
  Synthetic oligonucleotide
ggacatggcgcaggctgaatttcccccctttccgt

SEQ ID NO: 199508 - DNA, 35 bp, Artificial Sequence
  Synthetic oligonucleotide
actcgcaccgtatctcccgtcgctaaatccgtcgt

SEQ ID NO: 199509 - DNA, 35 bp, Artificial Sequence
  Synthetic oligonucleotide
ttctcccctcggcatttgatctgcgccactccggt

SEQ ID NO: 199510 - DNA, 35 bp, Artificial Sequence
  Synthetic oligonucleotide
ttgttgcttcccggctgtcctggccacctttcatt

SEQ ID NO: 199511 - DNA, 35 bp, Artificial Sequence
  Synthetic oligonucleotide
taagcgggatgggagggagggttcctttttatctt

SEQ ID NO: 199512 - DNA, 35 bp, Artificial Sequence
  Synthetic oligonucleotide
aacattgcgcctctccatgattctaggtcctcttt

SEQ ID NO: 199513 - DNA, 35 bp, Artificial Sequence
  Synthetic oligonucleotide
gataaccactggtgctgaattgccttactacgttt

SEQ ID NO: 199514 - DNA, 35 bp, Artificial Sequence
  Synthetic oligonucleotide
ggtacgttcaacgcgctcaatctcccctttcgttt

SEQ ID NO: 199515 - DNA, 35 bp, Artificial Sequence
  Synthetic oligonucleotide
ttggttaggggcggaggttttggtagtaggggcaa

SEQ ID NO: 199516 - DNA, 36 bp, Artificial Sequence
  Synthetic oligonucleotide
tgtcccatccgttgtgtccagccccccttccacgaa

SEQ ID NO: 199517 - DNA, 35 bp, Artificial Sequence
  Synthetic oligonucleotide
tccactctgatcgctttattcacattacgtgccca

SEQ ID NO: 199518 - DNA, 36 bp, Artificial Sequence
  Synthetic oligonucleotide
gtccgccccaccgatggcatactcctcattgtagca

SEQ ID NO: 199519 - DNA, 36 bp, Artificial Sequence
  Synthetic oligonucleotide
tagacgccctgctgcctcatcgacccccctgattca

SEQ ID NO: 199520 - DNA, 36 bp, Artificial Sequence
  Synthetic oligonucleotide
tgccatcgacccccgcgttttcttgcaaccgtttca

SEQ ID NO: 199521 - DNA, 35 bp, Artificial Sequence
  Synthetic oligonucleotide
tgagacgtgatggtggagggggctacaaaccgaga

SEQ ID NO: 199522 - DNA, 37 bp, Artificial Sequence
  Synthetic oligonucleotide
aacggagggggggtacgggagtctgatcagtgataga

SEQ ID NO: 199523 - DNA, 37 bp, Artificial Sequence
  Synthetic oligonucleotide
actacatgcccgtagtagtctcagtacatccccccga

SEQ ID NO: 199524 - DNA, 37 bp, Artificial Sequence
  Synthetic oligonucleotide
taagggtgaaggggtggcaaggtaacgtctggcgcga

SEQ ID NO: 199525 - DNA, 37 bp, Artificial Sequence
  Synthetic oligonucleotide
gggtcagtaacgagggtaacgaggggaagggcggcga

SEQ ID NO: 199526 - DNA, 37 bp, Artificial Sequence
  Synthetic oligonucleotide
gacacaccgccgttttgtcgtggctatcactcttcga

SEQ ID NO: 199527 - DNA, 37 bp, Artificial Sequence
  Synthetic oligonucleotide
tggagaagaaagagaaatggggtacggacgggaagga

SEQ ID NO: 199528 - DNA, 36 bp, Artificial Sequence
  Synthetic oligonucleotide
ttgatacgcagacggggaatgagagggtggggcgga

SEQ ID NO: 199529 - DNA, 37 bp, Artificial Sequence
  Synthetic oligonucleotide
gtacgaggggtagggaggggccagaagcgatggcgga

SEQ ID NO: 199530 - DNA, 37 bp, Artificial Sequence
  Synthetic oligonucleotide
tgaggctagggaagacacgttgctagggagggaggga

SEQ ID NO: 199531 - DNA, 37 bp, Artificial Sequence
  Synthetic oligonucleotide
ttgacccgccaccgttcccattggccccgttcatgga

SEQ ID NO: 199532 - DNA, 37 bp, Artificial Sequence
  Synthetic oligonucleotide
ggtacaggagggtgcgggaacaggggacgttcgatga

SEQ ID NO: 199533 - DNA, 38 bp, Artificial Sequence
  Synthetic oligonucleotide
gaccggactgctccgtcacgtttcccttccgttcctga

SEQ ID NO: 199534 - DNA, 38 bp, Artificial Sequence
  Synthetic oligonucleotide
gtcacgagtcaagcaagaagatgggcgggggcgagtga

SEQ ID NO: 199535 - DNA, 38 bp, Artificial Sequence
  Synthetic oligonucleotide
ggggaggagggcgggggtggagggggcgtaaaacgtga

SEQ ID NO: 199536 - DNA, 38 bp, Artificial Sequence
  Synthetic oligonucleotide
agacacgacgctccctcctactgcgtcactatccttga

SEQ ID NO: 199537 - DNA, 37 bp, Artificial Sequence
  Synthetic oligonucleotide
actgccctctgcaaacgtatacccgggcccatcttga

SEQ ID NO: 199538 - DNA, 35 bp, Artificial Sequence
  Synthetic oligonucleotide
atgtcccccagccgaatcctctgctccacctttga

SEQ ID NO: 199539 - DNA, 35 bp, Artificial Sequence
  Synthetic oligonucleotide
gaccccagttgctgttctgcattgtccgtttccta

SEQ ID NO: 199540 - DNA, 36 bp, Artificial Sequence
  Synthetic oligonucleotide
ttgacacgcaagacctcccccggcatatactggcta

SEQ ID NO: 199541 - DNA, 35 bp, Artificial Sequence
  Synthetic oligonucleotide
gtgagcttacctgcataccctacgcctttctgcta

SEQ ID NO: 199542 - DNA, 36 bp, Artificial Sequence
  Synthetic oligonucleotide
gacattccgttgtactcgttccccctggttgttcta

SEQ ID NO: 199543 - DNA, 35 bp, Artificial Sequence
  Synthetic oligonucleotide
tactggaggggggggaggagaggggaagtcactta

SEQ ID NO: 199544 - DNA, 36 bp, Artificial Sequence
  Synthetic oligonucleotide
acacaggtgcccttctgctcacatccagcccgctta

SEQ ID NO: 199545 - DNA, 35 bp, Artificial Sequence
  Synthetic oligonucleotide
tcacaccacaccgcgctacgtaccaggcggtagac

SEQ ID NO: 199546 - DNA, 35 bp, Artificial Sequence
  Synthetic oligonucleotide
ggtggaggtgcaatagggaaggcgggcgacaatac

SEQ ID NO: 199547 - DNA, 35 bp, Artificial Sequence
  Synthetic oligonucleotide
tacccgtctgctatgtcatattctcaacgctctac

SEQ ID NO: 199548 - DNA, 35 bp, Artificial Sequence
  Synthetic oligonucleotide
tatggagccgtgttccgtcgccccgagttttaccc

SEQ ID NO: 199549 - DNA, 35 bp, Artificial Sequence
  Synthetic oligonucleotide
agcagacgctcctccttccatttccgtcttgcccc

SEQ ID NO: 199550 - DNA, 35 bp, Artificial Sequence
  Synthetic oligonucleotide
atgcgctgctctaaaggcgcacaagccacccgccc

SEQ ID NO: 199551 - DNA, 35 bp, Artificial Sequence
  Synthetic oligonucleotide
gacactgccactgctattgcccctactctgtagcc

SEQ ID NO: 199552 - DNA, 35 bp, Artificial Sequence
  Synthetic oligonucleotide
gatttgtgcgtgatgtatttgcctccctccatgcc

SEQ ID NO: 199553 - DNA, 33 bp, Artificial Sequence
  Synthetic oligonucleotide
tactcctgccacatcaaggcgagtagacttgcc

SEQ ID NO: 199554 - DNA, 35 bp, Artificial Sequence
  Synthetic oligonucleotide
gccgccccgtccggtacttgtccatcagtcgctcc

SEQ ID NO: 199555 - DNA, 35 bp, Artificial Sequence
  Synthetic oligonucleotide
tacgtccccgtctcctagttgcttatcgcctgtcc

SEQ ID NO: 199556 - DNA, 35 bp, Artificial Sequence
  Synthetic oligonucleotide
acacgagcatatcccgtatttagacccacccttcc

SEQ ID NO: 199557 - DNA, 35 bp, Artificial Sequence
  Synthetic oligonucleotide
tggttggtccatagttagcctccgccgcctcccgc

SEQ ID NO: 199558 - DNA, 35 bp, Artificial Sequence
  Synthetic oligonucleotide
gtgggaaacgcatcgggatctagggagggttatgc

SEQ ID NO: 199559 - DNA, 35 bp, Artificial Sequence
  Synthetic oligonucleotide
tgtatgttcccgactcgtcctcccctcactgctgc

SEQ ID NO: 199560 - DNA, 35 bp, Artificial Sequence
  Synthetic oligonucleotide
gatgcccagcctaccctcgcttgccgttcgacatc

SEQ ID NO: 199561 - DNA, 35 bp, Artificial Sequence
  Synthetic oligonucleotide
agcgccccctctgctttttttccgtctgctccatc

SEQ ID NO: 199562 - DNA, 35 bp, Artificial Sequence
  Synthetic oligonucleotide
tagtcgtgtgcaccctcgccccgtgttttacattc

SEQ ID NO: 199563 - DNA, 35 bp, Artificial Sequence
  Synthetic oligonucleotide
aatgccgcattcacctcggtcttccgttcgttttc

SEQ ID NO: 199564 - DNA, 35 bp, Artificial Sequence
  Synthetic oligonucleotide
gaaagtgggggtgacatggacgggactggcgcaag

SEQ ID NO: 199565 - DNA, 35 bp, Artificial Sequence
  Synthetic oligonucleotide
ttgccccacggacctccctagtttctcctctggag

SEQ ID NO: 199566 - DNA, 35 bp, Artificial Sequence
  Synthetic oligonucleotide
aaggtaaacgggcaggtgcgaagggtggggcaacg

SEQ ID NO: 199567 - DNA, 35 bp, Artificial Sequence
  Synthetic oligonucleotide
tctaccgcaccatctacctttagctcggatttacg

SEQ ID NO: 199568 - DNA, 35 bp, Artificial Sequence
  Synthetic oligonucleotide
aatgcaccccgtgttcgttgttcgtgtctcttgcg

SEQ ID NO: 199569 - DNA, 34 bp, Artificial Sequence
  Synthetic oligonucleotide
acatcacccccgtattagtgtcctgttcaacggg

SEQ ID NO: 199570 - DNA, 35 bp, Artificial Sequence
  Synthetic oligonucleotide
ggatacggaggggaagtagacaattatcagggggg

SEQ ID NO: 199571 - DNA, 35 bp, Artificial Sequence
  Synthetic oligonucleotide
acccactacccgccatttgcgtgatgcttgcattg

SEQ ID NO: 199572 - DNA, 35 bp, Artificial Sequence
  Synthetic oligonucleotide
tcgcattccgtgtgtccgttaccacccatactttg

SEQ ID NO: 199573 - DNA, 35 bp, Artificial Sequence
  Synthetic oligonucleotide
gggacgggtacggaggaggagtgtcgtcaggtttg

SEQ ID NO: 199574 - DNA, 35 bp, Artificial Sequence
  Synthetic oligonucleotide
taccacgtcactttgctgagtcaccccccgcccat

SEQ ID NO: 199575 - DNA, 35 bp, Artificial Sequence
  Synthetic oligonucleotide
tgggccgttccgagccttccacgacctgtatccat

SEQ ID NO: 199576 - DNA, 35 bp, Artificial Sequence
  Synthetic oligonucleotide
tatcaacccccttatgtctaccagtgtcgcactat

SEQ ID NO: 199577 - DNA, 35 bp, Artificial Sequence
  Synthetic oligonucleotide
agtgccagtgccgactggcataccaactattctat

SEQ ID NO: 199578 - DNA, 35 bp, Artificial Sequence
  Synthetic oligonucleotide
acttcctgccgaccgccatgtgcgctaggtcccct

SEQ ID NO: 199579 - DNA, 35 bp, Artificial Sequence
  Synthetic oligonucleotide
gtgcgtaattgcctctgtgcccaggtttccacgct

SEQ ID NO: 199580 - DNA, 35 bp, Artificial Sequence
  Synthetic oligonucleotide
gtagccctggtctgattagccttctgcaaccctct

SEQ ID NO: 199581 - DNA, 35 bp, Artificial Sequence
  Synthetic oligonucleotide
gtgcaagataggacggtgaggacgagggagggtct

SEQ ID NO: 199582 - DNA, 35 bp, Artificial Sequence
  Synthetic oligonucleotide
gtccactcgccattaagcctacgtctcgttcacgt

SEQ ID NO: 199583 - DNA, 35 bp, Artificial Sequence
  Synthetic oligonucleotide
tctcactgcgtagccgtttcatgctcctacctttt

SEQ ID NO: 199584 - DNA, 36 bp, Artificial Sequence
  Synthetic oligonucleotide
tgactgcggctagctggacgggcgggggggatcaaa

SEQ ID NO: 199585 - DNA, 36 bp, Artificial Sequence
  Synthetic oligonucleotide
ttgatcccaccatgctattctacgtttacagttaaa

SEQ ID NO: 199586 - DNA, 36 bp, Artificial Sequence
  Synthetic oligonucleotide
tgcatccttctcagcgctgatctaccgactccccaa

SEQ ID NO: 199587 - DNA, 36 bp, Artificial Sequence
  Synthetic oligonucleotide
acaccaacagggaggggaagtgggtgggtactccaa

SEQ ID NO: 199588 - DNA, 38 bp, Artificial Sequence
  Synthetic oligonucleotide
gcatgacgggtgaggaggggggcggagcaattgatgaa

SEQ ID NO: 199589 - DNA, 36 bp, Artificial Sequence
  Synthetic oligonucleotide
gtgcgggcgggatgggcgattgtggaagggcaataa

SEQ ID NO: 199590 - DNA, 35 bp, Artificial Sequence
  Synthetic oligonucleotide
tcgaacgaacactgctctctactgaccttttaaca

SEQ ID NO: 199591 - DNA, 36 bp, Artificial Sequence
  Synthetic oligonucleotide
atagactgcccctctgttgtactcactccaccgaca

SEQ ID NO: 199592 - DNA, 36 bp, Artificial Sequence
  Synthetic oligonucleotide
atgcgtgatcgcccttttgtcatgtgtcttcgccca

SEQ ID NO: 199593 - DNA, 36 bp, Artificial Sequence
  Synthetic oligonucleotide
gcacgccctcactcatctggcctccgagctacgcca

SEQ ID NO: 199594 - DNA, 36 bp, Artificial Sequence
  Synthetic oligonucleotide
agtcctcccccctgtgttcttcgcaatggaatgcca

SEQ ID NO: 199595 - DNA, 36 bp, Artificial Sequence
  Synthetic oligonucleotide
tagtcacgcccacaacttatctcgatgacccatcca

SEQ ID NO: 199596 - DNA, 36 bp, Artificial Sequence
  Synthetic oligonucleotide
gtcccccccgcaccatatcaatcgagcttgttcgca

SEQ ID NO: 199597 - DNA, 36 bp, Artificial Sequence
  Synthetic oligonucleotide
tcacgcctccgggctacgtggtttcgccccttatca

SEQ ID NO: 199598 - DNA, 37 bp, Artificial Sequence
  Synthetic oligonucleotide
acgaggggcgagaaaaatagggactgggcgaagaaga

SEQ ID NO: 199599 - DNA, 37 bp, Artificial Sequence
  Synthetic oligonucleotide
ggaaggagagaggcaagtgggaagtcaagagggacga

SEQ ID NO: 199600 - DNA, 37 bp, Artificial Sequence
  Synthetic oligonucleotide
acccgtggtccagccttgtcctcatagtcaccttcga

SEQ ID NO: 199601 - DNA, 37 bp, Artificial Sequence
  Synthetic oligonucleotide
tactgctccagtcaaccttcctttgcccttaggcgga

SEQ ID NO: 199602 - DNA, 37 bp, Artificial Sequence
  Synthetic oligonucleotide
gccagagggagggggaggcgtgtttgtccgatgggga

SEQ ID NO: 199603 - DNA, 37 bp, Artificial Sequence
  Synthetic oligonucleotide
gaggaggggtcagaggaacaaatgataggggatggga

SEQ ID NO: 199604 - DNA, 37 bp, Artificial Sequence
  Synthetic oligonucleotide
gtcagggaaggcccgtgaatagggtgggcgggatgga

SEQ ID NO: 199605 - DNA, 37 bp, Artificial Sequence
  Synthetic oligonucleotide
gccaaccccgctcccgtcttgcggtcctaatattgga

SEQ ID NO: 199606 - DNA, 35 bp, Artificial Sequence
  Synthetic oligonucleotide
tcccgccctcccttctgcatgcaccaacctgctga

SEQ ID NO: 199607 - DNA, 36 bp, Artificial Sequence
  Synthetic oligonucleotide
tgggagacgggtgaacggagctatacgggcgggtga

SEQ ID NO: 199608 - DNA, 38 bp, Artificial Sequence
  Synthetic oligonucleotide
taacagggtgaagggggcataaacggcgagtagtgtga

SEQ ID NO: 199609 - DNA, 35 bp, Artificial Sequence
  Synthetic oligonucleotide
aagggagggggagtagaggtgatgttggcgtgtga

SEQ ID NO: 199610 - DNA, 36 bp, Artificial Sequence
  Synthetic oligonucleotide
ttcaagcggggggaggagtcggggagttcggtgtga

SEQ ID NO: 199611 - DNA, 35 bp, Artificial Sequence
  Synthetic oligonucleotide
tccacctgtatccggtttggatacgttcaccttga

SEQ ID NO: 199612 - DNA, 38 bp, Artificial Sequence
  Synthetic oligonucleotide
accaacccacatgtgcaagtgcctcgcgcccctgttga

SEQ ID NO: 199613 - DNA, 38 bp, Artificial Sequence
  Synthetic oligonucleotide
gggtgacagcagggggggtgaaggacgatgaagtttga

SEQ ID NO: 199614 - DNA, 35 bp, Artificial Sequence
  Synthetic oligonucleotide
taatcgggagcggagggggggaggtaccgatatta

SEQ ID NO: 199615 - DNA, 36 bp, Artificial Sequence
  Synthetic oligonucleotide
gatgcccgaccctttgcggcattttgctgttcctta

SEQ ID NO: 199616 - DNA, 31 bp, Artificial Sequence
  Synthetic oligonucleotide
gtaccgtgctccacccaaccgtcctgcttta

SEQ ID NO: 199617 - DNA, 35 bp, Artificial Sequence
  Synthetic oligonucleotide
acctaccaccgctgacgttaaaactatagatccac

SEQ ID NO: 199618 - DNA, 35 bp, Artificial Sequence
  Synthetic oligonucleotide
aaatcaagtggagagggggagaatgaagtcgagac

SEQ ID NO: 199619 - DNA, 35 bp, Artificial Sequence
  Synthetic oligonucleotide
gagagggtgggagggtactcattgctcagggggac

SEQ ID NO: 199620 - DNA, 35 bp, Artificial Sequence
  Synthetic oligonucleotide
gacgctctgtatgcccatgaacccccacgctctac

SEQ ID NO: 199621 - DNA, 35 bp, Artificial Sequence
  Synthetic oligonucleotide
tacgccctcactgtgtcccgcatgtccgttacacc

SEQ ID NO: 199622 - DNA, 35 bp, Artificial Sequence
  Synthetic oligonucleotide
gtgccccgcagccgagtctacctgtgcacttcacc

SEQ ID NO: 199623 - DNA, 35 bp, Artificial Sequence
  Synthetic oligonucleotide
gatggcacaagcagtcgagtagcgctctttccccc

SEQ ID NO: 199624 - DNA, 35 bp, Artificial Sequence
  Synthetic oligonucleotide
gataacgtcccgagtctcatccgccttactatccc

SEQ ID NO: 199625 - DNA, 35 bp, Artificial Sequence
  Synthetic oligonucleotide
gccatgcggaattcgtctcatagcgtccgactccc

SEQ ID NO: 199626 - DNA, 35 bp, Artificial Sequence
  Synthetic oligonucleotide
aactacgcatcttccaaccgggtcttagtccatcc

SEQ ID NO: 199627 - DNA, 35 bp, Artificial Sequence
  Synthetic oligonucleotide
ttagcccgcacaaagtgtccgttagcacgcactcc

SEQ ID NO: 199628 - DNA, 35 bp, Artificial Sequence
  Synthetic oligonucleotide
tagctacgccctgctacgtgccatgtttcatctcc

SEQ ID NO: 199629 - DNA, 35 bp, Artificial Sequence
  Synthetic oligonucleotide
aatgcacacatccggtttcttgctcatagctccgc

SEQ ID NO: 199630 - DNA, 35 bp, Artificial Sequence
  Synthetic oligonucleotide
acatcgctccctccgtcagaaacccctcctctggc

SEQ ID NO: 199631 - DNA, 35 bp, Artificial Sequence
  Synthetic oligonucleotide
acacgatagggtggtagcgagggtggggctattgc

SEQ ID NO: 199632 - DNA, 35 bp, Artificial Sequence
  Synthetic oligonucleotide
acaaaccgttccgtattgcttaccttgcccgttgc

SEQ ID NO: 199633 - DNA, 35 bp, Artificial Sequence
  Synthetic oligonucleotide
gatgccgtccattctctcccccgtatttgtcactc

SEQ ID NO: 199634 - DNA, 35 bp, Artificial Sequence
  Synthetic oligonucleotide
gacagccagtcgacgctcccatgtacagccacctc

SEQ ID NO: 199635 - DNA, 35 bp, Artificial Sequence
  Synthetic oligonucleotide
tttgagccactgccaccgtgtccagcttattcctc

SEQ ID NO: 199636 - DNA, 35 bp, Artificial Sequence
  Synthetic oligonucleotide
taggcccgccgatccctgcctgtgacctcgccttc

SEQ ID NO: 199637 - DNA, 36 bp, Artificial Sequence
  Synthetic oligonucleotide
ttgccccgcctctgttctgtctggcattacccgttc

SEQ ID NO: 199638 - DNA, 35 bp, Artificial Sequence
  Synthetic oligonucleotide
gttcgcggcccgcccctctttggacgcttcctacg

SEQ ID NO: 199639 - DNA, 35 bp, Artificial Sequence
  Synthetic oligonucleotide
taccacgccgactctttggtttttctcgccttacg

SEQ ID NO: 199640 - DNA, 35 bp, Artificial Sequence
  Synthetic oligonucleotide
gcatggcctcgcaagagcggtcatttccttccccg

SEQ ID NO: 199641 - DNA, 35 bp, Artificial Sequence
  Synthetic oligonucleotide
tcaacacagcaccaggcactcctccaccagcggcg

SEQ ID NO: 199642 - DNA, 35 bp, Artificial Sequence
  Synthetic oligonucleotide
tactgctggtaggggttgggtggggtaggagggcg

SEQ ID NO: 199643 - DNA, 35 bp, Artificial Sequence
  Synthetic oligonucleotide
gtctccggccatctctgtttcgcccgcccgtatgg

SEQ ID NO: 199644 - DNA, 35 bp, Artificial Sequence
  Synthetic oligonucleotide
ttgccaaggggaaggttagagaaggtgggaagatg

SEQ ID NO: 199645 - DNA, 35 bp, Artificial Sequence
  Synthetic oligonucleotide
tccgccccttgtcaacgacggccccccgaatattg

SEQ ID NO: 199646 - DNA, 35 bp, Artificial Sequence
  Synthetic oligonucleotide
gctgactagccgcacttcggtacatgtaactccat

SEQ ID NO: 199647 - DNA, 35 bp, Artificial Sequence
  Synthetic oligonucleotide
tagtccaccactgtccgtccagtcttctgcctact

SEQ ID NO: 199648 - DNA, 35 bp, Artificial Sequence
  Synthetic oligonucleotide
accgtcagtgaccgcagtttatcgcatcccgccct

SEQ ID NO: 199649 - DNA, 35 bp, Artificial Sequence
  Synthetic oligonucleotide
tctgcacgatagatcgtcacctgcgcccctctcct

SEQ ID NO: 199650 - DNA, 35 bp, Artificial Sequence
  Synthetic oligonucleotide
gtgggaggtaggagggataaggggtctggcatgct

SEQ ID NO: 199651 - DNA, 34 bp, Artificial Sequence
  Synthetic oligonucleotide
tgccatgatcacctcccctgtttacggtcactct

SEQ ID NO: 199652 - DNA, 35 bp, Artificial Sequence
  Synthetic oligonucleotide
gttaccgctccgtgtcctctagtgatccctgctct

SEQ ID NO: 199653 - DNA, 35 bp, Artificial Sequence
  Synthetic oligonucleotide
tccgacaacactcagctcctttccacacgagttct

SEQ ID NO: 199654 - DNA, 35 bp, Artificial Sequence
  Synthetic oligonucleotide
aagtagcaggaggggagataagggaaaacgagcgt

SEQ ID NO: 199655 - DNA, 35 bp, Artificial Sequence
  Synthetic oligonucleotide
atagccacactcaccatgctacatctgacccgctt

SEQ ID NO: 199656 - DNA, 35 bp, Artificial Sequence
  Synthetic oligonucleotide
ttagcacctgcccccccgtgccagtatactagttt

SEQ ID NO: 199657 - DNA, 34 bp, Artificial Sequence
  Synthetic oligonucleotide
gataagcatgggagtccggcgaaggggaaggcaa

SEQ ID NO: 199658 - DNA, 36 bp, Artificial Sequence
  Synthetic oligonucleotide
tgtgcccgggctgcccacttgctccacatcgtgcaa

SEQ ID NO: 199659 - DNA, 36 bp, Artificial Sequence
  Synthetic oligonucleotide
gcatccaaccgcctccgtgttccttcttcttatgaa

SEQ ID NO: 199660 - DNA, 36 bp, Artificial Sequence
  Synthetic oligonucleotide
tcacaccgcccgtacgcgtggagtcgtccccctgaa

SEQ ID NO: 199661 - DNA, 36 bp, Artificial Sequence
  Synthetic oligonucleotide
gtgagaggacggggggtgggatacaggctagttgaa

SEQ ID NO: 199662 - DNA, 35 bp, Artificial Sequence
  Synthetic oligonucleotide
gaccccccccgcccgtggtcacatacgggacctaa

SEQ ID NO: 199663 - DNA, 36 bp, Artificial Sequence
  Synthetic oligonucleotide
gcacagacgcagaggcaatgctccacctcctcgtaa

SEQ ID NO: 199664 - DNA, 36 bp, Artificial Sequence
  Synthetic oligonucleotide
aacaccctcgatcgtcgcaagcgatcctcttcgtaa

SEQ ID NO: 199665 - DNA, 36 bp, Artificial Sequence
  Synthetic oligonucleotide
gacccgacccccgctcttcttgacaatggcgtgaca

SEQ ID NO: 199666 - DNA, 36 bp, Artificial Sequence
  Synthetic oligonucleotide
taggctagcctccggttgttctgcccttcccgtaca

SEQ ID NO: 199667 - DNA, 35 bp, Artificial Sequence
  Synthetic oligonucleotide
actacacccccaaatgcgataaaacgctaaaacca

SEQ ID NO: 199668 - DNA, 36 bp, Artificial Sequence
  Synthetic oligonucleotide
tgtcacgaccgtttgccgacgctcctccgcacccca

SEQ ID NO: 199669 - DNA, 35 bp, Artificial Sequence
  Synthetic oligonucleotide
tctgcccgcctgttctctgttccgcgcccccagca

SEQ ID NO: 199670 - DNA, 35 bp, Artificial Sequence
  Synthetic oligonucleotide
tccaccctggattgtaacattccctaccgcttgca

SEQ ID NO: 199671 - DNA, 36 bp, Artificial Sequence
  Synthetic oligonucleotide
gccaacgtcaaccgctctcgctgtctttgtctttca

SEQ ID NO: 199672 - DNA, 37 bp, Artificial Sequence
  Synthetic oligonucleotide
tcatacacccactgacactcatgagctcggttaccga

SEQ ID NO: 199673 - DNA, 35 bp, Artificial Sequence
  Synthetic oligonucleotide
gccagaccgcaggtagtcctgttcacgcgccccga

SEQ ID NO: 199674 - DNA, 35 bp, Artificial Sequence
  Synthetic oligonucleotide
tactagcgcaatgtctcccgctccactgggcccga

SEQ ID NO: 199675 - DNA, 37 bp, Artificial Sequence
  Synthetic oligonucleotide
tcagatctggggtagggaaaaggggcgaaggatccga

SEQ ID NO: 199676 - DNA, 35 bp, Artificial Sequence
  Synthetic oligonucleotide
tccacatcatgcattacaccgacctgacattccga

SEQ ID NO: 199677 - DNA, 37 bp, Artificial Sequence
  Synthetic oligonucleotide
gtgaagagctggagggcggagaagagggaagcagcga

SEQ ID NO: 199678 - DNA, 37 bp, Artificial Sequence
  Synthetic oligonucleotide
agtgggggggcatctagacaggttaggggaagggcga

SEQ ID NO: 199679 - DNA, 35 bp, Artificial Sequence
  Synthetic oligonucleotide
ttagcgtgggtagggggggcggtcttgcaaacgga

SEQ ID NO: 199680 - DNA, 37 bp, Artificial Sequence
  Synthetic oligonucleotide
tagccaccacccctggtacctatgaaatcctagcgga

SEQ ID NO: 199681 - DNA, 36 bp, Artificial Sequence
  Synthetic oligonucleotide
gaaagcgcgagggggctggattgggggaatagggga

SEQ ID NO: 199682 - DNA, 37 bp, Artificial Sequence
  Synthetic oligonucleotide
gctgacgggtggaaggctagtgggggacgttcgggga

SEQ ID NO: 199683 - DNA, 37 bp, Artificial Sequence
  Synthetic oligonucleotide
gttcatcccctccgaatctttgagacacgcacaatga

SEQ ID NO: 199684 - DNA, 36 bp, Artificial Sequence
  Synthetic oligonucleotide
gatctacatccctgtgcctttatggtttgtccatga

SEQ ID NO: 199685 - DNA, 38 bp, Artificial Sequence
  Synthetic oligonucleotide
tgcatcacagcggggatgtctgggagggggggccctga

SEQ ID NO: 199686 - DNA, 35 bp, Artificial Sequence
  Synthetic oligonucleotide
gatgcgaacagagggaagggtgtacgatggagtga

SEQ ID NO: 199687 - DNA, 37 bp, Artificial Sequence
  Synthetic oligonucleotide
atagggcgccagtggggggacgaaggtgtgggggtga

SEQ ID NO: 199688 - DNA, 37 bp, Artificial Sequence
  Synthetic oligonucleotide
tcaccacccctcctgatttcaatgtgattttcattga

SEQ ID NO: 199689 - DNA, 37 bp, Artificial Sequence
  Synthetic oligonucleotide
gtccgtgagccccctgcccttctagccccacacttga

SEQ ID NO: 199690 - DNA, 29 bp, Artificial Sequence
  Synthetic oligonucleotide
gatccacggacccacgcccctcttgttga

SEQ ID NO: 199691 - DNA, 36 bp, Artificial Sequence
  Synthetic oligonucleotide
gccgacgagaggaggcattacataccttatctttga

SEQ ID NO: 199692 - DNA, 36 bp, Artificial Sequence
  Synthetic oligonucleotide
acccttccgcgttcacctactgcgcagattccgcta

SEQ ID NO: 199693 - DNA, 36 bp, Artificial Sequence
  Synthetic oligonucleotide
gtgctgggtgggtgcggccgggcgattctgttggta

SEQ ID NO: 199694 - DNA, 36 bp, Artificial Sequence
  Synthetic oligonucleotide
aatgatgtgtcccagcgtatttggcccatctctgta

SEQ ID NO: 199695 - DNA, 36 bp, Artificial Sequence
  Synthetic oligonucleotide
tctgaaacacctgcttgaccgacccgtagccactta

SEQ ID NO: 199696 - DNA, 35 bp, Artificial Sequence
  Synthetic oligonucleotide
atagtgcaccccaccttcttcattgactgctctta

SEQ ID NO: 199697 - DNA, 35 bp, Artificial Sequence
  Synthetic oligonucleotide
atcggtggcctcccctgttaacatagtcctgtaac

SEQ ID NO: 199698 - DNA, 35 bp, Artificial Sequence
  Synthetic oligonucleotide
gtagctccaagtgacaaatcccccgtccgtttcac

SEQ ID NO: 199699 - DNA, 35 bp, Artificial Sequence
  Synthetic oligonucleotide
gcgacaccgggtggtcatgcgggtggggtatatac

SEQ ID NO: 199700 - DNA, 35 bp, Artificial Sequence
  Synthetic oligonucleotide
gtgaccacgaatccatttggtgctcttgcctgacc

SEQ ID NO: 199701 - DNA, 35 bp, Artificial Sequence
  Synthetic oligonucleotide
gacacgtcagaagagcgccgccgaccgatattccc

SEQ ID NO: 199702 - DNA, 35 bp, Artificial Sequence
  Synthetic oligonucleotide
taagtgcggtgcctggtcgtttctcccttcgcgcc

SEQ ID NO: 199703 - DNA, 35 bp, Artificial Sequence
  Synthetic oligonucleotide
gtcgtcaccattttgcctgtttctaacgttcatcc

SEQ ID NO: 199704 - DNA, 35 bp, Artificial Sequence
  Synthetic oligonucleotide
agcgttgcctccgctgaaggtatttgtcccggtcc

SEQ ID NO: 199705 - DNA, 35 bp, Artificial Sequence
  Synthetic oligonucleotide
tgcgtgccgcagtgccatctagttctctcatgtcc

SEQ ID NO: 199706 - DNA, 35 bp, Artificial Sequence
  Synthetic oligonucleotide
gtactacccgtgggcataatgtcgaacccttgcgc

SEQ ID NO: 199707 - DNA, 35 bp, Artificial Sequence
  Synthetic oligonucleotide
tgcatccgcctctttaatctatatcctccgctcgc

SEQ ID NO: 199708 - DNA, 35 bp, Artificial Sequence
  Synthetic oligonucleotide
ttgtcaccgccttcatctcttcaattcatcctggc

SEQ ID NO: 199709 - DNA, 35 bp, Artificial Sequence
  Synthetic oligonucleotide
atgcgctgagcatgcgcgtgtaactccttctactc

SEQ ID NO: 199710 - DNA, 35 bp, Artificial Sequence
  Synthetic oligonucleotide
taacctgcctgggccttacaagacaccatttgctc

SEQ ID NO: 199711 - DNA, 35 bp, Artificial Sequence
  Synthetic oligonucleotide
gttgccacccgcacttgagctctcacttttgagtc

SEQ ID NO: 199712 - DNA, 35 bp, Artificial Sequence
  Synthetic oligonucleotide
taactcgcccgtccctcgcttgtacataatgcgtc

SEQ ID NO: 199713 - DNA, 35 bp, Artificial Sequence
  Synthetic oligonucleotide
tgcacctctcgcccttgtaattcgtgtcttgtttc

SEQ ID NO: 199714 - DNA, 35 bp, Artificial Sequence
  Synthetic oligonucleotide
gaagaggaccaggcggataagggggccagggcaag

SEQ ID NO: 199715 - DNA, 36 bp, Artificial Sequence
  Synthetic oligonucleotide
gtagcctggtgtacctggtgtagtccgccctcctcg

SEQ ID NO: 199716 - DNA, 35 bp, Artificial Sequence
  Synthetic oligonucleotide
gatgcggtgaggcaaagcatgagggtgcggggtcg

SEQ ID NO: 199717 - DNA, 35 bp, Artificial Sequence
  Synthetic oligonucleotide
aatctgccgattagtctatccttccctccctccgg

SEQ ID NO: 199718 - DNA, 35 bp, Artificial Sequence
  Synthetic oligonucleotide
gccaagtctattgggataatacgcgggcgggaggg

SEQ ID NO: 199719 - DNA, 35 bp, Artificial Sequence
  Synthetic oligonucleotide
tacaccctcccgtcccattcctgatgactcatatg

SEQ ID NO: 199720 - DNA, 35 bp, Artificial Sequence
  Synthetic oligonucleotide
tccgcacaggcctgccctttctacccagctgtatg

SEQ ID NO: 199721 - DNA, 35 bp, Artificial Sequence
  Synthetic oligonucleotide
gaaacaagcgggacgggagagggatagaattgttg

SEQ ID NO: 199722 - DNA, 35 bp, Artificial Sequence
  Synthetic oligonucleotide
gcaagctctacgtcccccctcgatcctgtcaatat

SEQ ID NO: 199723 - DNA, 35 bp, Artificial Sequence
  Synthetic oligonucleotide
aactctgccgtcccgcttgcttcccgccgcctact

SEQ ID NO: 199724 - DNA, 35 bp, Artificial Sequence
  Synthetic oligonucleotide
tccacacttgtgccgtgtatgaccgttcctggcct

SEQ ID NO: 199725 - DNA, 35 bp, Artificial Sequence
  Synthetic oligonucleotide
ggagtgcacaggtaaataggaagtagcggggaagt

SEQ ID NO: 199726 - DNA, 34 bp, Artificial Sequence
  Synthetic oligonucleotide
gcgtcccgcctctttttcttgtcctcgatccatt

SEQ ID NO: 199727 - DNA, 35 bp, Artificial Sequence
  Synthetic oligonucleotide
gagtcccaggtcctctgcaaatgctccgcctcctt

SEQ ID NO: 199728 - DNA, 35 bp, Artificial Sequence
  Synthetic oligonucleotide
atgacacccaatccgttgatcctcctgacttcgtt

SEQ ID NO: 199729 - DNA, 35 bp, Artificial Sequence
  Synthetic oligonucleotide
tgatcaccctctctttcatcacaccaggacgggtt

SEQ ID NO: 199730 - DNA, 35 bp, Artificial Sequence
  Synthetic oligonucleotide
tattgccctcttcacgctatgctatcactgtacaa

SEQ ID NO: 199731 - DNA, 35 bp, Artificial Sequence
  Synthetic oligonucleotide
tacgctcctcacgtgccctcttccccttcgttgaa

SEQ ID NO: 199732 - DNA, 36 bp, Artificial Sequence
  Synthetic oligonucleotide
gtgtcaccgagcagcgattcgtcccgtcttcactaa

SEQ ID NO: 199733 - DNA, 35 bp, Artificial Sequence
  Synthetic oligonucleotide
ttgagcacgttcactctttccatcctgttcccaca

SEQ ID NO: 199734 - DNA, 36 bp, Artificial Sequence
  Synthetic oligonucleotide
gccatggtctgccaggcacaagccatttcttcccca

SEQ ID NO: 199735 - DNA, 36 bp, Artificial Sequence
  Synthetic oligonucleotide
gtcggatcagcaggtacctctccgcactctacgcca

SEQ ID NO: 199736 - DNA, 36 bp, Artificial Sequence
  Synthetic oligonucleotide
gccaagcacggacgcgtttactgcaccactaggcca

SEQ ID NO: 199737 - DNA, 36 bp, Artificial Sequence
  Synthetic oligonucleotide
gcacacgcacgaccttttgagcgccaccgacacgca

SEQ ID NO: 199738 - DNA, 36 bp, Artificial Sequence
  Synthetic oligonucleotide
taagtcacacagcctgccaagtccgtccctgtcgca

SEQ ID NO: 199739 - DNA, 36 bp, Artificial Sequence
  Synthetic oligonucleotide
acattatgctcccgactcgtacctcgtgccgctgca

SEQ ID NO: 199740 - DNA, 35 bp, Artificial Sequence
  Synthetic oligonucleotide
atgagccccctcatgcgcgaaacacctttattgca

SEQ ID NO: 199741 - DNA, 35 bp, Artificial Sequence
  Synthetic oligonucleotide
gcccgtgagaggctaatcacggtcccccctcctca

SEQ ID NO: 199742 - DNA, 35 bp, Artificial Sequence
  Synthetic oligonucleotide
tgtcaacatcaactggacatatgctgcccctctca

SEQ ID NO: 199743 - DNA, 36 bp, Artificial Sequence
  Synthetic oligonucleotide
ggaagctgccaccgctgtgcttcctgtcttgtctca

SEQ ID NO: 199744 - DNA, 37 bp, Artificial Sequence
  Synthetic oligonucleotide
gatcgggtgggtccaaagtcgggaagggccgttaaga

SEQ ID NO: 199745 - DNA, 36 bp, Artificial Sequence
  Synthetic oligonucleotide
tgacggtgggggagtggggtaggagttcatgagaga

SEQ ID NO: 199746 - DNA, 37 bp, Artificial Sequence
  Synthetic oligonucleotide
accacaacattgatgcttttttgcgcctctccaccga

SEQ ID NO: 199747 - DNA, 35 bp, Artificial Sequence
  Synthetic oligonucleotide
tgacgtaggaacaggaaataggaagggaaaagcga

SEQ ID NO: 199748 - DNA, 37 bp, Artificial Sequence
  Synthetic oligonucleotide
gaagggtcggggggtggattacggcgcggcggtgcga

SEQ ID NO: 199749 - DNA, 36 bp, Artificial Sequence
  Synthetic oligonucleotide
ttggctcccccgaccgtaccaatcccttctgtgcga

SEQ ID NO: 199750 - DNA, 37 bp, Artificial Sequence
  Synthetic oligonucleotide
gggtggtggcgggggtatcggaggaggcaccaatcga

SEQ ID NO: 199751 - DNA, 36 bp, Artificial Sequence
  Synthetic oligonucleotide
atcgtgatggaagtggagggggcgacaagggaagga

SEQ ID NO: 199752 - DNA, 37 bp, Artificial Sequence
  Synthetic oligonucleotide
gaagagcccgtctagagggggaatagaggtgacagga

SEQ ID NO: 199753 - DNA, 37 bp, Artificial Sequence
  Synthetic oligonucleotide
atcgaaaacgtgggtggagaggggcttatggtcagga

SEQ ID NO: 199754 - DNA, 35 bp, Artificial Sequence
  Synthetic oligonucleotide
aactcccgcatcaccgctttgtctatactcacgga

SEQ ID NO: 199755 - DNA, 36 bp, Artificial Sequence
  Synthetic oligonucleotide
aaaggccgggaggaagggggtgcgttcgcacaggga

SEQ ID NO: 199756 - DNA, 36 bp, Artificial Sequence
  Synthetic oligonucleotide
acgaagttccagccgggcgggaagactagggaggga

SEQ ID NO: 199757 - DNA, 35 bp, Artificial Sequence
  Synthetic oligonucleotide
gcaacggtgtgcacgttcacagagggggggaggga

SEQ ID NO: 199758 - DNA, 36 bp, Artificial Sequence
  Synthetic oligonucleotide
gaaggacgaacgttgatggaaataacggggggggga

SEQ ID NO: 199759 - DNA, 37 bp, Artificial Sequence
  Synthetic oligonucleotide
accgtgtagctgcggttgtgggagggaaggggtggga

SEQ ID NO: 199760 - DNA, 38 bp, Artificial Sequence
  Synthetic oligonucleotide
aggtcatgcgacatgtgggtgaggcgggggggtgatga

SEQ ID NO: 199761 - DNA, 38 bp, Artificial Sequence
  Synthetic oligonucleotide
gccgtgccccctccgcggttacatgaccacatgtatga

SEQ ID NO: 199762 - DNA, 38 bp, Artificial Sequence
  Synthetic oligonucleotide
accgtgcacccgcagtgtattgcctccactcgtactga

SEQ ID NO: 199763 - DNA, 38 bp, Artificial Sequence
  Synthetic oligonucleotide
acattgcccaccatgcgttcaagcctattcactcctga

SEQ ID NO: 199764 - DNA, 38 bp, Artificial Sequence
  Synthetic oligonucleotide
ttacgcacctcccgtttgccatgaaactccttctctga

SEQ ID NO: 199765 - DNA, 37 bp, Artificial Sequence
  Synthetic oligonucleotide
ttgtagcctacgtcgtcgtacttctccctcctgttga

SEQ ID NO: 199766 - DNA, 36 bp, Artificial Sequence
  Synthetic oligonucleotide
atgcgtacgccgcgcgttttgcgaccctctccccta

SEQ ID NO: 199767 - DNA, 31 bp, Artificial Sequence
  Synthetic oligonucleotide
taacgtgcgcctgcattcccctacgctggta

SEQ ID NO: 199768 - DNA, 35 bp, Artificial Sequence
  Synthetic oligonucleotide
tcacccctcccagccgtggttactctgctcttgta

SEQ ID NO: 199769 - DNA, 35 bp, Artificial Sequence
  Synthetic oligonucleotide
accacgccgccgtttcacctaacgactcagccaac

SEQ ID NO: 199770 - DNA, 35 bp, Artificial Sequence
  Synthetic oligonucleotide
acaatgagggggagggggtgctggataggtggaac

SEQ ID NO: 199771 - DNA, 35 bp, Artificial Sequence
  Synthetic oligonucleotide
tgccgtacctgaatcattcgcctggcctaccttac

SEQ ID NO: 199772 - DNA, 35 bp, Artificial Sequence
  Synthetic oligonucleotide
agtgctgccaatctgtcgcctagcctatacgttac

SEQ ID NO: 199773 - DNA, 35 bp, Artificial Sequence
  Synthetic oligonucleotide
gcacaacccactatgtcgttgcaaccgcccctacc

SEQ ID NO: 199774 - DNA, 35 bp, Artificial Sequence
  Synthetic oligonucleotide
tctgtcaagaattgtcagtaactgcctctccgccc

SEQ ID NO: 199775 - DNA, 35 bp, Artificial Sequence
  Synthetic oligonucleotide
accttcgcggggtcgattgttagggagggcgggcc

SEQ ID NO: 199776 - DNA, 35 bp, Artificial Sequence
  Synthetic oligonucleotide
tgcctacactcttatcccgactgtccattacttgc

SEQ ID NO: 199777 - DNA, 35 bp, Artificial Sequence
  Synthetic oligonucleotide
acctccatccgtgcgctcagtgtaggcttcatatc

SEQ ID NO: 199778 - DNA, 35 bp, Artificial Sequence
  Synthetic oligonucleotide
agccgagcccctcacgtgtcttttcgctttctatc

SEQ ID NO: 199779 - DNA, 35 bp, Artificial Sequence
  Synthetic oligonucleotide
tacgtccgtcaactgcttatcgttctaaccctctc

SEQ ID NO: 199780 - DNA, 35 bp, Artificial Sequence
  Synthetic oligonucleotide
tgggaagggtgaagggaggtgggaggatctgcgtc

SEQ ID NO: 199781 - DNA, 35 bp, Artificial Sequence
  Synthetic oligonucleotide
tgacgtcgcgattaattctgtccgtagtttcgttc

SEQ ID NO: 199782 - DNA, 35 bp, Artificial Sequence
  Synthetic oligonucleotide
gcacgtcgaccgtctcaactgcgcttccacatttc

SEQ ID NO: 199783 - DNA, 35 bp, Artificial Sequence
  Synthetic oligonucleotide
ggaggggagttgggaaattaaggttaagatggaag

SEQ ID NO: 199784 - DNA, 35 bp, Artificial Sequence
  Synthetic oligonucleotide
tctcatctcatcatgttcttcgcccgggcctctag

SEQ ID NO: 199785 - DNA, 35 bp, Artificial Sequence
  Synthetic oligonucleotide
gggtgtcgggggggttttgcggatggcacatcgcg

SEQ ID NO: 199786 - DNA, 35 bp, Artificial Sequence
  Synthetic oligonucleotide
gagtctgcgcctgccgcctttgcttcccctcatcg

SEQ ID NO: 199787 - DNA, 35 bp, Artificial Sequence
  Synthetic oligonucleotide
gcatgaagggtaagatcgtgggattgggtgggggg

SEQ ID NO: 199788 - DNA, 35 bp, Artificial Sequence
  Synthetic oligonucleotide
acacccttgcccctgtgtctcatgcacacgcgtgg

SEQ ID NO: 199789 - DNA, 35 bp, Artificial Sequence
  Synthetic oligonucleotide
gcaagagaggagggccgatatcggcataggtggtg

SEQ ID NO: 199790 - DNA, 35 bp, Artificial Sequence
  Synthetic oligonucleotide
acccgctcagcaatgaatagttccatccgatccat

SEQ ID NO: 199791 - DNA, 35 bp, Artificial Sequence
  Synthetic oligonucleotide
gcccgcacctccgagtgaccagccgcctatcacct

SEQ ID NO: 199792 - DNA, 35 bp, Artificial Sequence
  Synthetic oligonucleotide
gaggacggtcggatgtattagttctctcgcgccct

SEQ ID NO: 199793 - DNA, 35 bp, Artificial Sequence
  Synthetic oligonucleotide
ttcacgcctcctatcacgtcctttattcaaggcct

SEQ ID NO: 199794 - DNA, 35 bp, Artificial Sequence
  Synthetic oligonucleotide
tgtccatcatgtattggtctgtgctgccatcctct

SEQ ID NO: 199795 - DNA, 35 bp, Artificial Sequence
  Synthetic oligonucleotide
atactgccgcactgcgcacacctcatttcctaggt

SEQ ID NO: 199796 - DNA, 35 bp, Artificial Sequence
  Synthetic oligonucleotide
tacgctaatgcgcggtttgacgccttccatcctgt

SEQ ID NO: 199797 - DNA, 32 bp, Artificial Sequence
  Synthetic oligonucleotide
agaaacgtacactcctgccccatactctctgt

SEQ ID NO: 199798 - DNA, 35 bp, Artificial Sequence
  Synthetic oligonucleotide
taggtgtcacgctccgttggtctatttcaccttgt

SEQ ID NO: 199799 - DNA, 35 bp, Artificial Sequence
  Synthetic oligonucleotide
ggagcactcctcgcctcttgtcaacccggtcttgt

SEQ ID NO: 199800 - DNA, 35 bp, Artificial Sequence
  Synthetic oligonucleotide
gtcgctgccctccgctgtactccatggtttgggtt

SEQ ID NO: 199801 - DNA, 35 bp, Artificial Sequence
  Synthetic oligonucleotide
gcacagaatagggggagggggttgacagagtattt

SEQ ID NO: 199802 - DNA, 35 bp, Artificial Sequence
  Synthetic oligonucleotide
tacccgcaatctgtgctttcatgtccgcttcacaa

SEQ ID NO: 199803 - DNA, 36 bp, Artificial Sequence
  Synthetic oligonucleotide
agaaagtgagggtgggtcaaagggcaggcaagcgaa

SEQ ID NO: 199804 - DNA, 35 bp, Artificial Sequence
  Synthetic oligonucleotide
tactcgcctcacgtgccctcttccccttcgttgaa

SEQ ID NO: 199805 - DNA, 35 bp, Artificial Sequence
  Synthetic oligonucleotide
gccctccctcgtttctcacatgagacgtatcttaa

SEQ ID NO: 199806 - DNA, 36 bp, Artificial Sequence
  Synthetic oligonucleotide
acatcatgactgtcacatcacctgtagggccacaca

SEQ ID NO: 199807 - DNA, 36 bp, Artificial Sequence
  Synthetic oligonucleotide
ttgccgtccgttcacctatggcttaggctttcacca

SEQ ID NO: 199808 - DNA, 36 bp, Artificial Sequence
  Synthetic oligonucleotide
cacaccagtcaacggtaccgtcattccacctcgcca

SEQ ID NO: 199809 - DNA, 35 bp, Artificial Sequence
  Synthetic oligonucleotide
tgtcctacacctctctgttgcactgtgggttgcca

SEQ ID NO: 199810 - DNA, 36 bp, Artificial Sequence
  Synthetic oligonucleotide
agcacagcgcattatctgtccgttccaacctatcca

SEQ ID NO: 199811 - DNA, 36 bp, Artificial Sequence
  Synthetic oligonucleotide
ccacaccccccaatctgcgtagtgcgccggctcgca

SEQ ID NO: 199812 - DNA, 35 bp, Artificial Sequence
  Synthetic oligonucleotide
ttgacacggcttccgattctcgctcccatttggca

SEQ ID NO: 199813 - DNA, 35 bp, Artificial Sequence
  Synthetic oligonucleotide
tgtccggtcctcggtgctccctgctcctcttgtca

SEQ ID NO: 199814 - DNA, 36 bp, Artificial Sequence
  Synthetic oligonucleotide
gtggatgggcgggcgcggtgggtcgtctgttaaaga

SEQ ID NO: 199815 - DNA, 37 bp, Artificial Sequence
  Synthetic oligonucleotide
gtggtgaggtgggtgggtaggcgggacggccacaaga

SEQ ID NO: 199816 - DNA, 37 bp, Artificial Sequence
  Synthetic oligonucleotide
tgactaacgagtcacggcgggggaggaggcagggaga

SEQ ID NO: 199817 - DNA, 35 bp, Artificial Sequence
  Synthetic oligonucleotide
tcatgcccttccgctgtcccgatctatggctccga

SEQ ID NO: 199818 - DNA, 37 bp, Artificial Sequence
  Synthetic oligonucleotide
gaccagttgcagggggagggagaaccggaagacgcga

SEQ ID NO: 199819 - DNA, 37 bp, Artificial Sequence
  Synthetic oligonucleotide
aaagcgaagacataaagggcgggtgaagcgaagcgga

SEQ ID NO: 199820 - DNA, 37 bp, Artificial Sequence
  Synthetic oligonucleotide
gtgacaggggggcggactgtgggtgaaatgataggga

SEQ ID NO: 199821 - DNA, 37 bp, Artificial Sequence
  Synthetic oligonucleotide
acagaaagggaagggataagagagggtgggctcggga

SEQ ID NO: 199822 - DNA, 36 bp, Artificial Sequence
  Synthetic oligonucleotide
atctcgcaggaaggggtggctagtaacggaggggga

SEQ ID NO: 199823 - DNA, 37 bp, Artificial Sequence
  Synthetic oligonucleotide
tgggagtgaaccaggtaaggggaggcggtgaaatgga

SEQ ID NO: 199824 - DNA, 37 bp, Artificial Sequence
  Synthetic oligonucleotide
agtttggcgctgatctagggacgggagggagggtgga

SEQ ID NO: 199825 - DNA, 35 bp, Artificial Sequence
  Synthetic oligonucleotide
gttgctgtccagtatgaccactcccccctcaatga

SEQ ID NO: 199826 - DNA, 38 bp, Artificial Sequence
  Synthetic oligonucleotide
gatgcagtggaatgggatgaagggtagggctaggatga

SEQ ID NO: 199827 - DNA, 37 bp, Artificial Sequence
  Synthetic oligonucleotide
aggtcgacgacagtgcaccctagcaccaccaccctga

SEQ ID NO: 199828 - DNA, 37 bp, Artificial Sequence
  Synthetic oligonucleotide
ggagacgggtggaaggaagcgggtaacgtcacggtga

SEQ ID NO: 199829 - DNA, 37 bp, Artificial Sequence
  Synthetic oligonucleotide
ttcggggcgggagggagtagaaggtacacgcgggtga

SEQ ID NO: 199830 - DNA, 38 bp, Artificial Sequence
  Synthetic oligonucleotide
gtccaccccatttgtccatgcgagcattttcttattga

SEQ ID NO: 199831 - DNA, 38 bp, Artificial Sequence
  Synthetic oligonucleotide
gacgagcgacgcccttgttagtaaacccaccctcttga

SEQ ID NO: 199832 - DNA, 38 bp, Artificial Sequence
  Synthetic oligonucleotide
gaatggcgcagacagggtgctggggggggaacggttga

SEQ ID NO: 199833 - DNA, 38 bp, Artificial Sequence
  Synthetic oligonucleotide
agggggagggctcggacttgtgtatgggagggggttga

SEQ ID NO: 199834 - DNA, 38 bp, Artificial Sequence
  Synthetic oligonucleotide
tgccctctccaccgcgcccaatagatgtctaatgttga

SEQ ID NO: 199835 - DNA, 36 bp, Artificial Sequence
  Synthetic oligonucleotide
acatgacgcccgttctctcttatggcttacatcata

SEQ ID NO: 199836 - DNA, 35 bp, Artificial Sequence
  Synthetic oligonucleotide
accaccccgccgaccctatagaacaggccaagata

SEQ ID NO: 199837 - DNA, 36 bp, Artificial Sequence
  Synthetic oligonucleotide
gaggaacgtggggaggggaaatttaaggaaccggta

SEQ ID NO: 199838 - DNA, 35 bp, Artificial Sequence
  Synthetic oligonucleotide
ttggggcccacctgttgtaactgtcatattcggta

SEQ ID NO: 199839 - DNA, 34 bp, Artificial Sequence
  Synthetic oligonucleotide
gccacatcaccattgccgacccagcaccagggta

SEQ ID NO: 199840 - DNA, 36 bp, Artificial Sequence
  Synthetic oligonucleotide
acctcggtgggtgggaagacgagacatgggcgggta

SEQ ID NO: 199841 - DNA, 35 bp, Artificial Sequence
  Synthetic oligonucleotide
acgtacgctcgggggtgttggtgtgtgggtgggta

SEQ ID NO: 199842 - DNA, 36 bp, Artificial Sequence
  Synthetic oligonucleotide
ggggtgagggtgaggggggtagtacagtcagggtta

SEQ ID NO: 199843 - DNA, 34 bp, Artificial Sequence
  Synthetic oligonucleotide
tccacgagcactacgtgatatctctgggctacac

SEQ ID NO: 199844 - DNA, 35 bp, Artificial Sequence
  Synthetic oligonucleotide
gccgtaacatcctatgacgcctggatcgctccacc

SEQ ID NO: 199845 - DNA, 35 bp, Artificial Sequence
  Synthetic oligonucleotide
tgtccgcagtcagtctgcttcaacgccgctatccc

SEQ ID NO: 199846 - DNA, 35 bp, Artificial Sequence
  Synthetic oligonucleotide
tccgcccgccttaccgtcgtcctaagtcgcttccc

SEQ ID NO: 199847 - DNA, 35 bp, Artificial Sequence
  Synthetic oligonucleotide
gcacactccatatcggtctcggtataccttttccc

SEQ ID NO: 199848 - DNA, 35 bp, Artificial Sequence
  Synthetic oligonucleotide
tccgattgcctcgcatcattcctgtatttcgcgcc

SEQ ID NO: 199849 - DNA, 35 bp, Artificial Sequence
  Synthetic oligonucleotide
tctcatgtgtgcaaagtcgcctatagtcccgttcc

SEQ ID NO: 199850 - DNA, 35 bp, Artificial Sequence
  Synthetic oligonucleotide
tccgacgcaccctcttgcctcactattagcctggc

SEQ ID NO: 199851 - DNA, 35 bp, Artificial Sequence
  Synthetic oligonucleotide
tgacccctcacattgccggcctccgaatatcctgc

SEQ ID NO: 199852 - DNA, 35 bp, Artificial Sequence
  Synthetic oligonucleotide
tttggcacgacaatgccttctgtccaccccgctgc

SEQ ID NO: 199853 - DNA, 35 bp, Artificial Sequence
  Synthetic oligonucleotide
gcccgcccctctttcttcaacagctccctccttgc

SEQ ID NO: 199854 - DNA, 35 bp, Artificial Sequence
  Synthetic oligonucleotide
ttccacaccgcgatacgcccctacttcttcgttgc

SEQ ID NO: 199855 - DNA, 35 bp, Artificial Sequence
  Synthetic oligonucleotide
tttgcgccccagcctgcgcttaattccacctttgc

SEQ ID NO: 199856 - DNA, 35 bp, Artificial Sequence
  Synthetic oligonucleotide
gataagccatcctccgagttgtcgttcccgctatc

SEQ ID NO: 199857 - DNA, 35 bp, Artificial Sequence
  Synthetic oligonucleotide
tgcactgcctcaatactccggtgcttcgttctctc

SEQ ID NO: 199858 - DNA, 35 bp, Artificial Sequence
  Synthetic oligonucleotide
agttgacgtccgagatacactcagtccttcttctc

SEQ ID NO: 199859 - DNA, 35 bp, Artificial Sequence
  Synthetic oligonucleotide
taagcccatccaagttctcgaggcgaccttccttc

SEQ ID NO: 199860 - DNA, 35 bp, Artificial Sequence
  Synthetic oligonucleotide
gttagtccgggagggggagtagggcgaggacacag

SEQ ID NO: 199861 - DNA, 35 bp, Artificial Sequence
  Synthetic oligonucleotide
gtgggagtgaaaggtagggatgagagaggggagag

SEQ ID NO: 199862 - DNA, 35 bp, Artificial Sequence
  Synthetic oligonucleotide
attggtgctggacagaggcggcataggtgggggag

SEQ ID NO: 199863 - DNA, 35 bp, Artificial Sequence
  Synthetic oligonucleotide
ttggtgtagtgcgtccgtttctgccgtgtgccccg

SEQ ID NO: 199864 - DNA, 35 bp, Artificial Sequence
  Synthetic oligonucleotide
gacctcgctcctggtttgactatagcccttcgccg

SEQ ID NO: 199865 - DNA, 35 bp, Artificial Sequence
  Synthetic oligonucleotide
tgcacgtagtgttttcctcttacctatcccgttgg

SEQ ID NO: 199866 - DNA, 35 bp, Artificial Sequence
  Synthetic oligonucleotide
ttacacccccagcctggctaaggcaaccccgtgtg

SEQ ID NO: 199867 - DNA, 35 bp, Artificial Sequence
  Synthetic oligonucleotide
tgtgatcccactattatgtcgccttcaatcccttg

SEQ ID NO: 199868 - DNA, 35 bp, Artificial Sequence
  Synthetic oligonucleotide
tacatctgccgtctatctagcctctctacctacat

SEQ ID NO: 199869 - DNA, 35 bp, Artificial Sequence
  Synthetic oligonucleotide
tgtatgtccaccggtatctgcgcttgcatttctat

SEQ ID NO: 199870 - DNA, 35 bp, Artificial Sequence
  Synthetic oligonucleotide
ttcctcctcacgtgtggcttccttggccccttact

SEQ ID NO: 199871 - DNA, 35 bp, Artificial Sequence
  Synthetic oligonucleotide
tcatacctccgctcccttatgccccgtgtcctcct

SEQ ID NO: 199872 - DNA, 35 bp, Artificial Sequence
  Synthetic oligonucleotide
gccgtcgacccgacaatcgtcctatccgctacgct

SEQ ID NO: 199873 - DNA, 35 bp, Artificial Sequence
  Synthetic oligonucleotide
gctcatgtccgactgtccgccgctccacaaaaagt

SEQ ID NO: 199874 - DNA, 35 bp, Artificial Sequence
  Synthetic oligonucleotide
gaccggtccgtggtctctctccatccagtcccatt

SEQ ID NO: 199875 - DNA, 35 bp, Artificial Sequence
  Synthetic oligonucleotide
ttagccgcggccattaccggtaggtgtcgttcctt

SEQ ID NO: 199876 - DNA, 35 bp, Artificial Sequence
  Synthetic oligonucleotide
ggagaccgcctgatcgtgattcgcccctcccggtt

SEQ ID NO: 199877 - DNA, 35 bp, Artificial Sequence
  Synthetic oligonucleotide
ttgcaccgttcccatggtactcgccttttgttgtt

SEQ ID NO: 199878 - DNA, 35 bp, Artificial Sequence
  Synthetic oligonucleotide
agggaaagagaggggcaaagaggggggcgcacaaa

SEQ ID NO: 199879 - DNA, 35 bp, Artificial Sequence
  Synthetic oligonucleotide
acaatgtcggtgggtagggagggttgcatgccgaa

SEQ ID NO: 199880 - DNA, 36 bp, Artificial Sequence
  Synthetic oligonucleotide
tgagcgcatggaggggggggatatagcttggaggaa

SEQ ID NO: 199881 - DNA, 35 bp, Artificial Sequence
  Synthetic oligonucleotide
tccctcaccaccgacgcgtacattgcgaaatggaa

SEQ ID NO: 199882 - DNA, 35 bp, Artificial Sequence
  Synthetic oligonucleotide
taggaggagggtggggttattgggaccagtataca

SEQ ID NO: 199883 - DNA, 35 bp, Artificial Sequence
  Synthetic oligonucleotide
ttgcccacgcaacgattgtccgatcctccgttaca

SEQ ID NO: 199884 - DNA, 35 bp, Artificial Sequence
  Synthetic oligonucleotide
tcgatgcctcgccccacgatccgattaggttgcca

SEQ ID NO: 199885 - DNA, 35 bp, Artificial Sequence
  Synthetic oligonucleotide
tcatgcacacgggatcggtttttatcgccactcca

SEQ ID NO: 199886 - DNA, 36 bp, Artificial Sequence
  Synthetic oligonucleotide
agcccagctcgtctccctgcttcttcaccaaatgca

SEQ ID NO: 199887 - DNA, 36 bp, Artificial Sequence
  Synthetic oligonucleotide
accaaagggaggggagtggaaggcggcctgaatgca

SEQ ID NO: 199888 - DNA, 36 bp, Artificial Sequence
  Synthetic oligonucleotide
atccactccaaccatctccgattcgtgcactttgca

SEQ ID NO: 199889 - DNA, 35 bp, Artificial Sequence
  Synthetic oligonucleotide
tagtccgttggcctgcttgctctatagtttcatca

SEQ ID NO: 199890 - DNA, 37 bp, Artificial Sequence
  Synthetic oligonucleotide
gagacgaagggttagaagggctgcaaaagggcacaga

SEQ ID NO: 199891 - DNA, 37 bp, Artificial Sequence
  Synthetic oligonucleotide
gatggtagacgatgggaagggaagaatcgtggggaga

SEQ ID NO: 199892 - DNA, 35 bp, Artificial Sequence
  Synthetic oligonucleotide
ggaacggaaggcagataggggtggggctgctgaga

SEQ ID NO: 199893 - DNA, 37 bp, Artificial Sequence
  Synthetic oligonucleotide
ttcaaatcgccgatttgcctaacgtaccttccctaga

SEQ ID NO: 199894 - DNA, 37 bp, Artificial Sequence
  Synthetic oligonucleotide
agacaagggctcggaactgggaagggaatgggttaga

SEQ ID NO: 199895 - DNA, 37 bp, Artificial Sequence
  Synthetic oligonucleotide
gtggtggagaggggacgggtgtgatagttggttgcga

SEQ ID NO: 199896 - DNA, 37 bp, Artificial Sequence
  Synthetic oligonucleotide
acgcccatcaccttcgttagccaccgtccctgctcga

SEQ ID NO: 199897 - DNA, 37 bp, Artificial Sequence
  Synthetic oligonucleotide
gacgccaaaggagcgaatcggagagggaaatgaagga

SEQ ID NO: 199898 - DNA, 37 bp, Artificial Sequence
  Synthetic oligonucleotide
tgtccccgcacagacatgttcttcctctccgtacgga

SEQ ID NO: 199899 - DNA, 37 bp, Artificial Sequence
  Synthetic oligonucleotide
taacgacggccatggttatgcgttctctctcttcgga

SEQ ID NO: 199900 - DNA, 36 bp, Artificial Sequence
  Synthetic oligonucleotide
gtgggaggcaaaagacagggagggggtcataaggga

SEQ ID NO: 199901 - DNA, 35 bp, Artificial Sequence
  Synthetic oligonucleotide
aatgcgtggaagggttagggacgcatgcagaggga

SEQ ID NO: 199902 - DNA, 37 bp, Artificial Sequence
  Synthetic oligonucleotide
gccggtggtaggaagtagagggacgggataaacggga

SEQ ID NO: 199903 - DNA, 37 bp, Artificial Sequence
  Synthetic oligonucleotide
gtcatgggcggagatagatgggtggggtagggctgga

SEQ ID NO: 199904 - DNA, 37 bp, Artificial Sequence
  Synthetic oligonucleotide
ataaccgcggaagattgttttgccgctcccttcctga

SEQ ID NO: 199905 - DNA, 37 bp, Artificial Sequence
  Synthetic oligonucleotide
gccaactgcagccttctatacttttcgcgcctgctga

SEQ ID NO: 199906 - DNA, 38 bp, Artificial Sequence
  Synthetic oligonucleotide
tacgccacgctcactgttgttattttccaccgctctga

SEQ ID NO: 199907 - DNA, 38 bp, Artificial Sequence
  Synthetic oligonucleotide
gccaagtcacaaggaaaaatgggggcatggaagggtga

SEQ ID NO: 199908 - DNA, 37 bp, Artificial Sequence
  Synthetic oligonucleotide
agtgtcaccccctcttatgctatcgtacatcacttga

SEQ ID NO: 199909 - DNA, 35 bp, Artificial Sequence
  Synthetic oligonucleotide
accacactctgccctaatcggacgcctgatcttga

SEQ ID NO: 199910 - DNA, 36 bp, Artificial Sequence
  Synthetic oligonucleotide
aactgccaccccctcaactggaccatatgcagtcta

SEQ ID NO: 199911 - DNA, 36 bp, Artificial Sequence
  Synthetic oligonucleotide
tcatgagcccatttgtacttgcccttaactatcgta

SEQ ID NO: 199912 - DNA, 36 bp, Artificial Sequence
  Synthetic oligonucleotide
tccaccttcgctcctcgtaataatcgcacttatgta

SEQ ID NO: 199913 - DNA, 35 bp, Artificial Sequence
  Synthetic oligonucleotide
tcaccgcacagtgtaccctccgcctgctacagcac

SEQ ID NO: 199914 - DNA, 35 bp, Artificial Sequence
  Synthetic oligonucleotide
tcaatcagcttcagcgctccataagctccccgcac

SEQ ID NO: 199915 - DNA, 35 bp, Artificial Sequence
  Synthetic oligonucleotide
gtggggggctcagttggagggggaggaggtggcac

SEQ ID NO: 199916 - DNA, 35 bp, Artificial Sequence
  Synthetic oligonucleotide
gggaccacgcccccacctgttttatccgctctcac

SEQ ID NO: 199917 - DNA, 35 bp, Artificial Sequence
  Synthetic oligonucleotide
gcctgtccggcgaagtgcatttattctccgtgccc

SEQ ID NO: 199918 - DNA, 35 bp, Artificial Sequence
  Synthetic oligonucleotide
ggtcaccttcctccctgactcgttatcctgccgcc

SEQ ID NO: 199919 - DNA, 35 bp, Artificial Sequence
  Synthetic oligonucleotide
tgcacccgtacttggttcgcctgacgttcttcgcc

SEQ ID NO: 199920 - DNA, 35 bp, Artificial Sequence
  Synthetic oligonucleotide
acaccacctcaccatctgtgcttcttaccatggcc

SEQ ID NO: 199921 - DNA, 35 bp, Artificial Sequence
  Synthetic oligonucleotide
gttgcccatgcccccgaggtcttatcgactcatcc

SEQ ID NO: 199922 - DNA, 35 bp, Artificial Sequence
  Synthetic oligonucleotide
gtgacggcgctcaactgcttattcccgtcccctcc

SEQ ID NO: 199923 - DNA, 35 bp, Artificial Sequence
  Synthetic oligonucleotide
gcctacgcccccgctgtaagaatcgatcccattcc

SEQ ID NO: 199924 - DNA, 34 bp, Artificial Sequence
  Synthetic oligonucleotide
tcacacgtagtgtccctcccagctggtcttttcc

SEQ ID NO: 199925 - DNA, 35 bp, Artificial Sequence
  Synthetic oligonucleotide
attgcccctcacgaaggttatttccgcttaaacgc

SEQ ID NO: 199926 - DNA, 35 bp, Artificial Sequence
  Synthetic oligonucleotide
gtggaccgtctgcaaacaccacgctccttacccgc

SEQ ID NO: 199927 - DNA, 35 bp, Artificial Sequence
  Synthetic oligonucleotide
agttcccgcacacgtgtctttgccttttcctccgc

SEQ ID NO: 199928 - DNA, 35 bp, Artificial Sequence
  Synthetic oligonucleotide
agatgcccgcccgagtaaactaccggccttcctgc

SEQ ID NO: 199929 - DNA, 35 bp, Artificial Sequence
  Synthetic oligonucleotide
ttgtaacgtcacagaaccaagcctccatccgttgc

SEQ ID NO: 199930 - DNA, 35 bp, Artificial Sequence
  Synthetic oligonucleotide
acaaccgcacccaccgcctcgtccgtctattttgc

SEQ ID NO: 199931 - DNA, 35 bp, Artificial Sequence
  Synthetic oligonucleotide
gattcaggggacgaaggaggggccgaagggagatc

SEQ ID NO: 199932 - DNA, 35 bp, Artificial Sequence
  Synthetic oligonucleotide
atcgcccggtaggcggaaactcgacctaatttctc

SEQ ID NO: 199933 - DNA, 35 bp, Artificial Sequence
  Synthetic oligonucleotide
gcggatccgcgtttgttgtctctttcgtcctggtc

SEQ ID NO: 199934 - DNA, 35 bp, Artificial Sequence
  Synthetic oligonucleotide
aacaccctcacccttttttgcgcccgacgctggtc

SEQ ID NO: 199935 - DNA, 36 bp, Artificial Sequence
  Synthetic oligonucleotide
tacgcccgagttcagcgcgtttaccatccttccttc

SEQ ID NO: 199936 - DNA, 35 bp, Artificial Sequence
  Synthetic oligonucleotide
gagtcaatggtgcgggggggacagggagaaactag

SEQ ID NO: 199937 - DNA, 35 bp, Artificial Sequence
  Synthetic oligonucleotide
atccaccacattttgcacccggcccatccgtgacg

SEQ ID NO: 199938 - DNA, 35 bp, Artificial Sequence
  Synthetic oligonucleotide
accttcccgccgttcgccatgttcattcgtttccg

SEQ ID NO: 199939 - DNA, 35 bp, Artificial Sequence
  Synthetic oligonucleotide
tattctcgccatcattttctttcagtcaccccggg

SEQ ID NO: 199940 - DNA, 35 bp, Artificial Sequence
  Synthetic oligonucleotide
agagcacgtagagggggttaatggtggtggagtgg

SEQ ID NO: 199941 - DNA, 37 bp, Artificial Sequence
  Synthetic oligonucleotide
atgatgaacaggggggaaacgtgaagatcatgagatg

SEQ ID NO: 199942 - DNA, 35 bp, Artificial Sequence
  Synthetic oligonucleotide
gcccgggccgtattcctccaacctgtctgtccttg

SEQ ID NO: 199943 - DNA, 35 bp, Artificial Sequence
  Synthetic oligonucleotide
gttcacgccgactgccctcgcctcctggattcttg

SEQ ID NO: 199944 - DNA, 35 bp, Artificial Sequence
  Synthetic oligonucleotide
gccccccgcctcccatcgtcttaagcaggcggttg

SEQ ID NO: 199945 - DNA, 35 bp, Artificial Sequence
  Synthetic oligonucleotide
atgtagcgcaacgggtagatggagtgggcgtagat

SEQ ID NO: 199946 - DNA, 35 bp, Artificial Sequence
  Synthetic oligonucleotide
accctcctccctgcagcccgcctcggcaccccgat

SEQ ID NO: 199947 - DNA, 35 bp, Artificial Sequence
  Synthetic oligonucleotide
agatggtccacagtgtcatcgtcttgttcccctat

SEQ ID NO: 199948 - DNA, 35 bp, Artificial Sequence
  Synthetic oligonucleotide
acaccactcccccgcgtgattacgcaccctgtact

SEQ ID NO: 199949 - DNA, 35 bp, Artificial Sequence
  Synthetic oligonucleotide
agcgccctcccagtttactaacccaagttttacct

SEQ ID NO: 199950 - DNA, 35 bp, Artificial Sequence
  Synthetic oligonucleotide
ttcaccacctgccgtgttctcgttcgggtacccct

SEQ ID NO: 199951 - DNA, 35 bp, Artificial Sequence
  Synthetic oligonucleotide
gacagcagaagggggagcaaatgggccgagggagt

SEQ ID NO: 199952 - DNA, 35 bp, Artificial Sequence
  Synthetic oligonucleotide
gggacgacactatgatatgccctaccattccctgt

SEQ ID NO: 199953 - DNA, 35 bp, Artificial Sequence
  Synthetic oligonucleotide
tcccaggcggtccgcactctgtccacattccttgt

SEQ ID NO: 199954 - DNA, 35 bp, Artificial Sequence
  Synthetic oligonucleotide
gtgcgcacaagaccttcaccttgccttcgataatt

SEQ ID NO: 199955 - DNA, 35 bp, Artificial Sequence
  Synthetic oligonucleotide
tcacgcggtctcccctgttctgctctggtctactt

SEQ ID NO: 199956 - DNA, 35 bp, Artificial Sequence
  Synthetic oligonucleotide
gctctggcgcagataatctattcagtccctctctt

SEQ ID NO: 199957 - DNA, 35 bp, Artificial Sequence
  Synthetic oligonucleotide
actgcccagtcctctatccagtctttgcgaccgtt

SEQ ID NO: 199958 - DNA, 35 bp, Artificial Sequence
  Synthetic oligonucleotide
gcatccccccctctgctatttatccttggactttt

SEQ ID NO: 199959 - DNA, 36 bp, Artificial Sequence
  Synthetic oligonucleotide
atcgcctcaccaattgtactttcgcatttgccttaa

SEQ ID NO: 199960 - DNA, 36 bp, Artificial Sequence
  Synthetic oligonucleotide
gagtgtcccggtccgctggcttcactgtacccatca

SEQ ID NO: 199961 - DNA, 36 bp, Artificial Sequence
  Synthetic oligonucleotide
cccgcccccccgactgcgctcgccatgcaatcctca

SEQ ID NO: 199962 - DNA, 35 bp, Artificial Sequence
  Synthetic oligonucleotide
gacaggaggcactgttcctagccgttttttcctca

SEQ ID NO: 199963 - DNA, 35 bp, Artificial Sequence
  Synthetic oligonucleotide
tcaccaccgcgatgttaccggtgccccgtccttca

SEQ ID NO: 199964 - DNA, 37 bp, Artificial Sequence
  Synthetic oligonucleotide
atcacatcagggcgggcggtgaggggcatcgatacga

SEQ ID NO: 199965 - DNA, 37 bp, Artificial Sequence
  Synthetic oligonucleotide
taccccctcccgatcggttcttgagcagccgaaccga

SEQ ID NO: 199966 - DNA, 37 bp, Artificial Sequence
  Synthetic oligonucleotide
agcccggaggttgcggggatggatgggtggaatccga

SEQ ID NO: 199967 - DNA, 36 bp, Artificial Sequence
  Synthetic oligonucleotide
tgaaggtgagggtggcacgaaaagctagaggagcga

SEQ ID NO: 199968 - DNA, 36 bp, Artificial Sequence
  Synthetic oligonucleotide
gtggggggagaaaatggggtccggagactatggcga

SEQ ID NO: 199969 - DNA, 37 bp, Artificial Sequence
  Synthetic oligonucleotide
ttcgccactacctctgcctgtactcaatgcctctcga

SEQ ID NO: 199970 - DNA, 37 bp, Artificial Sequence
  Synthetic oligonucleotide
gccgacgggtggtaaggggaagggcgatcgggttcga

SEQ ID NO: 199971 - DNA, 37 bp, Artificial Sequence
  Synthetic oligonucleotide
gcaggggccggggggaatgacagacgggtgcaacgga

SEQ ID NO: 199972 - DNA, 36 bp, Artificial Sequence
  Synthetic oligonucleotide
gaagtgcctaggggtgtaagcgggaaggggaaggga

SEQ ID NO: 199973 - DNA, 37 bp, Artificial Sequence
  Synthetic oligonucleotide
gggagacaggaggatgcggggggcggggtggatggga

SEQ ID NO: 199974 - DNA, 37 bp, Artificial Sequence
  Synthetic oligonucleotide
gtctgagaggaggtaagggcaaacgtggagggtggga

SEQ ID NO: 199975 - DNA, 37 bp, Artificial Sequence
  Synthetic oligonucleotide
atgtcgcaagagacattgaacaagagggcgggtggga

SEQ ID NO: 199976 - DNA, 38 bp, Artificial Sequence
  Synthetic oligonucleotide
tgtggcccgcaaccatctatccggcctgttttgaatga

SEQ ID NO: 199977 - DNA, 38 bp, Artificial Sequence
  Synthetic oligonucleotide
ttactgacatcagtgcgctccatccatcactacgctga

SEQ ID NO: 199978 - DNA, 35 bp, Artificial Sequence
  Synthetic oligonucleotide
ttggccccacaatgccatctctgccgatcgttcta

SEQ ID NO: 199979 - DNA, 36 bp, Artificial Sequence
  Synthetic oligonucleotide
gaagggatgaggatcgagggcaaaggagtcggggta

SEQ ID NO: 199980 - DNA, 35 bp, Artificial Sequence
  Synthetic oligonucleotide
atgcccacccgccgagcctgaaacagtatgcctta

SEQ ID NO: 199981 - DNA, 35 bp, Artificial Sequence
  Synthetic oligonucleotide
aagctacaggcagggaggtgaaggggtggctgtta

SEQ ID NO: 199982 - DNA, 35 bp, Artificial Sequence
  Synthetic oligonucleotide
acatgctccgaccctgcgacaagttcagtccctac

SEQ ID NO: 199983 - DNA, 35 bp, Artificial Sequence
  Synthetic oligonucleotide
gagtaactggaggaagtggagggggcagtcggtac

SEQ ID NO: 199984 - DNA, 35 bp, Artificial Sequence
  Synthetic oligonucleotide
gcatgtgcccagtcggtcgtccacttttacacacc

SEQ ID NO: 199985 - DNA, 35 bp, Artificial Sequence
  Synthetic oligonucleotide
gagtgcatctcactgctttgtttcgtggttcgccc

SEQ ID NO: 199986 - DNA, 35 bp, Artificial Sequence
  Synthetic oligonucleotide
gcctcgtatccgtcttatagcatggttcacctccc

SEQ ID NO: 199987 - DNA, 35 bp, Artificial Sequence
  Synthetic oligonucleotide
acacaacgtctagttactctatgatcctttccgcc

SEQ ID NO: 199988 - DNA, 35 bp, Artificial Sequence
  Synthetic oligonucleotide
aagtcagtagccagcccgcagcacccctccgcgcc

SEQ ID NO: 199989 - DNA, 35 bp, Artificial Sequence
  Synthetic oligonucleotide
gactgcaggaccccatcatatgcctactctcgtcc

SEQ ID NO: 199990 - DNA, 35 bp, Artificial Sequence
  Synthetic oligonucleotide
tagcatggtcgaccttcccgttagtgctgccttcc

SEQ ID NO: 199991 - DNA, 35 bp, Artificial Sequence
  Synthetic oligonucleotide
ttagcgctgacctctccgaccattacgtgccttcc

SEQ ID NO: 199992 - DNA, 35 bp, Artificial Sequence
  Synthetic oligonucleotide
tcgaaggtgtcgctctctgtattcaccgtcgttcc

SEQ ID NO: 199993 - DNA, 35 bp, Artificial Sequence
  Synthetic oligonucleotide
gatgctggttccgtcccaccagtcgcctctgccgc

SEQ ID NO: 199994 - DNA, 35 bp, Artificial Sequence
  Synthetic oligonucleotide
tgtgtgcgaactacgttttttgcctaactgtcatc

SEQ ID NO: 199995 - DNA, 35 bp, Artificial Sequence
  Synthetic oligonucleotide
gtcaacagtccgctattcttacccagttgttgctc

SEQ ID NO: 199996 - DNA, 35 bp, Artificial Sequence
  Synthetic oligonucleotide
gcaggcgctgcatccacactaccggctccttggtc

SEQ ID NO: 199997 - DNA, 35 bp, Artificial Sequence
  Synthetic oligonucleotide
ttatcaccacagatccgtcgctcctcccccttgtc

SEQ ID NO: 199998 - DNA, 35 bp, Artificial Sequence
  Synthetic oligonucleotide
aacgcagtccactgcacgagttcccatgtcccttc

SEQ ID NO: 199999 - DNA, 35 bp, Artificial Sequence
  Synthetic oligonucleotide
accttgcaaggagggtgggagcgaggatgaagcag

SEQ ID NO: 200000 - DNA, 35 bp, Artificial Sequence
  Synthetic oligonucleotide
tgtaccgcctatgctcgaatcagcccgctccaccg

SEQ ID NO: 200001 - DNA, 35 bp, Artificial Sequence
  Synthetic oligonucleotide
ggtaggggcggaggaggacacgtcagattttaccg

SEQ ID NO: 200002 - DNA, 35 bp, Artificial Sequence
  Synthetic oligonucleotide
tatatgtacagcacccgtcacctccgccattgccg

SEQ ID NO: 200003 - DNA, 33 bp, Artificial Sequence
  Synthetic oligonucleotide
gtatgggatggaatgcgtagggggagaaggtcg

SEQ ID NO: 200004 - DNA, 35 bp, Artificial Sequence
  Synthetic oligonucleotide
tgacggtggtgagggctaaggggagggtggaaagg

SEQ ID NO: 200005 - DNA, 35 bp, Artificial Sequence
  Synthetic oligonucleotide
tgagagacaggaggtagatattgaccgggagaagg

SEQ ID NO: 200006 - DNA, 35 bp, Artificial Sequence
  Synthetic oligonucleotide
acacccgggccacctggtaatttactgccttccgg

SEQ ID NO: 200007 - DNA, 35 bp, Artificial Sequence
  Synthetic oligonucleotide
atcacacccaaagcaagcgtcaagggaaggaaggg

SEQ ID NO: 200008 - DNA, 35 bp, Artificial Sequence
  Synthetic oligonucleotide
agtggagaggagcgtgcgggggcgaagaatttggg

SEQ ID NO: 200009 - DNA, 35 bp, Artificial Sequence
  Synthetic oligonucleotide
tgaggaaggccaagagggagatgggttgcgtaatg

SEQ ID NO: 200010 - DNA, 35 bp, Artificial Sequence
  Synthetic oligonucleotide
tacgccctcgttgcaccagttaacccgccactctg

SEQ ID NO: 200011 - DNA, 35 bp, Artificial Sequence
  Synthetic oligonucleotide
tcataccaggcgtcttgttggctacatcccctctg

SEQ ID NO: 200012 - DNA, 35 bp, Artificial Sequence
  Synthetic oligonucleotide
taccaaccgtgcatttggtcatcccgcctgaacat

SEQ ID NO: 200013 - DNA, 35 bp, Artificial Sequence
  Synthetic oligonucleotide
gacatgagggccggtggggcaagaagcgaggggat

SEQ ID NO: 200014 - DNA, 35 bp, Artificial Sequence
  Synthetic oligonucleotide
tcaacctccaacccgtgaaacgacctgatccctat

SEQ ID NO: 200015 - DNA, 35 bp, Artificial Sequence
  Synthetic oligonucleotide
tagtgctatgcgtacggatgacccgtcgcgcccct

SEQ ID NO: 200016 - DNA, 35 bp, Artificial Sequence
  Synthetic oligonucleotide
agtcccatccgacctttttcatagtgtccttgcct

SEQ ID NO: 200017 - DNA, 35 bp, Artificial Sequence
  Synthetic oligonucleotide
gtacgcactagtattccgtcttagctccgttttct

SEQ ID NO: 200018 - DNA, 35 bp, Artificial Sequence
  Synthetic oligonucleotide
ggggagtgggtggttgggatatgaagcaaaaaggt

SEQ ID NO: 200019 - DNA, 35 bp, Artificial Sequence
  Synthetic oligonucleotide
gaaagcagggggggcgaggttgtgcagtgtgatgt

SEQ ID NO: 200020 - DNA, 35 bp, Artificial Sequence
  Synthetic oligonucleotide
acacactctccctcgcctatttacagtcagacatt

SEQ ID NO: 200021 - DNA, 35 bp, Artificial Sequence
  Synthetic oligonucleotide
gcccggtgtcactttcgctacaggccgggttcctt

SEQ ID NO: 200022 - DNA, 35 bp, Artificial Sequence
  Synthetic oligonucleotide
gagaccgccttcctcccagaggccctcacatggtt

SEQ ID NO: 200023 - DNA, 35 bp, Artificial Sequence
  Synthetic oligonucleotide
aagtacgacgcccatgacgctatcttctctcgttt

SEQ ID NO: 200024 - DNA, 36 bp, Artificial Sequence
  Synthetic oligonucleotide
gactgcccgtccatttgttttaccctgtggtcccaa

SEQ ID NO: 200025 - DNA, 36 bp, Artificial Sequence
  Synthetic oligonucleotide
gagtaacgtgagggaaggcagtgagggtacggcgaa

SEQ ID NO: 200026 - DNA, 36 bp, Artificial Sequence
  Synthetic oligonucleotide
atgtagacgaatgggggcggtggtgaacgtggcgaa

SEQ ID NO: 200027 - DNA, 36 bp, Artificial Sequence
  Synthetic oligonucleotide
gaacacccaacggtctttatgttcacttcccctgaa

SEQ ID NO: 200028 - DNA, 36 bp, Artificial Sequence
  Synthetic oligonucleotide
actccccccctctgtgatgataagacccacgctgaa

SEQ ID NO: 200029 - DNA, 35 bp, Artificial Sequence
  Synthetic oligonucleotide
tctcactgcgtccctatccgtcctgtttcctctaa

SEQ ID NO: 200030 - DNA, 36 bp, Artificial Sequence
  Synthetic oligonucleotide
aatgcgccggagatatgggtgggaagggtcgggaca

SEQ ID NO: 200031 - DNA, 36 bp, Artificial Sequence
  Synthetic oligonucleotide
acgtgacgggcggctagtattcgttgtcccatccca

SEQ ID NO: 200032 - DNA, 36 bp, Artificial Sequence
  Synthetic oligonucleotide
tgcccgccatccactaatccatttgccccgttgcca

SEQ ID NO: 200033 - DNA, 36 bp, Artificial Sequence
  Synthetic oligonucleotide
tgtgcggatggagggggaggggcagaacgcggtcca

SEQ ID NO: 200034 - DNA, 36 bp, Artificial Sequence
  Synthetic oligonucleotide
gcgcacgagcatcttctctgtacttactcatccgca

SEQ ID NO: 200035 - DNA, 36 bp, Artificial Sequence
  Synthetic oligonucleotide
tggagggaaagcaaggggccgagggagggttcatca

SEQ ID NO: 200036 - DNA, 37 bp, Artificial Sequence
  Synthetic oligonucleotide
gagcaaggaagggaggtcgggacaatgccgggacaga

SEQ ID NO: 200037 - DNA, 37 bp, Artificial Sequence
  Synthetic oligonucleotide
gctggggggggaggggacacacggggctcgccctaga

SEQ ID NO: 200038 - DNA, 37 bp, Artificial Sequence
  Synthetic oligonucleotide
tcctccaccatcattgtgtcagctacgccagacacga

SEQ ID NO: 200039 - DNA, 37 bp, Artificial Sequence
  Synthetic oligonucleotide
gtaccaccttccgctcgtgctagattccttcgtacga

SEQ ID NO: 200040 - DNA, 37 bp, Artificial Sequence
  Synthetic oligonucleotide
tcatacggggtgggaactaaggaggaggaaagtgcga

SEQ ID NO: 200041 - DNA, 37 bp, Artificial Sequence
  Synthetic oligonucleotide
tcctgcctcaccgcgttactgcacgtattttgctcga

SEQ ID NO: 200042 - DNA, 35 bp, Artificial Sequence
  Synthetic oligonucleotide
taggtagaggggggaggagaaatacgcgctaagga

SEQ ID NO: 200043 - DNA, 36 bp, Artificial Sequence
  Synthetic oligonucleotide
taccgggcaagatacggggatagacggggaggagga

SEQ ID NO: 200044 - DNA, 38 bp, Artificial Sequence
  Synthetic oligonucleotide
tcagaggggacggataggggatgggtgaaaacgaatga

SEQ ID NO: 200045 - DNA, 36 bp, Artificial Sequence
  Synthetic oligonucleotide
tgtcacctccctgccacgatcccgccgacgccctga

SEQ ID NO: 200046 - DNA, 38 bp, Artificial Sequence
  Synthetic oligonucleotide
gaacgctagcataaggacggggggcggttggagggtga

SEQ ID NO: 200047 - DNA, 36 bp, Artificial Sequence
  Synthetic oligonucleotide
tatgcgtacggggggtaaagggggagctaaacaata

SEQ ID NO: 200048 - DNA, 36 bp, Artificial Sequence
  Synthetic oligonucleotide
ttcactgctgtcccgttcgtcgtccctacttaccta

SEQ ID NO: 200049 - DNA, 36 bp, Artificial Sequence
  Synthetic oligonucleotide
acacgtccctgcctcctgtctctgtctcctgagcta

SEQ ID NO: 200050 - DNA, 36 bp, Artificial Sequence
  Synthetic oligonucleotide
ggagccatcattgccgatcttacaactatccccgta

SEQ ID NO: 200051 - DNA, 36 bp, Artificial Sequence
  Synthetic oligonucleotide
gtcagggagggagggaggtgacaactgttgctcgta

SEQ ID NO: 200052 - DNA, 36 bp, Artificial Sequence
  Synthetic oligonucleotide
gccatcccgcccgagttatgctcctgttgacctgta

SEQ ID NO: 200053 - DNA, 35 bp, Artificial Sequence
  Synthetic oligonucleotide
tgcccgattaggtctctctctttgtctcgccatta

SEQ ID NO: 200054 - DNA, 36 bp, Artificial Sequence
  Synthetic oligonucleotide
ttgtcgccagacggtatgccttctactttcccttta

SEQ ID NO: 200055 - DNA, 35 bp, Artificial Sequence
  Synthetic oligonucleotide
acccatggttcgcatatgcatcaagccgccttaac

SEQ ID NO: 200056 - DNA, 35 bp, Artificial Sequence
  Synthetic oligonucleotide
tatgacggtcagtatctgttctcttcgtgtcctac

SEQ ID NO: 200057 - DNA, 35 bp, Artificial Sequence
  Synthetic oligonucleotide
acaacgttgacttagcgcgacctcctgtgccaccc

SEQ ID NO: 200058 - DNA, 35 bp, Artificial Sequence
  Synthetic oligonucleotide
atcgcgaagctggccgagccggtcactgcactccc

SEQ ID NO: 200059 - DNA, 35 bp, Artificial Sequence
  Synthetic oligonucleotide
taaccacgccgtcctatcggtctgatccggctccc

SEQ ID NO: 200060 - DNA, 35 bp, Artificial Sequence
  Synthetic oligonucleotide
ttggcacatttcatgctacccgccacggtattccc

SEQ ID NO: 200061 - DNA, 35 bp, Artificial Sequence
  Synthetic oligonucleotide
tgtggcccccgaaatgttttctcgcccgtaccgcc

SEQ ID NO: 200062 - DNA, 35 bp, Artificial Sequence
  Synthetic oligonucleotide
tttggcccccgaactgttttctcgcccgtaccgcc

SEQ ID NO: 200063 - DNA, 35 bp, Artificial Sequence
  Synthetic oligonucleotide
tccacatccgcactgcacagacctcatccccgtcc

SEQ ID NO: 200064 - DNA, 35 bp, Artificial Sequence
  Synthetic oligonucleotide
ttaggcacccgcccccttgcggcactggaccttcc

SEQ ID NO: 200065 - DNA, 35 bp, Artificial Sequence
  Synthetic oligonucleotide
gaggccgtgggcagttgctaccgttccatccacgc

SEQ ID NO: 200066 - DNA, 35 bp, Artificial Sequence
  Synthetic oligonucleotide
acgctacgtaccatcctctatagcgaacatacctc

SEQ ID NO: 200067 - DNA, 35 bp, Artificial Sequence
  Synthetic oligonucleotide
gacgggcataatgtattacgcgcacgaacctcctc

SEQ ID NO: 200068 - DNA, 35 bp, Artificial Sequence
  Synthetic oligonucleotide
acacgtgcagcataccttccgtcacttcgcagttc

SEQ ID NO: 200069 - DNA, 35 bp, Artificial Sequence
  Synthetic oligonucleotide
ttgaacagcaagccgtttggttcctttgctctttc

SEQ ID NO: 200070 - DNA, 35 bp, Artificial Sequence
  Synthetic oligonucleotide
ggtgctgaggaacaaaaaagaaaaaggggcaagag

SEQ ID NO: 200071 - DNA, 35 bp, Artificial Sequence
  Synthetic oligonucleotide
tgtacaacaccactcgtaccatgctcttaattgag

SEQ ID NO: 200072 - DNA, 35 bp, Artificial Sequence
  Synthetic oligonucleotide
ggacatgcctccgcacttccttggttacacttacg

SEQ ID NO: 200073 - DNA, 35 bp, Artificial Sequence
  Synthetic oligonucleotide
tccagccggtccgtctctgtttagcttaccgtgcg

SEQ ID NO: 200074 - DNA, 35 bp, Artificial Sequence
  Synthetic oligonucleotide
atgcaagtccgtcgcatttggccctccacacttcg

SEQ ID NO: 200075 - DNA, 35 bp, Artificial Sequence
  Synthetic oligonucleotide
gggtggacaattgggtggaagcgatgtaggaaggg

SEQ ID NO: 200076 - DNA, 35 bp, Artificial Sequence
  Synthetic oligonucleotide
aacacctctcacaggctactcatctggccccattg

SEQ ID NO: 200077 - DNA, 35 bp, Artificial Sequence
  Synthetic oligonucleotide
tagggcccccctgctgtctcccactaagatccttg

SEQ ID NO: 200078 - DNA, 35 bp, Artificial Sequence
  Synthetic oligonucleotide
gatgtaggtgacaaggtggagcaaaatgagggaat

SEQ ID NO: 200079 - DNA, 35 bp, Artificial Sequence
  Synthetic oligonucleotide
atgggagggaggggcgggtacgaggcagggggaat

SEQ ID NO: 200080 - DNA, 35 bp, Artificial Sequence
  Synthetic oligonucleotide
tcctctgccccctatggtggaagcaccttatacct

SEQ ID NO: 200081 - DNA, 35 bp, Artificial Sequence
  Synthetic oligonucleotide
gactgctcaactcttgccacgtatcagccctgcct

SEQ ID NO: 200082 - DNA, 35 bp, Artificial Sequence
  Synthetic oligonucleotide
ttgtgatgccctgtgcttactattcccgtgtgcct

SEQ ID NO: 200083 - DNA, 35 bp, Artificial Sequence
  Synthetic oligonucleotide
tccacgtcccgcgtccgattaggttgctcgatcct

SEQ ID NO: 200084 - DNA, 35 bp, Artificial Sequence
  Synthetic oligonucleotide
tcccgcacgcatgtcccttccctcttaaaggtcct

SEQ ID NO: 200085 - DNA, 35 bp, Artificial Sequence
  Synthetic oligonucleotide
gccacatgccgggtatacctaggcgctgacttcct

SEQ ID NO: 200086 - DNA, 35 bp, Artificial Sequence
  Synthetic oligonucleotide
tcggtcccgccacacggtggtcgctaactcttcct

SEQ ID NO: 200087 - DNA, 35 bp, Artificial Sequence
  Synthetic oligonucleotide
tgccagccccacggtaacggcgctagttccattct

SEQ ID NO: 200088 - DNA, 35 bp, Artificial Sequence
  Synthetic oligonucleotide
tacgtctcgggggggagagaggagcacggaaaggt

SEQ ID NO: 200089 - DNA, 35 bp, Artificial Sequence
  Synthetic oligonucleotide
gccgttctgcaccatcgctcaattggaatccctgt

SEQ ID NO: 200090 - DNA, 35 bp, Artificial Sequence
  Synthetic oligonucleotide
gaccgactgcagctgggttcgtcgcctctgttatt

SEQ ID NO: 200091 - DNA, 35 bp, Artificial Sequence
  Synthetic oligonucleotide
tggagccccagatgaatctcccccactggtccgtt

SEQ ID NO: 200092 - DNA, 35 bp, Artificial Sequence
  Synthetic oligonucleotide
gcacacctcactgtcgatatctcgcccggctattt

SEQ ID NO: 200093 - DNA, 35 bp, Artificial Sequence
  Synthetic oligonucleotide
gaagccgtctcgcacccataaccgactctcgcttt

SEQ ID NO: 200094 - DNA, 35 bp, Artificial Sequence
  Synthetic oligonucleotide
acaaacagggcacggggtactaaggggggggacaa

SEQ ID NO: 200095 - DNA, 35 bp, Artificial Sequence
  Synthetic oligonucleotide
aacatggatcgccgacgccccgccgagtttattaa

SEQ ID NO: 200096 - DNA, 36 bp, Artificial Sequence
  Synthetic oligonucleotide
gatggtcagccactctctcgtctcatctacattcca

SEQ ID NO: 200097 - DNA, 37 bp, Artificial Sequence
  Synthetic oligonucleotide
agtgcggaggcaggaaagggggtggaggaatattaga

SEQ ID NO: 200098 - DNA, 37 bp, Artificial Sequence
  Synthetic oligonucleotide
gcagagatcagaggcgtcataacggaagggaaagcga

SEQ ID NO: 200099 - DNA, 36 bp, Artificial Sequence
  Synthetic oligonucleotide
tgacagacacaggaggaggataaaaagtaagggcga

SEQ ID NO: 200100 - DNA, 37 bp, Artificial Sequence
  Synthetic oligonucleotide
actgtcaccgtgcgatctaactgctacccccttgcga

SEQ ID NO: 200101 - DNA, 37 bp, Artificial Sequence
  Synthetic oligonucleotide
atgctccccattgccgctaaggagcccctgccttcga

SEQ ID NO: 200102 - DNA, 37 bp, Artificial Sequence
  Synthetic oligonucleotide
tccaccgccgatcgtatctttttcatcaccacgcgga

SEQ ID NO: 200103 - DNA, 35 bp, Artificial Sequence
  Synthetic oligonucleotide
gttgtccccccagcctcacagttccaaggaaggga

SEQ ID NO: 200104 - DNA, 37 bp, Artificial Sequence
  Synthetic oligonucleotide
tatcatggagaaggggaagtgcggcataggaagggga

SEQ ID NO: 200105 - DNA, 37 bp, Artificial Sequence
  Synthetic oligonucleotide
aagcaggggtgggagggggaagtgaggagaacgggga

SEQ ID NO: 200106 - DNA, 37 bp, Artificial Sequence
  Synthetic oligonucleotide
aatgagaggaagggataaggggggttaggtgcatgga

SEQ ID NO: 200107 - DNA, 36 bp, Artificial Sequence
  Synthetic oligonucleotide
gcccatgccctcgctccgtgtaacctgcggtttgga

SEQ ID NO: 200108 - DNA, 37 bp, Artificial Sequence
  Synthetic oligonucleotide
gacacccactaccactgctaattacacgtcatcatga

SEQ ID NO: 200109 - DNA, 38 bp, Artificial Sequence
  Synthetic oligonucleotide
atgggagggggcggagctggggaaaagtaagggtatga

SEQ ID NO: 200110 - DNA, 38 bp, Artificial Sequence
  Synthetic oligonucleotide
ggggagggggggctgggctacgttgcaatcagttatga

SEQ ID NO: 200111 - DNA, 38 bp, Artificial Sequence
  Synthetic oligonucleotide
tacaacccacatgagctattgctgccctccgaagctga

SEQ ID NO: 200112 - DNA, 38 bp, Artificial Sequence
  Synthetic oligonucleotide
tgctacgcccgccgaaatccagctgccccttctgctga

SEQ ID NO: 200113 - DNA, 37 bp, Artificial Sequence
  Synthetic oligonucleotide
agagtgtgggagtggggtaaaaggggttggacagtga

SEQ ID NO: 200114 - DNA, 38 bp, Artificial Sequence
  Synthetic oligonucleotide
ggggcggggacagctggggttcaaggtacagggtgtga

SEQ ID NO: 200115 - DNA, 36 bp, Artificial Sequence
  Synthetic oligonucleotide
gagaaacggagggaggggagaagaaatgtaggttga

SEQ ID NO: 200116 - DNA, 36 bp, Artificial Sequence
  Synthetic oligonucleotide
ggatgagggaggaggcaaggaacagttcgggacata

SEQ ID NO: 200117 - DNA, 35 bp, Artificial Sequence
  Synthetic oligonucleotide
gtgtagtacgcccgcgtgtcacctctcttatcata

SEQ ID NO: 200118 - DNA, 36 bp, Artificial Sequence
  Synthetic oligonucleotide
tcaatggggaggagagggtatagggcctcagtcata

SEQ ID NO: 200119 - DNA, 36 bp, Artificial Sequence
  Synthetic oligonucleotide
ttgctacccgctacttgtttcgctcctctgctacta

SEQ ID NO: 200120 - DNA, 35 bp, Artificial Sequence
  Synthetic oligonucleotide
tctccatcccctcaagtatccttaggaaccaccta

SEQ ID NO: 200121 - DNA, 35 bp, Artificial Sequence
  Synthetic oligonucleotide
tcccgtcgaagggtccttacgttacatctttccta

SEQ ID NO: 200122 - DNA, 35 bp, Artificial Sequence
  Synthetic oligonucleotide
taccaccaccacatgagcctactgtccgacatcta

SEQ ID NO: 200123 - DNA, 35 bp, Artificial Sequence
  Synthetic oligonucleotide
gtgccatcgcacgtcctccactcctgccacacgta

SEQ ID NO: 200124 - DNA, 34 bp, Artificial Sequence
  Synthetic oligonucleotide
gatcaacatgtgtatgcctcctcttcccgtcgta

SEQ ID NO: 200125 - DNA, 35 bp, Artificial Sequence
  Synthetic oligonucleotide
acatcctgaccccgagccatccaccacgcattgta

SEQ ID NO: 200126 - DNA, 35 bp, Artificial Sequence
  Synthetic oligonucleotide
tccggaaagcaaccgctgtctactccgccttgtta

SEQ ID NO: 200127 - DNA, 35 bp, Artificial Sequence
  Synthetic oligonucleotide
tttcgatgccatctctcttgtttttcgacttccac

SEQ ID NO: 200128 - DNA, 35 bp, Artificial Sequence
  Synthetic oligonucleotide
acatgacgtgccacctatttacttgtgcccattac

SEQ ID NO: 200129 - DNA, 35 bp, Artificial Sequence
  Synthetic oligonucleotide
tctatcagcatgccaattgcgccgtaactacaacc

SEQ ID NO: 200130 - DNA, 35 bp, Artificial Sequence
  Synthetic oligonucleotide
tgaaagcctcccgttgtttcccccgttgctgtacc

SEQ ID NO: 200131 - DNA, 35 bp, Artificial Sequence
  Synthetic oligonucleotide
agccccagccacacgctcggcacaaaacatttacc

SEQ ID NO: 200132 - DNA, 35 bp, Artificial Sequence
  Synthetic oligonucleotide
tatagcctgctacctgcgtgttcatccttttcccc

SEQ ID NO: 200133 - DNA, 34 bp, Artificial Sequence
  Synthetic oligonucleotide
actgcgcaagcaagattccgcctacgccaggccc

SEQ ID NO: 200134 - DNA, 35 bp, Artificial Sequence
  Synthetic oligonucleotide
tgtggcccccgaactgttttctcgccagtaccgcc

SEQ ID NO: 200135 - DNA, 35 bp, Artificial Sequence
  Synthetic oligonucleotide
tcaccactatcctggtaatttggcctgttctggcc

SEQ ID NO: 200136 - DNA, 35 bp, Artificial Sequence
  Synthetic oligonucleotide
tgtcacggtagcctgcacgtcccatgagcttctcc

SEQ ID NO: 200137 - DNA, 35 bp, Artificial Sequence
  Synthetic oligonucleotide
ttggtggtcccttacgcgtttgatcttcctcccgc

SEQ ID NO: 200138 - DNA, 35 bp, Artificial Sequence
  Synthetic oligonucleotide
gcctatgccacgctcccacattcctaattctccgc

SEQ ID NO: 200139 - DNA, 35 bp, Artificial Sequence
  Synthetic oligonucleotide
tctaggcaccttgtcacttcctttaccccgtatgc

SEQ ID NO: 200140 - DNA, 35 bp, Artificial Sequence
  Synthetic oligonucleotide
gtggccctccgccgcctgcccaaaagcgatgcatc

SEQ ID NO: 200141 - DNA, 35 bp, Artificial Sequence
  Synthetic oligonucleotide
agccccatcctcgccacattacgccaggacttatc

SEQ ID NO: 200142 - DNA, 35 bp, Artificial Sequence
  Synthetic oligonucleotide
tgacgtattcgacatcatctgttcttctgctactc

SEQ ID NO: 200143 - DNA, 35 bp, Artificial Sequence
  Synthetic oligonucleotide
tctgtggacagcctgctcgcgatctattcgccctc

SEQ ID NO: 200144 - DNA, 35 bp, Artificial Sequence
  Synthetic oligonucleotide
aaccggtgggagcacgcgtactaattgtcctcctc

SEQ ID NO: 200145 - DNA, 35 bp, Artificial Sequence
  Synthetic oligonucleotide
gcgtagcaccgccctgcccttcttactgtcttgtc

SEQ ID NO: 200146 - DNA, 35 bp, Artificial Sequence
  Synthetic oligonucleotide
gatctcatacgtcagagaatatccgctccccgttc

SEQ ID NO: 200147 - DNA, 35 bp, Artificial Sequence
  Synthetic oligonucleotide
acgttagcgctcaccgttctatgctcgtcgttttc

SEQ ID NO: 200148 - DNA, 35 bp, Artificial Sequence
  Synthetic oligonucleotide
gaggacggaggttgggatgggaggagcaggggaag

SEQ ID NO: 200149 - DNA, 35 bp, Artificial Sequence
  Synthetic oligonucleotide
gccttccacccccctgccatacgtcccggccacag

SEQ ID NO: 200150 - DNA, 35 bp, Artificial Sequence
  Synthetic oligonucleotide
tgcgcatgtggaggggggaggtataactagggacg

SEQ ID NO: 200151 - DNA, 35 bp, Artificial Sequence
  Synthetic oligonucleotide
acagaaaggggcgatgggtactaatgagggacggg

SEQ ID NO: 200152 - DNA, 35 bp, Artificial Sequence
  Synthetic oligonucleotide
taccgccaacactcgcaccttcaccccctaccggg

SEQ ID NO: 200153 - DNA, 35 bp, Artificial Sequence
  Synthetic oligonucleotide
gtgccgagctcgcaacactccattaacctgccgtg

SEQ ID NO: 200154 - DNA, 35 bp, Artificial Sequence
  Synthetic oligonucleotide
ttgctcccaccagcgcgtagttattcttgctttat

SEQ ID NO: 200155 - DNA, 35 bp, Artificial Sequence
  Synthetic oligonucleotide
actcccgatcgccggtctccgctcgccaccttact

SEQ ID NO: 200156 - DNA, 35 bp, Artificial Sequence
  Synthetic oligonucleotide
agacaacggctggtaggtcggaagggggggaaggt

SEQ ID NO: 200157 - DNA, 35 bp, Artificial Sequence
  Synthetic oligonucleotide
tagtaccatcgctctcttgcacagacggattatgt

SEQ ID NO: 200158 - DNA, 35 bp, Artificial Sequence
  Synthetic oligonucleotide
tccctaccacgcaccgtatttgatcacgaacctgt

SEQ ID NO: 200159 - DNA, 35 bp, Artificial Sequence
  Synthetic oligonucleotide
tgcgatccctgttcgctctgtatcaaccctattgt

SEQ ID NO: 200160 - DNA, 35 bp, Artificial Sequence
  Synthetic oligonucleotide
tgcgacgtccgacgtctccactccctcgttattgt

SEQ ID NO: 200161 - DNA, 35 bp, Artificial Sequence
  Synthetic oligonucleotide
gcgacgcatccgccatgtcttacctgccctacgtt

SEQ ID NO: 200162 - DNA, 35 bp, Artificial Sequence
  Synthetic oligonucleotide
gattgcccattgctcccagcgaacgcgccctcgtt

SEQ ID NO: 200163 - DNA, 35 bp, Artificial Sequence
  Synthetic oligonucleotide
tatcacctcccggcgcatacagagaccctcagaaa

SEQ ID NO: 200164 - DNA, 36 bp, Artificial Sequence
  Synthetic oligonucleotide
gtccacattcccttttgtcatacagacataaaccaa

SEQ ID NO: 200165 - DNA, 36 bp, Artificial Sequence
  Synthetic oligonucleotide
tgcaacgcactcatgccgtttccagccacttagcaa

SEQ ID NO: 200166 - DNA, 36 bp, Artificial Sequence
  Synthetic oligonucleotide
ttcgcgagcacggagggaagtggggaaaggcgagaa

SEQ ID NO: 200167 - DNA, 35 bp, Artificial Sequence
  Synthetic oligonucleotide
atccactggtccgcctccgttgcacgttccatgaa

SEQ ID NO: 200168 - DNA, 36 bp, Artificial Sequence
  Synthetic oligonucleotide
gtgagcaccgagatgggacgggggtggagcttgtaa

SEQ ID NO: 200169 - DNA, 35 bp, Artificial Sequence
  Synthetic oligonucleotide
ttcaacgccacggtctacttacttatgctccaaca

SEQ ID NO: 200170 - DNA, 35 bp, Artificial Sequence
  Synthetic oligonucleotide
gttgccgtaccgtgctatcctcgtttgtttgaaca

SEQ ID NO: 200171 - DNA, 35 bp, Artificial Sequence
  Synthetic oligonucleotide
gtaccctctgtgtcctaatatccttgccttttaca

SEQ ID NO: 200172 - DNA, 36 bp, Artificial Sequence
  Synthetic oligonucleotide
gagtgcgtgctctatttgcacgtttccctgttacca

SEQ ID NO: 200173 - DNA, 36 bp, Artificial Sequence
  Synthetic oligonucleotide
gtcgatgtcacagtcctgttctgccttaaatcccca

SEQ ID NO: 200174 - DNA, 36 bp, Artificial Sequence
  Synthetic oligonucleotide
ttggtgccctcttcagtgtcagtcagaacctccgca

SEQ ID NO: 200175 - DNA, 35 bp, Artificial Sequence
  Synthetic oligonucleotide
acgttcctcaggcctgtcttaaatcgccctcatca

SEQ ID NO: 200176 - DNA, 35 bp, Artificial Sequence
  Synthetic oligonucleotide
ggaggggggaattgtgcgggggtatagcgccgtca

SEQ ID NO: 200177 - DNA, 37 bp, Artificial Sequence
  Synthetic oligonucleotide
gacgatgtgccattggtatccctccgcttactaaaga

SEQ ID NO: 200178 - DNA, 37 bp, Artificial Sequence
  Synthetic oligonucleotide
atgggtggggcggataatgtgcaggcggggtttgaga

SEQ ID NO: 200179 - DNA, 36 bp, Artificial Sequence
  Synthetic oligonucleotide
acctggtgagagttgtgcctcgccgccccctaccga

SEQ ID NO: 200180 - DNA, 35 bp, Artificial Sequence
  Synthetic oligonucleotide
gccggaagaaaagtggggcaaggcgaattggagga

SEQ ID NO: 200181 - DNA, 34 bp, Artificial Sequence
  Synthetic oligonucleotide
actcggctcacccgttatgctaactctctccgga

SEQ ID NO: 200182 - DNA, 37 bp, Artificial Sequence
  Synthetic oligonucleotide
attgcgaggtggatggtggtgcgtgggggggggcgga

SEQ ID NO: 200183 - DNA, 37 bp, Artificial Sequence
  Synthetic oligonucleotide
tgatgggacctgtgggggtaagggtcggtacgaggga

SEQ ID NO: 200184 - DNA, 37 bp, Artificial Sequence
  Synthetic oligonucleotide
gtagcgcaagggcggggatggggacgaaatgagggga

SEQ ID NO: 200185 - DNA, 37 bp, Artificial Sequence
  Synthetic oligonucleotide
ggaggaagagcagaacgggggggggtggcatatggga

SEQ ID NO: 200186 - DNA, 37 bp, Artificial Sequence
  Synthetic oligonucleotide
accgggacgtaggatcgggacgttgggggaaggtgga

SEQ ID NO: 200187 - DNA, 37 bp, Artificial Sequence
  Synthetic oligonucleotide
tacgaagtcgtacggggagaatggggaatgcaaatga

SEQ ID NO: 200188 - DNA, 38 bp, Artificial Sequence
  Synthetic oligonucleotide
ttaccaccgccctgtttttttggcgcacgttcccatga

SEQ ID NO: 200189 - DNA, 38 bp, Artificial Sequence
  Synthetic oligonucleotide
tgtgcgctctcactgaacttctgccgtccgctctatga

SEQ ID NO: 200190 - DNA, 37 bp, Artificial Sequence
  Synthetic oligonucleotide
gtggccgtccatctcctctcagcgtcattactcctga

SEQ ID NO: 200191 - DNA, 36 bp, Artificial Sequence
  Synthetic oligonucleotide
aagagccggaggagggtagtggtggtctaggagtga

SEQ ID NO: 200192 - DNA, 38 bp, Artificial Sequence
  Synthetic oligonucleotide
gtcaaagcaaaggcggagcggagggacagcatgagtga

SEQ ID NO: 200193 - DNA, 37 bp, Artificial Sequence
  Synthetic oligonucleotide
gaacacgtgaaaggagaagggggtcagatctgcgtga

SEQ ID NO: 200194 - DNA, 36 bp, Artificial Sequence
  Synthetic oligonucleotide
tctaatcaggggtgggaggggacagggctccggtga

SEQ ID NO: 200195 - DNA, 38 bp, Artificial Sequence
  Synthetic oligonucleotide
tctgtccgccaaccgtctgtcttattcctccgttttga

SEQ ID NO: 200196 - DNA, 36 bp, Artificial Sequence
  Synthetic oligonucleotide
gacgagtgggccggtcattgcaacatcattttccta

SEQ ID NO: 200197 - DNA, 36 bp, Artificial Sequence
  Synthetic oligonucleotide
gtccgtccccacccagccttgtatagcctttcggta

SEQ ID NO: 200198 - DNA, 35 bp, Artificial Sequence
  Synthetic oligonucleotide
atgcgccgttccggagctgaaaatgcccttccaac

SEQ ID NO: 200199 - DNA, 35 bp, Artificial Sequence
  Synthetic oligonucleotide
ttgcccccccctctgtaggtagccttgtagtggac

SEQ ID NO: 200200 - DNA, 36 bp, Artificial Sequence
  Synthetic oligonucleotide
tcttgccacgagcgctatcgattacgtcctcacccc

SEQ ID NO: 200201 - DNA, 35 bp, Artificial Sequence
  Synthetic oligonucleotide
agtgccaccgcctccggacctgatgatactgtccc

SEQ ID NO: 200202 - DNA, 35 bp, Artificial Sequence
  Synthetic oligonucleotide
tcaacgcgatgttcttttctctccggcgctttccc

SEQ ID NO: 200203 - DNA, 35 bp, Artificial Sequence
  Synthetic oligonucleotide
tgtcttacgcaggtctgtcccgttttgtcctcgcc

SEQ ID NO: 200204 - DNA, 35 bp, Artificial Sequence
  Synthetic oligonucleotide
taccgacctcgcttcaggcctccatacgccacagc

SEQ ID NO: 200205 - DNA, 35 bp, Artificial Sequence
  Synthetic oligonucleotide
tcgcacaatcgcacgccccgtaatggcatctccgc

SEQ ID NO: 200206 - DNA, 35 bp, Artificial Sequence
  Synthetic oligonucleotide
tacgctcgccgtggttctatcttggcatttagcgc

SEQ ID NO: 200207 - DNA, 35 bp, Artificial Sequence
  Synthetic oligonucleotide
tcacgtagctgctcctcgtgattcccgccttcctc

SEQ ID NO: 200208 - DNA, 29 bp, Artificial Sequence
  Synthetic oligonucleotide
acaacgcgcccccgctgcctaccaaattc

SEQ ID NO: 200209 - DNA, 34 bp, Artificial Sequence
  Synthetic oligonucleotide
aaccccacgctcacctgattacatcgctgtcttc

SEQ ID NO: 200210 - DNA, 35 bp, Artificial Sequence
  Synthetic oligonucleotide
tgattcccgcgccccccgtgcttaccacactgttc

SEQ ID NO: 200211 - DNA, 35 bp, Artificial Sequence
  Synthetic oligonucleotide
acgtaccgcctccccctgttctatcaagccagcag

SEQ ID NO: 200212 - DNA, 35 bp, Artificial Sequence
  Synthetic oligonucleotide
gatcccctccgccgtttaccatgaatattgctccg

SEQ ID NO: 200213 - DNA, 35 bp, Artificial Sequence
  Synthetic oligonucleotide
tccgcctcccctcgaaagtttagtcactggcctcg

SEQ ID NO: 200214 - DNA, 35 bp, Artificial Sequence
  Synthetic oligonucleotide
atcggatcgctgctcttttatctggccgcctctcg

SEQ ID NO: 200215 - DNA, 36 bp, Artificial Sequence
  Synthetic oligonucleotide
gaggagaattatggggggttaggatggaccagaggg

SEQ ID NO: 200216 - DNA, 35 bp, Artificial Sequence
  Synthetic oligonucleotide
attgcaacggtctatggaccttctcgccctgcctg

SEQ ID NO: 200217 - DNA, 35 bp, Artificial Sequence
  Synthetic oligonucleotide
ttcacacatcgatcctccagtggtaaccatccttg

SEQ ID NO: 200218 - DNA, 35 bp, Artificial Sequence
  Synthetic oligonucleotide
tgatcaccacccatgcagttcttatctatagtttg

SEQ ID NO: 200219 - DNA, 35 bp, Artificial Sequence
  Synthetic oligonucleotide
ttgtgccgcccccacacgcaagtccatatttacat

SEQ ID NO: 200220 - DNA, 35 bp, Artificial Sequence
  Synthetic oligonucleotide
gtccgaacgtccgcccaatccaccgtgtttcgcat

SEQ ID NO: 200221 - DNA, 35 bp, Artificial Sequence
  Synthetic oligonucleotide
atgggaggggggggcgggtacgaggcagggggcat

SEQ ID NO: 200222 - DNA, 35 bp, Artificial Sequence
  Synthetic oligonucleotide
tgactcccccccatgcggccgcgcttagcctctat

SEQ ID NO: 200223 - DNA, 35 bp, Artificial Sequence
  Synthetic oligonucleotide
atccccccgccatatgaggactattcgtccggcct

SEQ ID NO: 200224 - DNA, 35 bp, Artificial Sequence
  Synthetic oligonucleotide
atcccccgcatacgatatcacacgtctctactcct

SEQ ID NO: 200225 - DNA, 35 bp, Artificial Sequence
  Synthetic oligonucleotide
acatcccgctgttgtgtcgcgagtcaatcccttct

SEQ ID NO: 200226 - DNA, 35 bp, Artificial Sequence
  Synthetic oligonucleotide
atggtggggtaaggggggagggacataagcgacgt

SEQ ID NO: 200227 - DNA, 35 bp, Artificial Sequence
  Synthetic oligonucleotide
tactccatcactctaggactggtcttttcgccctt

SEQ ID NO: 200228 - DNA, 35 bp, Artificial Sequence
  Synthetic oligonucleotide
gccgtatcgctcaactgctatgctccacacgattt

SEQ ID NO: 200229 - DNA, 36 bp, Artificial Sequence
  Synthetic oligonucleotide
atccccgtccacgttcttcgctacatcaggttacaa

SEQ ID NO: 200230 - DNA, 36 bp, Artificial Sequence
  Synthetic oligonucleotide
gtgcatcccacacatgagtccattttcgctattcaa

SEQ ID NO: 200231 - DNA, 36 bp, Artificial Sequence
  Synthetic oligonucleotide
ttgaggccaccggttattagtctttgcgatcccaca

SEQ ID NO: 200232 - DNA, 36 bp, Artificial Sequence
  Synthetic oligonucleotide
tgcaacgcacagtcgttgccttccgtttacatcaca

SEQ ID NO: 200233 - DNA, 36 bp, Artificial Sequence
  Synthetic oligonucleotide
atggtccgcttgcatcgtatgtttccgccgccgcca

SEQ ID NO: 200234 - DNA, 36 bp, Artificial Sequence
  Synthetic oligonucleotide
aactcatgtcggaggagggggtcctgggtggtggca

SEQ ID NO: 200235 - DNA, 35 bp, Artificial Sequence
  Synthetic oligonucleotide
acccccaccgtcctttgattccgcgacgcaatgca

SEQ ID NO: 200236 - DNA, 35 bp, Artificial Sequence
  Synthetic oligonucleotide
gtactagccctcgccacatttcctttgagccctca

SEQ ID NO: 200237 - DNA, 35 bp, Artificial Sequence
  Synthetic oligonucleotide
tcagctgcgctcatgccgttgtcgcctcccattca

SEQ ID NO: 200238 - DNA, 36 bp, Artificial Sequence
  Synthetic oligonucleotide
aatgcagatcgcccacgcgctatttccggtccttca

SEQ ID NO: 200239 - DNA, 36 bp, Artificial Sequence
  Synthetic oligonucleotide
acacacacaatctgaacgatacaagccctccgttca

SEQ ID NO: 200240 - DNA, 35 bp, Artificial Sequence
  Synthetic oligonucleotide
gcagggggggaggggaatcagtgtgtaggcaacga

SEQ ID NO: 200241 - DNA, 37 bp, Artificial Sequence
  Synthetic oligonucleotide
gacgtctcggaagggcaataggagggagggtccacga

SEQ ID NO: 200242 - DNA, 37 bp, Artificial Sequence
  Synthetic oligonucleotide
agtgaaggtggcggaggggctgtttcggacggcacga

SEQ ID NO: 200243 - DNA, 37 bp, Artificial Sequence
  Synthetic oligonucleotide
atggagggaaggggaaggtgggagtatctcggcacga

SEQ ID NO: 200244 - DNA, 37 bp, Artificial Sequence
  Synthetic oligonucleotide
gtgcctccctgtgtatccgttctccttcgcaccccga

SEQ ID NO: 200245 - DNA, 37 bp, Artificial Sequence
  Synthetic oligonucleotide
gagggggggagtacgaggggtttatgaatggccagga

SEQ ID NO: 200246 - DNA, 37 bp, Artificial Sequence
  Synthetic oligonucleotide
tcctgcccctttcactgccttgtttaccattcacgga

SEQ ID NO: 200247 - DNA, 36 bp, Artificial Sequence
  Synthetic oligonucleotide
tcgggacgaaacgggaggggaaagaacgacaaggga

SEQ ID NO: 200248 - DNA, 37 bp, Artificial Sequence
  Synthetic oligonucleotide
tcgcggtacaacagggggggcgtaatggggggaggga

SEQ ID NO: 200249 - DNA, 37 bp, Artificial Sequence
  Synthetic oligonucleotide
tatcgaatgacgtgggctaagtgatggggtctgggga

SEQ ID NO: 200250 - DNA, 36 bp, Artificial Sequence
  Synthetic oligonucleotide
ttgccgcaatcagtttctatcctcgcgttgccctga

SEQ ID NO: 200251 - DNA, 38 bp, Artificial Sequence
  Synthetic oligonucleotide
aaaggaggaagacgaagagggaccggacgcgaaagtga

SEQ ID NO: 200252 - DNA, 37 bp, Artificial Sequence
  Synthetic oligonucleotide
tacgcccctcaaattctcttcgcacgtcccgtagtga

SEQ ID NO: 200253 - DNA, 37 bp, Artificial Sequence
  Synthetic oligonucleotide
tactccccggccaatatgttggtgttccttcccgtga

SEQ ID NO: 200254 - DNA, 37 bp, Artificial Sequence
  Synthetic oligonucleotide
gtacgacacgaggcctctatacacccccacttcgtga

SEQ ID NO: 200255 - DNA, 38 bp, Artificial Sequence
  Synthetic oligonucleotide
gtcatcgccaccgtcatacccccactcgcgcttcgtga

SEQ ID NO: 200256 - DNA, 38 bp, Artificial Sequence
  Synthetic oligonucleotide
tggtgagacaggggggttaaacgggacataggcggtga

SEQ ID NO: 200257 - DNA, 35 bp, Artificial Sequence
  Synthetic oligonucleotide
tcacccacgccttgcactttgacagactgctttga

SEQ ID NO: 200258 - DNA, 35 bp, Artificial Sequence
  Synthetic oligonucleotide
tgcaccccagccgtcttattgaccatcccccaata

SEQ ID NO: 200259 - DNA, 36 bp, Artificial Sequence
  Synthetic oligonucleotide
taggggagggacggggtagggacggcgtattggata

SEQ ID NO: 200260 - DNA, 35 bp, Artificial Sequence
  Synthetic oligonucleotide
tgtagccctaaacttgtacttgatgccctcgccta

SEQ ID NO: 200261 - DNA, 35 bp, Artificial Sequence
  Synthetic oligonucleotide
gtgtccgtgtccgatgctctgccctgttctgtcta

SEQ ID NO: 200262 - DNA, 36 bp, Artificial Sequence
  Synthetic oligonucleotide
tacggggcaaaggagcgagtgagggccggagtagta

SEQ ID NO: 200263 - DNA, 36 bp, Artificial Sequence
  Synthetic oligonucleotide
tgcggggccagtgtgtggggtgggcacccaggggta

SEQ ID NO: 200264 - DNA, 35 bp, Artificial Sequence
  Synthetic oligonucleotide
ttagcacgtcgttgcatcttcgctcgtcctaacac

SEQ ID NO: 200265 - DNA, 35 bp, Artificial Sequence
  Synthetic oligonucleotide
aacccacttcgacgtgcggagtgacctcacttacc

SEQ ID NO: 200266 - DNA, 35 bp, Artificial Sequence
  Synthetic oligonucleotide
gagacgacagaagatgcctcctgatgcctaccccc

SEQ ID NO: 200267 - DNA, 35 bp, Artificial Sequence
  Synthetic oligonucleotide
tagaccatcgcatcccactgatcggacctctcccc

SEQ ID NO: 200268 - DNA, 35 bp, Artificial Sequence
  Synthetic oligonucleotide
gcatgtcctgtttgcgcttttggttgtcggtcgcc

SEQ ID NO: 200269 - DNA, 35 bp, Artificial Sequence
  Synthetic oligonucleotide
tctctctgtccgccggatacatcgagccaccctcc

SEQ ID NO: 200270 - DNA, 35 bp, Artificial Sequence
  Synthetic oligonucleotide
tccaccgctcggcctggccataccgtacttcttcc

SEQ ID NO: 200271 - DNA, 35 bp, Artificial Sequence
  Synthetic oligonucleotide
gccgttccacccctctcgatctgtaagccccacgc

SEQ ID NO: 200272 - DNA, 35 bp, Artificial Sequence
  Synthetic oligonucleotide
actagacgtcaaacgaaaagttacctccttcccgc

SEQ ID NO: 200273 - DNA, 35 bp, Artificial Sequence
  Synthetic oligonucleotide
aaccactccgacttgtgcattattctgctgcctgc

SEQ ID NO: 200274 - DNA, 35 bp, Artificial Sequence
  Synthetic oligonucleotide
atccgacgcccacacgtgttgttatgcgtcgcatc

SEQ ID NO: 200275 - DNA, 34 bp, Artificial Sequence
  Synthetic oligonucleotide
tccacccggcacatccttctcctatgggcctatc

SEQ ID NO: 200276 - DNA, 35 bp, Artificial Sequence
  Synthetic oligonucleotide
tccgggtccagtgacgcactgtccttcttaccctc

SEQ ID NO: 200277 - DNA, 35 bp, Artificial Sequence
  Synthetic oligonucleotide
gtcacgaccggatgccactctatttgccacgcctc

SEQ ID NO: 200278 - DNA, 35 bp, Artificial Sequence
  Synthetic oligonucleotide
tgagcctccggtccgctttaacaaacgcaatcctc

SEQ ID NO: 200279 - DNA, 35 bp, Artificial Sequence
  Synthetic oligonucleotide
tgtacactggtgggtatgaagggctgggaagggtc

SEQ ID NO: 200280 - DNA, 35 bp, Artificial Sequence
  Synthetic oligonucleotide
tgacccacccctgcagtgcttactgcactgtgttc

SEQ ID NO: 200281 - DNA, 35 bp, Artificial Sequence
  Synthetic oligonucleotide
tatggagccagggtgcgggggcaacgggagaaaag

SEQ ID NO: 200282 - DNA, 35 bp, Artificial Sequence
  Synthetic oligonucleotide
ttaccccctccccgtgctaatgcgtcaaaactccg

SEQ ID NO: 200283 - DNA, 34 bp, Artificial Sequence
  Synthetic oligonucleotide
aacgcaggcttgaattgggggggagggaccggcg

SEQ ID NO: 200284 - DNA, 35 bp, Artificial Sequence
  Synthetic oligonucleotide
aatgggtgtgagcgggggggtgggtaaaggctgcg

SEQ ID NO: 200285 - DNA, 35 bp, Artificial Sequence
  Synthetic oligonucleotide
gttgccctttgtcacagtatacctcctctcatgtg

SEQ ID NO: 200286 - DNA, 35 bp, Artificial Sequence
  Synthetic oligonucleotide
tggtagtcgagagaaggagtaagggtggtgcaaat

SEQ ID NO: 200287 - DNA, 34 bp, Artificial Sequence
  Synthetic oligonucleotide
gcacaagaggcatgaggagggaaggatgcgcaat

SEQ ID NO: 200288 - DNA, 35 bp, Artificial Sequence
  Synthetic oligonucleotide
tacaatccatcggcacatgacttttctttcaccat

SEQ ID NO: 200289 - DNA, 35 bp, Artificial Sequence
  Synthetic oligonucleotide
tcaacacgcctgtcacgtcgggtactacctaccat

SEQ ID NO: 200290 - DNA, 35 bp, Artificial Sequence
  Synthetic oligonucleotide
acagagtgcgcccgttatccgcgtttacctcccct

SEQ ID NO: 200291 - DNA, 35 bp, Artificial Sequence
  Synthetic oligonucleotide
gcacgcaatcactgccctctaggaaacgtttccct

SEQ ID NO: 200292 - DNA, 35 bp, Artificial Sequence
  Synthetic oligonucleotide
gccacgaaagttgacgtcggacctgccgttcttct

SEQ ID NO: 200293 - DNA, 35 bp, Artificial Sequence
  Synthetic oligonucleotide
tactgtaccccggcggatggtcccttcaccacggt

SEQ ID NO: 200294 - DNA, 35 bp, Artificial Sequence
  Synthetic oligonucleotide
ggtgccggtcgcctcatgttatcgccacatccatt

SEQ ID NO: 200295 - DNA, 35 bp, Artificial Sequence
  Synthetic oligonucleotide
accgccggcgtcccgactatgattaccgccacctt

SEQ ID NO: 200296 - DNA, 34 bp, Artificial Sequence
  Synthetic oligonucleotide
gtcacattcgccctccgtgcatcttaggttcctt

SEQ ID NO: 200297 - DNA, 33 bp, Artificial Sequence
  Synthetic oligonucleotide
gacacactctcctgatctctaatgccgctccaa

SEQ ID NO: 200298 - DNA, 35 bp, Artificial Sequence
  Synthetic oligonucleotide
tgcacgccctcaacggtaaatctgctcatgttcaa

SEQ ID NO: 200299 - DNA, 36 bp, Artificial Sequence
  Synthetic oligonucleotide
taggcccacgccgccgtacctgtgccctacacaaca

SEQ ID NO: 200300 - DNA, 35 bp, Artificial Sequence
  Synthetic oligonucleotide
gagtgcgagggaggggcggattagaggtggtacca

SEQ ID NO: 200301 - DNA, 36 bp, Artificial Sequence
  Synthetic oligonucleotide
tgttcgtcaactatcgccacttgccacacttcgcca

SEQ ID NO: 200302 - DNA, 36 bp, Artificial Sequence
  Synthetic oligonucleotide
attccgccccagaacatcatcgccatgcgaatagca

SEQ ID NO: 200303 - DNA, 36 bp, Artificial Sequence
  Synthetic oligonucleotide
gtcaggggaagacagaaagggagtggagagtgggca

SEQ ID NO: 200304 - DNA, 36 bp, Artificial Sequence
  Synthetic oligonucleotide
atgatcggtcgggagtgcccttttttacgcctttca

SEQ ID NO: 200305 - DNA, 36 bp, Artificial Sequence
  Synthetic oligonucleotide
tgctcgctcctgttgtccgtcccttgccgtctttca

SEQ ID NO: 200306 - DNA, 37 bp, Artificial Sequence
  Synthetic oligonucleotide
gtggggcggtgggggagaaactcaagtcgcagtaaga

SEQ ID NO: 200307 - DNA, 37 bp, Artificial Sequence
  Synthetic oligonucleotide
gggggaggaatgaggagagggttcaaggaagcataga

SEQ ID NO: 200308 - DNA, 37 bp, Artificial Sequence
  Synthetic oligonucleotide
gacaagacagaaagagtaggggggctgagtgcgtaga

SEQ ID NO: 200309 - DNA, 38 bp, Artificial Sequence
  Synthetic oligonucleotide
aacgacgcgcgggtggcggaggaagggggttttgacga

SEQ ID NO: 200310 - DNA, 35 bp, Artificial Sequence
  Synthetic oligonucleotide
tctcgccccgtgccagttagcgtgtctctccccga

SEQ ID NO: 200311 - DNA, 36 bp, Artificial Sequence
  Synthetic oligonucleotide
gtaccgccagttgacgcattccgaatacctcctcga

SEQ ID NO: 200312 - DNA, 37 bp, Artificial Sequence
  Synthetic oligonucleotide
gtaacacgtacccattggcctcactctaccctgtcga

SEQ ID NO: 200313 - DNA, 35 bp, Artificial Sequence
  Synthetic oligonucleotide
aactgaaggcgggggaggtgccatggaagggagga

SEQ ID NO: 200314 - DNA, 37 bp, Artificial Sequence
  Synthetic oligonucleotide
tgtacatccacacatccccagttgacactccgtagga

SEQ ID NO: 200315 - DNA, 37 bp, Artificial Sequence
  Synthetic oligonucleotide
atggcccgagcccactgcgatctgctccacctacgga

SEQ ID NO: 200316 - DNA, 37 bp, Artificial Sequence
  Synthetic oligonucleotide
tccatccatgctcattataagcctcctccctctcgga

SEQ ID NO: 200317 - DNA, 37 bp, Artificial Sequence
  Synthetic oligonucleotide
gcaacagggtgggtgctgggtacatttcatttgggga

SEQ ID NO: 200318 - DNA, 35 bp, Artificial Sequence
  Synthetic oligonucleotide
gtagatcaggggggggaagtacggagtggcgtgga

SEQ ID NO: 200319 - DNA, 37 bp, Artificial Sequence
  Synthetic oligonucleotide
gaacgagcagaaacggaggaaggctggtaatggatga

SEQ ID NO: 200320 - DNA, 38 bp, Artificial Sequence
  Synthetic oligonucleotide
gatactgacgcccgataattagcctgccgctcccctga

SEQ ID NO: 200321 - DNA, 38 bp, Artificial Sequence
  Synthetic oligonucleotide
acgcccccgaggcttcgcataagtttgcccccccgtga

SEQ ID NO: 200322 - DNA, 36 bp, Artificial Sequence
  Synthetic oligonucleotide
gacaggagccatggggggggggagtggaacaggtga

SEQ ID NO: 200323 - DNA, 37 bp, Artificial Sequence
  Synthetic oligonucleotide
tgtgccccttccatcctggtgtcacgagttcatgtga

SEQ ID NO: 200324 - DNA, 35 bp, Artificial Sequence
  Synthetic oligonucleotide
tacgcatcccgttcctattgcctccatacttgtga

SEQ ID NO: 200325 - DNA, 38 bp, Artificial Sequence
  Synthetic oligonucleotide
gggagggggggcgccgggataaaatgccactcttgtga

SEQ ID NO: 200326 - DNA, 36 bp, Artificial Sequence
  Synthetic oligonucleotide
gaccggagtccctcgttttcgccacctcgcacttga

SEQ ID NO: 200327 - DNA, 36 bp, Artificial Sequence
  Synthetic oligonucleotide
aacgcttgcgtgtagctcagccattcgcccctttga

SEQ ID NO: 200328 - DNA, 38 bp, Artificial Sequence
  Synthetic oligonucleotide
acactgtgcctcctggtgtcacatactcgttcctttga

SEQ ID NO: 200329 - DNA, 37 bp, Artificial Sequence
  Synthetic oligonucleotide
gcctcgccctcagatatgctccacctacttgttttga

SEQ ID NO: 200330 - DNA, 36 bp, Artificial Sequence
  Synthetic oligonucleotide
gcaaccccctcgctcggcctattatagcctggaata

SEQ ID NO: 200331 - DNA, 35 bp, Artificial Sequence
  Synthetic oligonucleotide
tgctgcactgcatctgtacctcgccgctacctcta

SEQ ID NO: 200332 - DNA, 36 bp, Artificial Sequence
  Synthetic oligonucleotide
tgcggggccaatgtgtggggtggtcacccaggggta

SEQ ID NO: 200333 - DNA, 36 bp, Artificial Sequence
  Synthetic oligonucleotide
tcacgccagtcgctgtcctaaagcgtcgccccttta

SEQ ID NO: 200334 - DNA, 35 bp, Artificial Sequence
  Synthetic oligonucleotide
agtgtaccgccatactgctagcacgcatcccttta

SEQ ID NO: 200335 - DNA, 35 bp, Artificial Sequence
  Synthetic oligonucleotide
tgccaccgccatccttaattagttgaggatcttac

SEQ ID NO: 200336 - DNA, 35 bp, Artificial Sequence
  Synthetic oligonucleotide
tgcggtcacgactcctggtcttatcgctgaacacc

SEQ ID NO: 200337 - DNA, 35 bp, Artificial Sequence
  Synthetic oligonucleotide
acacacgcacatcgacttcacgtccggcacccccc

SEQ ID NO: 200338 - DNA, 35 bp, Artificial Sequence
  Synthetic oligonucleotide
tagtacccggcctgcctgtccccatcctttttgcc

SEQ ID NO: 200339 - DNA, 35 bp, Artificial Sequence
  Synthetic oligonucleotide
tcaccgtacgccctcttaaatgcctgtcttcatcc

SEQ ID NO: 200340 - DNA, 35 bp, Artificial Sequence
  Synthetic oligonucleotide
tccacgagtccacatagttatacgcgctcgtctcc

SEQ ID NO: 200341 - DNA, 35 bp, Artificial Sequence
  Synthetic oligonucleotide
gcaatactgcgcgcatgcagtccacacgaccttcc

SEQ ID NO: 200342 - DNA, 35 bp, Artificial Sequence
  Synthetic oligonucleotide
tcacacaccgctcacaggcataagcttacccgcgc

SEQ ID NO: 200343 - DNA, 35 bp, Artificial Sequence
  Synthetic oligonucleotide
gacaacctccgactcgcattattccttggactggc

SEQ ID NO: 200344 - DNA, 35 bp, Artificial Sequence
  Synthetic oligonucleotide
gttgggccaagcactatcgggtgggagggacttgc

SEQ ID NO: 200345 - DNA, 35 bp, Artificial Sequence
  Synthetic oligonucleotide
tgccctgtcccatctagttactgaaccgctccatc

SEQ ID NO: 200346 - DNA, 35 bp, Artificial Sequence
  Synthetic oligonucleotide
atccacgctgtggtgattttgcgttaccgggcctc

SEQ ID NO: 200347 - DNA, 35 bp, Artificial Sequence
  Synthetic oligonucleotide
gcccagtcgtcacgctctatgccccgatcaatgtc

SEQ ID NO: 200348 - DNA, 35 bp, Artificial Sequence
  Synthetic oligonucleotide
gcccatcctccatgacttgcccgagtcgccgtgtc

SEQ ID NO: 200349 - DNA, 35 bp, Artificial Sequence
  Synthetic oligonucleotide
actaccagtcagccgctcctaataaaccccctgcg

SEQ ID NO: 200350 - DNA, 35 bp, Artificial Sequence
  Synthetic oligonucleotide
gtcaatcactgctgtgcaccgttcttccgccatcg

SEQ ID NO: 200351 - DNA, 35 bp, Artificial Sequence
  Synthetic oligonucleotide
acgacagggtcatgctgctatccttcccaccgtcg

SEQ ID NO: 200352 - DNA, 35 bp, Artificial Sequence
  Synthetic oligonucleotide
gaaggtgtaagggtgggggtatagctaggtgaagg

SEQ ID NO: 200353 - DNA, 35 bp, Artificial Sequence
  Synthetic oligonucleotide
gaagggcgggactaaaggattgcgggtgggacagg

SEQ ID NO: 200354 - DNA, 35 bp, Artificial Sequence
  Synthetic oligonucleotide
tgctgaaggggggagcgagtagcaggagaggccgg

SEQ ID NO: 200355 - DNA, 35 bp, Artificial Sequence
  Synthetic oligonucleotide
gatgggcgggagaggtgcggggctcattttctggg

SEQ ID NO: 200356 - DNA, 35 bp, Artificial Sequence
  Synthetic oligonucleotide
gggactggtcgagggagggtgggaacagtgtactg

SEQ ID NO: 200357 - DNA, 35 bp, Artificial Sequence
  Synthetic oligonucleotide
gcacacatcagacgtacattccgcccctgctattg

SEQ ID NO: 200358 - DNA, 35 bp, Artificial Sequence
  Synthetic oligonucleotide
tagtgggccaggagcggtgggagggaggcgaaaat

SEQ ID NO: 200359 - DNA, 35 bp, Artificial Sequence
  Synthetic oligonucleotide
ttccgatccacgaccatgccagaaacccgttccat

SEQ ID NO: 200360 - DNA, 35 bp, Artificial Sequence
  Synthetic oligonucleotide
ttgagattcgatgtgtcgtctccatcccccttact

SEQ ID NO: 200361 - DNA, 35 bp, Artificial Sequence
  Synthetic oligonucleotide
gtcacctcccatggctggatcgaatttacgtacct

SEQ ID NO: 200362 - DNA, 35 bp, Artificial Sequence
  Synthetic oligonucleotide
tgtccgctccgttgcgatcgttccgttggtaccct

SEQ ID NO: 200363 - DNA, 35 bp, Artificial Sequence
  Synthetic oligonucleotide
gtgccaatcgcggtttgaaacgtcaccgcccccct

SEQ ID NO: 200364 - DNA, 35 bp, Artificial Sequence
  Synthetic oligonucleotide
gcatgacacctcagcctgcccttaatgttacatct

SEQ ID NO: 200365 - DNA, 35 bp, Artificial Sequence
  Synthetic oligonucleotide
gactgcctgcgtgtgcccttccctactatgcgagt

SEQ ID NO: 200366 - DNA, 35 bp, Artificial Sequence
  Synthetic oligonucleotide
gttacgcccctgtgtccagccccattcgtgagcgt

SEQ ID NO: 200367 - DNA, 35 bp, Artificial Sequence
  Synthetic oligonucleotide
acttaaacaccctccgccgtcgcacctggtttctt

SEQ ID NO: 200368 - DNA, 35 bp, Artificial Sequence
  Synthetic oligonucleotide
tcatctaggccctatgcctgtactttcaagccttt

SEQ ID NO: 200369 - DNA, 35 bp, Artificial Sequence
  Synthetic oligonucleotide
ttcgacgactcctatggcaccgtggtctgtttttt

SEQ ID NO: 200370 - DNA, 35 bp, Artificial Sequence
  Synthetic oligonucleotide
gaaaagggaatggcggtgcttgggtaggaataaaa

SEQ ID NO: 200371 - DNA, 35 bp, Artificial Sequence
  Synthetic oligonucleotide
tggagtcgggttggggtacgaggggtgggctcaaa

SEQ ID NO: 200372 - DNA, 36 bp, Artificial Sequence
  Synthetic oligonucleotide
gaggggagggaaggggtaaacgctggttcaatagaa

SEQ ID NO: 200373 - DNA, 35 bp, Artificial Sequence
  Synthetic oligonucleotide
gccctgatccgcggtacttcgtcactcacctcgaa

SEQ ID NO: 200374 - DNA, 35 bp, Artificial Sequence
  Synthetic oligonucleotide
ttgagagtgtgcggggagggcgggactgacaataa

SEQ ID NO: 200375 - DNA, 36 bp, Artificial Sequence
  Synthetic oligonucleotide
gacacacatgcggaaacgggcacttgcattgtgtaa

SEQ ID NO: 200376 - DNA, 36 bp, Artificial Sequence
  Synthetic oligonucleotide
aagggcggggtggaatagggaggaggaagccagaca

SEQ ID NO: 200377 - DNA, 36 bp, Artificial Sequence
  Synthetic oligonucleotide
aacctggcgtgccagtcgtctcttgctacccgtaca

SEQ ID NO: 200378 - DNA, 35 bp, Artificial Sequence
  Synthetic oligonucleotide
tccgtgccttcactcctggcgtttcgacgttacca

SEQ ID NO: 200379 - DNA, 35 bp, Artificial Sequence
  Synthetic oligonucleotide
agccgccgccagcccagcgcgtaaacttccgtcca

SEQ ID NO: 200380 - DNA, 36 bp, Artificial Sequence
  Synthetic oligonucleotide
gtgttaccctctcctgctaagctacgtacgaagtca

SEQ ID NO: 200381 - DNA, 37 bp, Artificial Sequence
  Synthetic oligonucleotide
tacacgccctccgcaacttatgtcagcccttgacaga

SEQ ID NO: 200382 - DNA, 36 bp, Artificial Sequence
  Synthetic oligonucleotide
tgaatggtcggagggtaagcaagggggaaatgcaga

SEQ ID NO: 200383 - DNA, 36 bp, Artificial Sequence
  Synthetic oligonucleotide
ggagagatgaggtgggatgggacggacaaggtgcga

SEQ ID NO: 200384 - DNA, 37 bp, Artificial Sequence
  Synthetic oligonucleotide
aaggggggtgtcaaagaatgcgtggaggaggggagga

SEQ ID NO: 200385 - DNA, 37 bp, Artificial Sequence
  Synthetic oligonucleotide
gatgcgttggaaggcaacagagaggggggggatagga

SEQ ID NO: 200386 - DNA, 37 bp, Artificial Sequence
  Synthetic oligonucleotide
gggacaagtcaaggacaaagatggagaggtgggcgga

SEQ ID NO: 200387 - DNA, 37 bp, Artificial Sequence
  Synthetic oligonucleotide
gaccatgttggaaggggaatgggatgaaccttgggga

SEQ ID NO: 200388 - DNA, 37 bp, Artificial Sequence
  Synthetic oligonucleotide
ggaggagaagtgcaggaggggtagatgcatgtgtgga

SEQ ID NO: 200389 - DNA, 36 bp, Artificial Sequence
  Synthetic oligonucleotide
agttaccccgacctgtatagattccacccacgctga

SEQ ID NO: 200390 - DNA, 37 bp, Artificial Sequence
  Synthetic oligonucleotide
gcaccaccgacacttgcttaattcactatcttgctga

SEQ ID NO: 200391 - DNA, 38 bp, Artificial Sequence
  Synthetic oligonucleotide
agctagcaacgggtgtgcaagggtgggggggaaggtga

SEQ ID NO: 200392 - DNA, 35 bp, Artificial Sequence
  Synthetic oligonucleotide
acagtcacgcacatgggactgccaccctaaaccta

SEQ ID NO: 200393 - DNA, 36 bp, Artificial Sequence
  Synthetic oligonucleotide
ggacagagcgggggtggagggaacaaatcggaccta

SEQ ID NO: 200394 - DNA, 36 bp, Artificial Sequence
  Synthetic oligonucleotide
accacccagagttcttatcatcatgctctactcgta

SEQ ID NO: 200395 - DNA, 36 bp, Artificial Sequence
  Synthetic oligonucleotide
ttgcgacagggagggagaggggggagcaccactgta

SEQ ID NO: 200396 - DNA, 35 bp, Artificial Sequence
  Synthetic oligonucleotide
gaatgggggctcaaaatctgggggcggggttcaac

SEQ ID NO: 200397 - DNA, 35 bp, Artificial Sequence
  Synthetic oligonucleotide
gccatgatccgactgcccacgtcctggttacctac

SEQ ID NO: 200398 - DNA, 35 bp, Artificial Sequence
  Synthetic oligonucleotide
tcagcaattcgttgcgaagtgccgtgcctccttac

SEQ ID NO: 200399 - DNA, 35 bp, Artificial Sequence
  Synthetic oligonucleotide
tctatacgtacacctaggtgtcgaccctgtttacc

SEQ ID NO: 200400 - DNA, 35 bp, Artificial Sequence
  Synthetic oligonucleotide
tggacaggtccaagattagcacttctcgtccgccc

SEQ ID NO: 200401 - DNA, 35 bp, Artificial Sequence
  Synthetic oligonucleotide
tgtgtgccccgcgacttatgtacacccccgtgccc

SEQ ID NO: 200402 - DNA, 35 bp, Artificial Sequence
  Synthetic oligonucleotide
gtgggtgcccctactcgtctatcgtgccgttatcc

SEQ ID NO: 200403 - DNA, 35 bp, Artificial Sequence
  Synthetic oligonucleotide
gtaacaccccgctcagttatagacgtatctcctcc

SEQ ID NO: 200404 - DNA, 35 bp, Artificial Sequence
  Synthetic oligonucleotide
agtaccgttcgccagcctcatgaatagcgccttcc

SEQ ID NO: 200405 - DNA, 35 bp, Artificial Sequence
  Synthetic oligonucleotide
ttcgttgccgacataatgcgctgaaacccccccgc

SEQ ID NO: 200406 - DNA, 35 bp, Artificial Sequence
  Synthetic oligonucleotide
gttgttaccgtcaccttaagtttccattgctcctc

SEQ ID NO: 200407 - DNA, 35 bp, Artificial Sequence
  Synthetic oligonucleotide
tgttccctccctctgcactgtacagtactgtcctc

SEQ ID NO: 200408 - DNA, 35 bp, Artificial Sequence
  Synthetic oligonucleotide
gagaccacactagctgttactgcactccctctctc

SEQ ID NO: 200409 - DNA, 35 bp, Artificial Sequence
  Synthetic oligonucleotide
taagcctgccttcacatactcttatccaccgtgtc

SEQ ID NO: 200410 - DNA, 35 bp, Artificial Sequence
  Synthetic oligonucleotide
tccagtgcccgacgattgccccccgtattttattc

SEQ ID NO: 200411 - DNA, 35 bp, Artificial Sequence
  Synthetic oligonucleotide
acgctccacatgtcaatccctcggtctgttccttc

SEQ ID NO: 200412 - DNA, 35 bp, Artificial Sequence
  Synthetic oligonucleotide
gggtctaactgcaacacctccgctcgcatccgacg

SEQ ID NO: 200413 - DNA, 35 bp, Artificial Sequence
  Synthetic oligonucleotide
acgcgccccatcctgacgatccatccaatgaagcg

SEQ ID NO: 200414 - DNA, 34 bp, Artificial Sequence
  Synthetic oligonucleotide
gccacccacgtgtctaaatttccccctctgtgcg

SEQ ID NO: 200415 - DNA, 35 bp, Artificial Sequence
  Synthetic oligonucleotide
gtaagtcagatcccgtcatattcctcccgtttgcg

SEQ ID NO: 200416 - DNA, 35 bp, Artificial Sequence
  Synthetic oligonucleotide
gaaaggtgggtggataggagagatggtcgatatgg

SEQ ID NO: 200417 - DNA, 35 bp, Artificial Sequence
  Synthetic oligonucleotide
tcacgtcgcaccgttgcttttccctctcccccatg

SEQ ID NO: 200418 - DNA, 35 bp, Artificial Sequence
  Synthetic oligonucleotide
acccgatccctgcccctgtacgtagagctaatttg

SEQ ID NO: 200419 - DNA, 35 bp, Artificial Sequence
  Synthetic oligonucleotide
tcgctgggccctactatcttgcaacgacacatcat

SEQ ID NO: 200420 - DNA, 35 bp, Artificial Sequence
  Synthetic oligonucleotide
actatgtacggggccgctcccatcacccctgcttt

SEQ ID NO: 200421 - DNA, 35 bp, Artificial Sequence
  Synthetic oligonucleotide
gttgctcgctgcacgttttagcactcctgattttt

SEQ ID NO: 200422 - DNA, 35 bp, Artificial Sequence
  Synthetic oligonucleotide
gtggcggaggcggggtgtggatggagggcaatcaa

SEQ ID NO: 200423 - DNA, 36 bp, Artificial Sequence
  Synthetic oligonucleotide
aactagagggggatagggaagcgggaggggagaaca

SEQ ID NO: 200424 - DNA, 36 bp, Artificial Sequence
  Synthetic oligonucleotide
accaccccctctgtcgggcaggaacggtgcaataca

SEQ ID NO: 200425 - DNA, 35 bp, Artificial Sequence
  Synthetic oligonucleotide
tacgcccggcctccactgactatcaatctgcccca

SEQ ID NO: 200426 - DNA, 36 bp, Artificial Sequence
  Synthetic oligonucleotide
gcatcgcgctatctgcactaagctgacctcccttca

SEQ ID NO: 200427 - DNA, 36 bp, Artificial Sequence
  Synthetic oligonucleotide
accctgtgcgtacgatcctgtacttggctctcttca

SEQ ID NO: 200428 - DNA, 35 bp, Artificial Sequence
  Synthetic oligonucleotide
acacccattagtgccacccacgtcttctttcaaga

SEQ ID NO: 200429 - DNA, 37 bp, Artificial Sequence
  Synthetic oligonucleotide
gagtgcgcccttactttctacgtgccctcttgttaga

SEQ ID NO: 200430 - DNA, 37 bp, Artificial Sequence
  Synthetic oligonucleotide
tttacgtcacacgtgcttgccttcgtccccctttaga

SEQ ID NO: 200431 - DNA, 36 bp, Artificial Sequence
  Synthetic oligonucleotide
gtccgacacggagcctatatgtcttccttcttccga

SEQ ID NO: 200432 - DNA, 35 bp, Artificial Sequence
  Synthetic oligonucleotide
gcgaaaggctgagtgggggcgggcggagaaagcga

SEQ ID NO: 200433 - DNA, 35 bp, Artificial Sequence
  Synthetic oligonucleotide
ttgggggggggaggaatagcactaggctagggcga

SEQ ID NO: 200434 - DNA, 37 bp, Artificial Sequence
  Synthetic oligonucleotide
tcatgtagaccggcgaatgggggacagggaggacgga

SEQ ID NO: 200435 - DNA, 36 bp, Artificial Sequence
  Synthetic oligonucleotide
tttgtccatcagcccgatatgcacccgccccttgga

SEQ ID NO: 200436 - DNA, 38 bp, Artificial Sequence
  Synthetic oligonucleotide
tgtgggagtgcggggaaaggggttgtagcgggacatga

SEQ ID NO: 200437 - DNA, 38 bp, Artificial Sequence
  Synthetic oligonucleotide
tgatggtcagagcttgttaaatccgtttcccccgctga

SEQ ID NO: 200438 - DNA, 38 bp, Artificial Sequence
  Synthetic oligonucleotide
tcttaagccgctgtgtgcacctccccaatcctgtctga

SEQ ID NO: 200439 - DNA, 38 bp, Artificial Sequence
  Synthetic oligonucleotide
tagggtcgatccgccgttactctcaccgtcccacgtga

SEQ ID NO: 200440 - DNA, 38 bp, Artificial Sequence
  Synthetic oligonucleotide
gtcaagtgccagactctctaaccgcctccatttcgtga

SEQ ID NO: 200441 - DNA, 35 bp, Artificial Sequence
  Synthetic oligonucleotide
gatcgagccagcgttttacggcgccatcctcacta

SEQ ID NO: 200442 - DNA, 36 bp, Artificial Sequence
  Synthetic oligonucleotide
aatagagtggtggaagtgggaggggagctgcagcta

SEQ ID NO: 200443 - DNA, 36 bp, Artificial Sequence
  Synthetic oligonucleotide
atggaagacatggagggcgagggggaaacgttcgta

SEQ ID NO: 200444 - DNA, 36 bp, Artificial Sequence
  Synthetic oligonucleotide
gtcatcatcccgccgccgctatgcttggacaactta

SEQ ID NO: 200445 - DNA, 35 bp, Artificial Sequence
  Synthetic oligonucleotide
actccctgctcaactggtcttcatgtctctgctta

SEQ ID NO: 200446 - DNA, 36 bp, Artificial Sequence
  Synthetic oligonucleotide
accccgctcccagtatgcgtcctgcgaatctattta

SEQ ID NO: 200447 - DNA, 35 bp, Artificial Sequence
  Synthetic oligonucleotide
atcgcctcataattgcgttatcttgcccagcccac

SEQ ID NO: 200448 - DNA, 35 bp, Artificial Sequence
  Synthetic oligonucleotide
tcccaccgatccgttctctttaccttgagttgtac

SEQ ID NO: 200449 - DNA, 35 bp, Artificial Sequence
  Synthetic oligonucleotide
gcgacaagcctggcctcgttcgagtatgttctccc

SEQ ID NO: 200450 - DNA, 35 bp, Artificial Sequence
  Synthetic oligonucleotide
acccgccactgacagatgccctccgccctggtccc

SEQ ID NO: 200451 - DNA, 36 bp, Artificial Sequence
  Synthetic oligonucleotide
acgctccagcatctctgtacctctagtcgtttggcc

SEQ ID NO: 200452 - DNA, 35 bp, Artificial Sequence
  Synthetic oligonucleotide
tagtcagcccatccgtcgtactacttcatccatcc

SEQ ID NO: 200453 - DNA, 35 bp, Artificial Sequence
  Synthetic oligonucleotide
gaggaaccagcgcagctatgtatcgttccacctcc

SEQ ID NO: 200454 - DNA, 35 bp, Artificial Sequence
  Synthetic oligonucleotide
gtggttgggtcggatagctcattcctgtccatcgc

SEQ ID NO: 200455 - DNA, 35 bp, Artificial Sequence
  Synthetic oligonucleotide
tctggttcaggcgtcatctccctcgccctgcatgc

SEQ ID NO: 200456 - DNA, 35 bp, Artificial Sequence
  Synthetic oligonucleotide
gtccccgcccagttccgcctaaatcgcatagctgc

SEQ ID NO: 200457 - DNA, 35 bp, Artificial Sequence
  Synthetic oligonucleotide
tgaacaaccactctggcatacgtgacctcatctgc

SEQ ID NO: 200458 - DNA, 35 bp, Artificial Sequence
  Synthetic oligonucleotide
acaccgcccgccgctgaacgagtcgtcctgaaatc

SEQ ID NO: 200459 - DNA, 35 bp, Artificial Sequence
  Synthetic oligonucleotide
gacaccaagtcgtcttgacgtacaccctaccaatc

SEQ ID NO: 200460 - DNA, 35 bp, Artificial Sequence
  Synthetic oligonucleotide
tacggtagtccctccgagtccataccaagccgctc

SEQ ID NO: 200461 - DNA, 35 bp, Artificial Sequence
  Synthetic oligonucleotide
gcggtgccctccgttagtaaagctcaatctctgtc

SEQ ID NO: 200462 - DNA, 35 bp, Artificial Sequence
  Synthetic oligonucleotide
agacggcggttccctgcgttcttccctgacttttc

SEQ ID NO: 200463 - DNA, 35 bp, Artificial Sequence
  Synthetic oligonucleotide
gagatgcccgccgcctctgtaaatataccatcccg

SEQ ID NO: 200464 - DNA, 35 bp, Artificial Sequence
  Synthetic oligonucleotide
atgcgcaagccacgtgttcgtcctccttctggccg

SEQ ID NO: 200465 - DNA, 35 bp, Artificial Sequence
  Synthetic oligonucleotide
atccccatcaatgagctgttacgaacgtctctccg

SEQ ID NO: 200466 - DNA, 35 bp, Artificial Sequence
  Synthetic oligonucleotide
tcacccggtcatcagggtctccgtcccatcaacgg

SEQ ID NO: 200467 - DNA, 35 bp, Artificial Sequence
  Synthetic oligonucleotide
ttgtggcacagtaagtactgtcctattctcccctg

SEQ ID NO: 200468 - DNA, 35 bp, Artificial Sequence
  Synthetic oligonucleotide
tcatgcagactcggtcttggcgccctcacttcctg

SEQ ID NO: 200469 - DNA, 35 bp, Artificial Sequence
  Synthetic oligonucleotide
acagggccgcaacggaccggtacgaactttcctat

SEQ ID NO: 200470 - DNA, 35 bp, Artificial Sequence
  Synthetic oligonucleotide
atgacaccatccccccttatggccaccacgagact

SEQ ID NO: 200471 - DNA, 35 bp, Artificial Sequence
  Synthetic oligonucleotide
gaaccgtgtgttcccgtgcaaattcgtccatccct

SEQ ID NO: 200472 - DNA, 35 bp, Artificial Sequence
  Synthetic oligonucleotide
gttcagcccgctctcgaagaagttatcacgcctct

SEQ ID NO: 200473 - DNA, 35 bp, Artificial Sequence
  Synthetic oligonucleotide
gtatgacccccgcctgtatccgaaggtgatattct

SEQ ID NO: 200474 - DNA, 35 bp, Artificial Sequence
  Synthetic oligonucleotide
gactctccatcgaattgattgcaagccctccttct

SEQ ID NO: 200475 - DNA, 35 bp, Artificial Sequence
  Synthetic oligonucleotide
ttcagacctgcctcctgatcgtctattttcccggt

SEQ ID NO: 200476 - DNA, 34 bp, Artificial Sequence
  Synthetic oligonucleotide
tccactcctgccgtgttttttgcgccctccaatt

SEQ ID NO: 200477 - DNA, 35 bp, Artificial Sequence
  Synthetic oligonucleotide
accatcgcagattgccacaaaatcctgggtccctt

SEQ ID NO: 200478 - DNA, 35 bp, Artificial Sequence
  Synthetic oligonucleotide
aaccaccacgcggtagattgctccacttccttctt

SEQ ID NO: 200479 - DNA, 35 bp, Artificial Sequence
  Synthetic oligonucleotide
tcagggccagtccctggtatgtccccttccccgtt

SEQ ID NO: 200480 - DNA, 35 bp, Artificial Sequence
  Synthetic oligonucleotide
tcacaaacgaaggtggcgaatagggagagtttgtt

SEQ ID NO: 200481 - DNA, 35 bp, Artificial Sequence
  Synthetic oligonucleotide
atggggggggagtgagacgggaaggggaagagaaa

SEQ ID NO: 200482 - DNA, 35 bp, Artificial Sequence
  Synthetic oligonucleotide
ttgggcggtctccctgcctttatgacgctccgtaa

SEQ ID NO: 200483 - DNA, 36 bp, Artificial Sequence
  Synthetic oligonucleotide
tgacgccacactcgcatctggtctacccgtccttaa

SEQ ID NO: 200484 - DNA, 35 bp, Artificial Sequence
  Synthetic oligonucleotide
tcacccgcagtgctatctgaaacctcgctccagca

SEQ ID NO: 200485 - DNA, 35 bp, Artificial Sequence
  Synthetic oligonucleotide
gccgctcgacctgcctatgcataatacgactcgca

SEQ ID NO: 200486 - DNA, 36 bp, Artificial Sequence
  Synthetic oligonucleotide
aacccgcagtacccctttcacgccttgctgaaggca

SEQ ID NO: 200487 - DNA, 36 bp, Artificial Sequence
  Synthetic oligonucleotide
gttgcccacatgatgcatgccactctcctgttatca

SEQ ID NO: 200488 - DNA, 35 bp, Artificial Sequence
  Synthetic oligonucleotide
ttgcgagcagaactcatggtccgtcacctcgttca

SEQ ID NO: 200489 - DNA, 35 bp, Artificial Sequence
  Synthetic oligonucleotide
agggaacaaccgaaaagagggggactggagcgaga

SEQ ID NO: 200490 - DNA, 37 bp, Artificial Sequence
  Synthetic oligonucleotide
gaccaaaccggtacgagactagagagagagagggaga

SEQ ID NO: 200491 - DNA, 36 bp, Artificial Sequence
  Synthetic oligonucleotide
gggagggacgggctaacaataataggggactggaga

SEQ ID NO: 200492 - DNA, 37 bp, Artificial Sequence
  Synthetic oligonucleotide
gccttagccccgttcctcctgccagccgttagaacga

SEQ ID NO: 200493 - DNA, 37 bp, Artificial Sequence
  Synthetic oligonucleotide
gacattgggccgaaagggggatggggttggggaacga

SEQ ID NO: 200494 - DNA, 36 bp, Artificial Sequence
  Synthetic oligonucleotide
gacacccccttcattcgatttactttcgttccacga

SEQ ID NO: 200495 - DNA, 37 bp, Artificial Sequence
  Synthetic oligonucleotide
gtcccacctcggtcgcattgagtactcgctctgacga

SEQ ID NO: 200496 - DNA, 37 bp, Artificial Sequence
  Synthetic oligonucleotide
tgacgggatgaggccacgggagggcgggtggtaccga

SEQ ID NO: 200497 - DNA, 37 bp, Artificial Sequence
  Synthetic oligonucleotide
agccctgaggtggcggggatggatgggtggaatccga

SEQ ID NO: 200498 - DNA, 36 bp, Artificial Sequence
  Synthetic oligonucleotide
tgacccgcccacctgtcagcagcaactaggttccga

SEQ ID NO: 200499 - DNA, 37 bp, Artificial Sequence
  Synthetic oligonucleotide
ttcggaaccgcatttgcagccgagccgtcccccgcga

SEQ ID NO: 200500 - DNA, 37 bp, Artificial Sequence
  Synthetic oligonucleotide
gtgtcagacaagctgggtgggaggggggcaactgcga

SEQ ID NO: 200501 - DNA, 37 bp, Artificial Sequence
  Synthetic oligonucleotide
agaaaagggggagagggcggggcaagccagtactcga

SEQ ID NO: 200502 - DNA, 37 bp, Artificial Sequence
  Synthetic oligonucleotide
gtgacacctctttcacctgccacaagttcgtcctcga

SEQ ID NO: 200503 - DNA, 37 bp, Artificial Sequence
  Synthetic oligonucleotide
tacgcaatgagcacttgtggtttcatccccccttcga

SEQ ID NO: 200504 - DNA, 37 bp, Artificial Sequence
  Synthetic oligonucleotide
taggtgcgagggggaggatagacccgggagactagga

SEQ ID NO: 200505 - DNA, 37 bp, Artificial Sequence
  Synthetic oligonucleotide
tgacatcgcgaatgcgaactgttacttcctacccgga

SEQ ID NO: 200506 - DNA, 37 bp, Artificial Sequence
  Synthetic oligonucleotide
gtaagacgggctgaagggactggcgaggggggcggga

SEQ ID NO: 200507 - DNA, 37 bp, Artificial Sequence
  Synthetic oligonucleotide
atgtcatacgcagacgactaggaaagggcggagggga

SEQ ID NO: 200508 - DNA, 37 bp, Artificial Sequence
  Synthetic oligonucleotide
gacgaacgagggggagtgcgtcggattaaggcgggga

SEQ ID NO: 200509 - DNA, 37 bp, Artificial Sequence
  Synthetic oligonucleotide
gcacgggacgggggggatgaggcacgggacgcatgga

SEQ ID NO: 200510 - DNA, 35 bp, Artificial Sequence
  Synthetic oligonucleotide
gtggtggaggagggggaggaaggccaggatctgga

SEQ ID NO: 200511 - DNA, 38 bp, Artificial Sequence
  Synthetic oligonucleotide
atgaatgggaggaaggcgaggaaaagggaagtcactga

SEQ ID NO: 200512 - DNA, 35 bp, Artificial Sequence
  Synthetic oligonucleotide
tcattagccggatgcgtcccaacaatttttactga

SEQ ID NO: 200513 - DNA, 37 bp, Artificial Sequence
  Synthetic oligonucleotide
tgctacgctagatggcgtgcgtatctcctccttctga

SEQ ID NO: 200514 - DNA, 36 bp, Artificial Sequence
  Synthetic oligonucleotide
gtacgcgccttggtcttgtcgatcgccccacctata

SEQ ID NO: 200515 - DNA, 36 bp, Artificial Sequence
  Synthetic oligonucleotide
gttgtcccactctgatctctatatccaatagcccta

SEQ ID NO: 200516 - DNA, 34 bp, Artificial Sequence
  Synthetic oligonucleotide
gcacctagctggagatcttcgacccttacctcta

SEQ ID NO: 200517 - DNA, 36 bp, Artificial Sequence
  Synthetic oligonucleotide
tgagaacaaggcggagggggactggggccggctcta

SEQ ID NO: 200518 - DNA, 35 bp, Artificial Sequence
  Synthetic oligonucleotide
actgtatcccaagccgtgtccctcttatcgcgtta

SEQ ID NO: 200519 - DNA, 36 bp, Artificial Sequence
  Synthetic oligonucleotide
gacacccgcctgaccccatgcgattccagagtttta

SEQ ID NO: 200520 - DNA, 35 bp, Artificial Sequence
  Synthetic oligonucleotide
aagccgttgatatgggtgggagggtcagggcaaac

SEQ ID NO: 200521 - DNA, 35 bp, Artificial Sequence
  Synthetic oligonucleotide
tcccaccacggttcactacatagtttacgcttaac

SEQ ID NO: 200522 - DNA, 35 bp, Artificial Sequence
  Synthetic oligonucleotide
gcacctcgacacatctactttgcactagcgtaacc

SEQ ID NO: 200523 - DNA, 35 bp, Artificial Sequence
  Synthetic oligonucleotide
gttgtaacagctatgtgctaactttcaccttcacc

SEQ ID NO: 200524 - DNA, 35 bp, Artificial Sequence
  Synthetic oligonucleotide
tgttgcccctccaattcaatcaccatggttttacc

SEQ ID NO: 200525 - DNA, 35 bp, Artificial Sequence
  Synthetic oligonucleotide
gggacatccccaacattagataagcccctcatgcc

SEQ ID NO: 200526 - DNA, 35 bp, Artificial Sequence
  Synthetic oligonucleotide
gccatcctgcgctcacttcacgttcaggcactgcc

SEQ ID NO: 200527 - DNA, 35 bp, Artificial Sequence
  Synthetic oligonucleotide
taaccagccgcactttcgagtatctacccgcctcc

SEQ ID NO: 200528 - DNA, 35 bp, Artificial Sequence
  Synthetic oligonucleotide
tgtcccacgacctgaagcccatcacctcatattcc

SEQ ID NO: 200529 - DNA, 35 bp, Artificial Sequence
  Synthetic oligonucleotide
tactcgcgcccattgcgtgaatacgtgtaccttcc

SEQ ID NO: 200530 - DNA, 35 bp, Artificial Sequence
  Synthetic oligonucleotide
acgcaaacgttgccttctgtaccgcctgtcgccgc

SEQ ID NO: 200531 - DNA, 35 bp, Artificial Sequence
  Synthetic oligonucleotide
aagtcatactcctcttctatctgtgcaacctctgc

SEQ ID NO: 200532 - DNA, 35 bp, Artificial Sequence
  Synthetic oligonucleotide
gatcaacgcacgggttagatgcctgttgttccatc

SEQ ID NO: 200533 - DNA, 35 bp, Artificial Sequence
  Synthetic oligonucleotide
gaccaccgaggctcgtgctactgctaccgcaactc

SEQ ID NO: 200534 - DNA, 35 bp, Artificial Sequence
  Synthetic oligonucleotide
acacaagatgtcactgtattcgttctatcctgctc

SEQ ID NO: 200535 - DNA, 31 bp, Artificial Sequence
  Synthetic oligonucleotide
tatgcccgccggatctcttattttaaccgtc

SEQ ID NO: 200536 - DNA, 35 bp, Artificial Sequence
  Synthetic oligonucleotide
taggatgaggggcgagtcgagaacgagggcggacg

SEQ ID NO: 200537 - DNA, 35 bp, Artificial Sequence
  Synthetic oligonucleotide
ggggggggagggagctgggagcaaactgtctggcg

SEQ ID NO: 200538 - DNA, 35 bp, Artificial Sequence
  Synthetic oligonucleotide
tcaccgacacggatctggtcctgcctccccgatcg

SEQ ID NO: 200539 - DNA, 35 bp, Artificial Sequence
  Synthetic oligonucleotide
tgacggtggtgaggtcgaaggggagggtggaaagg

SEQ ID NO: 200540 - DNA, 35 bp, Artificial Sequence
  Synthetic oligonucleotide
atgggcggagtggtcgggtggggttacggcgtggg

SEQ ID NO: 200541 - DNA, 35 bp, Artificial Sequence
  Synthetic oligonucleotide
tgacggagtggggtgggaagggcaatcgcagcctg

SEQ ID NO: 200542 - DNA, 35 bp, Artificial Sequence
  Synthetic oligonucleotide
agcgatggcgataggagatggggatgggggggctg

SEQ ID NO: 200543 - DNA, 35 bp, Artificial Sequence
  Synthetic oligonucleotide
gcctgagcgccaccttaggtgagttatcctttctg

SEQ ID NO: 200544 - DNA, 35 bp, Artificial Sequence
  Synthetic oligonucleotide
atcaccagcagacacgtgatgttcctcccaccgtg

SEQ ID NO: 200545 - DNA, 35 bp, Artificial Sequence
  Synthetic oligonucleotide
tgtgaagggtgagagacgggagaagggcggagcat

SEQ ID NO: 200546 - DNA, 35 bp, Artificial Sequence
  Synthetic oligonucleotide
gtgcccttgccccgcgtgtctatcgctcgccacct

SEQ ID NO: 200547 - DNA, 35 bp, Artificial Sequence
  Synthetic oligonucleotide
tcgaagctgcacccccgttccatccgactgtctct

SEQ ID NO: 200548 - DNA, 35 bp, Artificial Sequence
  Synthetic oligonucleotide
gagtctcaatctgtgcttccacctgcccttccggt

SEQ ID NO: 200549 - DNA, 35 bp, Artificial Sequence
  Synthetic oligonucleotide
tcacgcgcttcctctggtaaccggatccctacctt

SEQ ID NO: 200550 - DNA, 36 bp, Artificial Sequence
  Synthetic oligonucleotide
gtagacacgtggagaggtaggaaggaagcagcacaa

SEQ ID NO: 200551 - DNA, 36 bp, Artificial Sequence
  Synthetic oligonucleotide
acactccgccttgtacctctgtgatgttccagctaa

SEQ ID NO: 200552 - DNA, 35 bp, Artificial Sequence
  Synthetic oligonucleotide
tgtagtctactgcaggtcatctcgcccctgtctaa

SEQ ID NO: 200553 - DNA, 35 bp, Artificial Sequence
  Synthetic oligonucleotide
acattggcgttggtcggggacgagggtgggtaaca

SEQ ID NO: 200554 - DNA, 36 bp, Artificial Sequence
  Synthetic oligonucleotide
tgttacgcctgctgcctctgttactctcaccagaca

SEQ ID NO: 200555 - DNA, 35 bp, Artificial Sequence
  Synthetic oligonucleotide
tactctctgcgtcctccatgccccatcttttgaca

SEQ ID NO: 200556 - DNA, 35 bp, Artificial Sequence
  Synthetic oligonucleotide
gcaccaccccacatgtcaattagccgccctcacca

SEQ ID NO: 200557 - DNA, 36 bp, Artificial Sequence
  Synthetic oligonucleotide
tgctgcccccagagcgtctagcttttcgccccgcca

SEQ ID NO: 200558 - DNA, 36 bp, Artificial Sequence
  Synthetic oligonucleotide
atgcgtgaaaggggagggcggtaagacagttgagca

SEQ ID NO: 200559 - DNA, 36 bp, Artificial Sequence
  Synthetic oligonucleotide
gttcaccgcacaccttttcgcatgcaatgtaatgca

SEQ ID NO: 200560 - DNA, 36 bp, Artificial Sequence
  Synthetic oligonucleotide
gatagggacggtgaaggagcaatacagggaccaaga

SEQ ID NO: 200561 - DNA, 37 bp, Artificial Sequence
  Synthetic oligonucleotide
gtgggcgggcgtaagggagtactaaagggcgggaaga

SEQ ID NO: 200562 - DNA, 37 bp, Artificial Sequence
  Synthetic oligonucleotide
gacatgagaggagaggtagcgcagcgaaagcatcaga

SEQ ID NO: 200563 - DNA, 37 bp, Artificial Sequence
  Synthetic oligonucleotide
gccactgccgtccgttttccactcctccgcctagaga

SEQ ID NO: 200564 - DNA, 35 bp, Artificial Sequence
  Synthetic oligonucleotide
aatatggggaggggcgagggcaagtttgcaggaga

SEQ ID NO: 200565 - DNA, 37 bp, Artificial Sequence
  Synthetic oligonucleotide
gtgggaagggggaggaggtggactgattgtctggaga

SEQ ID NO: 200566 - DNA, 37 bp, Artificial Sequence
  Synthetic oligonucleotide
tatgtgctcactgcgtaattcgccgcccttttttaga

SEQ ID NO: 200567 - DNA, 36 bp, Artificial Sequence
  Synthetic oligonucleotide
acaccgtcacctctggtcagcacaccctttccacga

SEQ ID NO: 200568 - DNA, 37 bp, Artificial Sequence
  Synthetic oligonucleotide
gacgtaccctcggagttatacataccaccctaaccga

SEQ ID NO: 200569 - DNA, 37 bp, Artificial Sequence
  Synthetic oligonucleotide
gtacccgcccagcggtatgcctgcctgcctctgccga

SEQ ID NO: 200570 - DNA, 37 bp, Artificial Sequence
  Synthetic oligonucleotide
gatggggtcggacaataaagggactcgggggaggcga

SEQ ID NO: 200571 - DNA, 37 bp, Artificial Sequence
  Synthetic oligonucleotide
acacacgcactctgtagtcctaggtcccttctctcga

SEQ ID NO: 200572 - DNA, 37 bp, Artificial Sequence
  Synthetic oligonucleotide
gcacatgagtcagcggagggcaaaggctggtggagga

SEQ ID NO: 200573 - DNA, 36 bp, Artificial Sequence
  Synthetic oligonucleotide
atgcgaggagggcggctttaggaacggtaggtagga

SEQ ID NO: 200574 - DNA, 37 bp, Artificial Sequence
  Synthetic oligonucleotide
gagggggggcttcaacggggatgagggggctgtagga

SEQ ID NO: 200575 - DNA, 37 bp, Artificial Sequence
  Synthetic oligonucleotide
tgtagaggcagaaggagtaaggctgggggttggggga

SEQ ID NO: 200576 - DNA, 35 bp, Artificial Sequence
  Synthetic oligonucleotide
acgacaaacgagagggagggtagaaggtgatggga

SEQ ID NO: 200577 - DNA, 37 bp, Artificial Sequence
  Synthetic oligonucleotide
gacgctggcggggttgtaggtacgggacggggtggga

SEQ ID NO: 200578 - DNA, 38 bp, Artificial Sequence
  Synthetic oligonucleotide
gtagaggggaaagggacgagagaacagttggcccatga

SEQ ID NO: 200579 - DNA, 36 bp, Artificial Sequence
  Synthetic oligonucleotide
gaaagggggaaggggaggaacggaagtggttcatga

SEQ ID NO: 200580 - DNA, 38 bp, Artificial Sequence
  Synthetic oligonucleotide
tgaagtgcaggggtaagggaaagcaaggttgcgggtga

SEQ ID NO: 200581 - DNA, 35 bp, Artificial Sequence
  Synthetic oligonucleotide
ttgaccctctgaccttatgaccgacgccgaattga

SEQ ID NO: 200582 - DNA, 38 bp, Artificial Sequence
  Synthetic oligonucleotide
tcacccacccgtcgtactgccttcatcgtgccacttga

SEQ ID NO: 200583 - DNA, 37 bp, Artificial Sequence
  Synthetic oligonucleotide
tgctgcacctgtgcccccgtcctccaacatgcgttga

SEQ ID NO: 200584 - DNA, 37 bp, Artificial Sequence
  Synthetic oligonucleotide
gcccccccttcaccgtgtccgttagttgtcattttga

SEQ ID NO: 200585 - DNA, 35 bp, Artificial Sequence
  Synthetic oligonucleotide
gcacatcacgtacgtcaaagcgctattattggcta

SEQ ID NO: 200586 - DNA, 35 bp, Artificial Sequence
  Synthetic oligonucleotide
tatgagctccctgtaccattcaccgtcctccgaac

SEQ ID NO: 200587 - DNA, 35 bp, Artificial Sequence
  Synthetic oligonucleotide
gatgtaggaggaggtttagggaggtacataggcac

SEQ ID NO: 200588 - DNA, 35 bp, Artificial Sequence
  Synthetic oligonucleotide
tggaacgcatcaacgcggtccctacttttaccacc

SEQ ID NO: 200589 - DNA, 35 bp, Artificial Sequence
  Synthetic oligonucleotide
acacgactatctgcccatcatatccggcgctgacc

SEQ ID NO: 200590 - DNA, 35 bp, Artificial Sequence
  Synthetic oligonucleotide
tgtccaggcacagctgcttcgcttatgtcacatcc

SEQ ID NO: 200591 - DNA, 35 bp, Artificial Sequence
  Synthetic oligonucleotide
atccacctgccttctgtttgacaagccaccgatcc

SEQ ID NO: 200592 - DNA, 35 bp, Artificial Sequence
  Synthetic oligonucleotide
atgcgcgtaagttcgcttgtatgccgtctcgttcc

SEQ ID NO: 200593 - DNA, 35 bp, Artificial Sequence
  Synthetic oligonucleotide
tagtaccgctgcttcgtaccgctccctgtctctgc

SEQ ID NO: 200594 - DNA, 35 bp, Artificial Sequence
  Synthetic oligonucleotide
aatcggatcaccttcgcatgttgtacgccctcgtc

SEQ ID NO: 200595 - DNA, 35 bp, Artificial Sequence
  Synthetic oligonucleotide
gatggtgaagaggtggggagagacgagcggcacag

SEQ ID NO: 200596 - DNA, 35 bp, Artificial Sequence
  Synthetic oligonucleotide
ttccacgtcgaagggcccgttccatcctaagctag

SEQ ID NO: 200597 - DNA, 35 bp, Artificial Sequence
  Synthetic oligonucleotide
gccgattggatgtgtccccgccgtctgccttcccg

SEQ ID NO: 200598 - DNA, 35 bp, Artificial Sequence
  Synthetic oligonucleotide
actgtacccgtaggtctccttatttgtcatctccg

SEQ ID NO: 200599 - DNA, 35 bp, Artificial Sequence
  Synthetic oligonucleotide
agcaagtgggagggcgggcggctttatcgagatcg

SEQ ID NO: 200600 - DNA, 35 bp, Artificial Sequence
  Synthetic oligonucleotide
gcccggcccctgtcaccatctatttcgtccactcg

SEQ ID NO: 200601 - DNA, 35 bp, Artificial Sequence
  Synthetic oligonucleotide
tgcagaggggtaggcgggattatgacatatggggg

SEQ ID NO: 200602 - DNA, 35 bp, Artificial Sequence
  Synthetic oligonucleotide
gggataggagaggggtgaacaaaagaaggatctgg

SEQ ID NO: 200603 - DNA, 35 bp, Artificial Sequence
  Synthetic oligonucleotide
gggaccccgctcatcccgtctatattgctcttcat

SEQ ID NO: 200604 - DNA, 35 bp, Artificial Sequence
  Synthetic oligonucleotide
gatgacgtcccataccctgttctgatcccccgact

SEQ ID NO: 200605 - DNA, 35 bp, Artificial Sequence
  Synthetic oligonucleotide
actcaaaccgctgttcgaagttccccacctccggt

SEQ ID NO: 200606 - DNA, 35 bp, Artificial Sequence
  Synthetic oligonucleotide
gcccccatcgtaggccttcacctcttccgtgcatt

SEQ ID NO: 200607 - DNA, 35 bp, Artificial Sequence
  Synthetic oligonucleotide
gtcaccagtcgcctgctccttctcgacatagagaa

SEQ ID NO: 200608 - DNA, 36 bp, Artificial Sequence
  Synthetic oligonucleotide
agaagagatagaggagggcaaggacgggagtaataa

SEQ ID NO: 200609 - DNA, 35 bp, Artificial Sequence
  Synthetic oligonucleotide
tgtgtgggtgagggaggattgagagggtccattaa

SEQ ID NO: 200610 - DNA, 36 bp, Artificial Sequence
  Synthetic oligonucleotide
gaaatcgggcggtgacgtgggtgggagtaatgttaa

SEQ ID NO: 200611 - DNA, 36 bp, Artificial Sequence
  Synthetic oligonucleotide
gacaccgcccgacctacttaatacctgcgctacgca

SEQ ID NO: 200612 - DNA, 36 bp, Artificial Sequence
  Synthetic oligonucleotide
tttgggcacgtggacagttgtcttttccacctctca

SEQ ID NO: 200613 - DNA, 37 bp, Artificial Sequence
  Synthetic oligonucleotide
taagtagcggaggaaacgggacggggacggggcaaga

SEQ ID NO: 200614 - DNA, 36 bp, Artificial Sequence
  Synthetic oligonucleotide
tgcactggcccgtctctatctgttgtcctgtccaga

SEQ ID NO: 200615 - DNA, 36 bp, Artificial Sequence
  Synthetic oligonucleotide
atggaagggactaggaggggtcaaggggaacgtaga

SEQ ID NO: 200616 - DNA, 36 bp, Artificial Sequence
  Synthetic oligonucleotide
tgccccctgcgcatcgatatgctccgcctgtcccga

SEQ ID NO: 200617 - DNA, 37 bp, Artificial Sequence
  Synthetic oligonucleotide
gtgcaagtccgtcaactgtactcccaactgcctccga

SEQ ID NO: 200618 - DNA, 37 bp, Artificial Sequence
  Synthetic oligonucleotide
acgcaccaccatctgtcatcagttactctgcctccga

SEQ ID NO: 200619 - DNA, 35 bp, Artificial Sequence
  Synthetic oligonucleotide
tgacatcctccgcactatatatgcgcccccctcga

SEQ ID NO: 200620 - DNA, 37 bp, Artificial Sequence
  Synthetic oligonucleotide
gactggtacggccggtaatttacacctctctcgtcga

SEQ ID NO: 200621 - DNA, 37 bp, Artificial Sequence
  Synthetic oligonucleotide
gcaaagggaaagaggcggggggaaacgcatcggagga

SEQ ID NO: 200622 - DNA, 37 bp, Artificial Sequence
  Synthetic oligonucleotide
gagatgagcaaggtggagcgaaggaggccctggcgga

SEQ ID NO: 200623 - DNA, 37 bp, Artificial Sequence
  Synthetic oligonucleotide
atgtcgagcacgcccccccttcctcgtaggtcctgga

SEQ ID NO: 200624 - DNA, 37 bp, Artificial Sequence
  Synthetic oligonucleotide
agctcatcctctgtgccccgttcccctatccgctgga

SEQ ID NO: 200625 - DNA, 38 bp, Artificial Sequence
  Synthetic oligonucleotide
gcgccgggtcgggatgggatgggctggggtctaaatga

SEQ ID NO: 200626 - DNA, 38 bp, Artificial Sequence
  Synthetic oligonucleotide
gataagcggtgggtaaggggaagtgacgtcaaatgtga

SEQ ID NO: 200627 - DNA, 37 bp, Artificial Sequence
  Synthetic oligonucleotide
gtgccctctgtacgttaaccgcccctgcatcttgtga

SEQ ID NO: 200628 - DNA, 37 bp, Artificial Sequence
  Synthetic oligonucleotide
tatccgccactccgccttcacgtacagactaccttga

SEQ ID NO: 200629 - DNA, 36 bp, Artificial Sequence
  Synthetic oligonucleotide
ttggagagcgggttggtgggtcgaacatgccaaata

SEQ ID NO: 200630 - DNA, 36 bp, Artificial Sequence
  Synthetic oligonucleotide
atgtacagcgatctcctcgtcatccagttcccgcta

SEQ ID NO: 200631 - DNA, 36 bp, Artificial Sequence
  Synthetic oligonucleotide
gtacgcacacgtcacgcccggttaatcattcgctta

SEQ ID NO: 200632 - DNA, 35 bp, Artificial Sequence
  Synthetic oligonucleotide
tgtcgaccccaatctggcttctgtgcaatcccaac

SEQ ID NO: 200633 - DNA, 35 bp, Artificial Sequence
  Synthetic oligonucleotide
gtgctatgtcgattcttggccccacacttgtacac

SEQ ID NO: 200634 - DNA, 35 bp, Artificial Sequence
  Synthetic oligonucleotide
tacgaggtgacggggggaagtgggttagggttcac

SEQ ID NO: 200635 - DNA, 35 bp, Artificial Sequence
  Synthetic oligonucleotide
tgcacatcgccgctctccattgttcatgcccttac

SEQ ID NO: 200636 - DNA, 34 bp, Artificial Sequence
  Synthetic oligonucleotide
gaacacactcatttctgtactgcctcgccacacc

SEQ ID NO: 200637 - DNA, 35 bp, Artificial Sequence
  Synthetic oligonucleotide
gcgtagcgcccatgcccatcgccaccgactacgcc

SEQ ID NO: 200638 - DNA, 35 bp, Artificial Sequence
  Synthetic oligonucleotide
gactcgtgcaagctgtatcctctccgctattgtcc

SEQ ID NO: 200639 - DNA, 35 bp, Artificial Sequence
  Synthetic oligonucleotide
atgtgcacaccatgccaagtgctttcccttcctgc

SEQ ID NO: 200640 - DNA, 35 bp, Artificial Sequence
  Synthetic oligonucleotide
gtctacgcacgatgctcctgagtctccatctctgc

SEQ ID NO: 200641 - DNA, 35 bp, Artificial Sequence
  Synthetic oligonucleotide
tagtctcgccaatggtcctccgccgctctttctgc

SEQ ID NO: 200642 - DNA, 35 bp, Artificial Sequence
  Synthetic oligonucleotide
gtacccatcaagtgtcgttcccggtatcatccatc

SEQ ID NO: 200643 - DNA, 35 bp, Artificial Sequence
  Synthetic oligonucleotide
atgacgcgacgctcgtactgctctggtacctcatc

SEQ ID NO: 200644 - DNA, 35 bp, Artificial Sequence
  Synthetic oligonucleotide
tgacgccatatatcagccggaccttactcacgctc

SEQ ID NO: 200645 - DNA, 35 bp, Artificial Sequence
  Synthetic oligonucleotide
gaagacggtcgcctgttttttcactccctactttc

SEQ ID NO: 200646 - DNA, 35 bp, Artificial Sequence
  Synthetic oligonucleotide
tccctcccctctttgtcttagttcgagccctcccg

SEQ ID NO: 200647 - DNA, 35 bp, Artificial Sequence
  Synthetic oligonucleotide
acccacgcaaggacgtgagcaccctctagccgccg

SEQ ID NO: 200648 - DNA, 35 bp, Artificial Sequence
  Synthetic oligonucleotide
gcgaacgccactaatctgttgtctcctacatctcg

SEQ ID NO: 200649 - DNA, 35 bp, Artificial Sequence
  Synthetic oligonucleotide
gtaacgtagagtggtgcgggtgggactgggaaaat

SEQ ID NO: 200650 - DNA, 35 bp, Artificial Sequence
  Synthetic oligonucleotide
tgactcagcactatcatgctattcgatctgctcct

SEQ ID NO: 200651 - DNA, 35 bp, Artificial Sequence
  Synthetic oligonucleotide
gcgatcccaccctttatgatgctggccctttctct

SEQ ID NO: 200652 - DNA, 35 bp, Artificial Sequence
  Synthetic oligonucleotide
gacatttccagggtgtggaggggtgggataaatgt

SEQ ID NO: 200653 - DNA, 35 bp, Artificial Sequence
  Synthetic oligonucleotide
tttgcatccctgttcctgtcgttccctgcattttt

SEQ ID NO: 200654 - DNA, 35 bp, Artificial Sequence
  Synthetic oligonucleotide
gactgagggtgggtggcgtttttgagcgggtgaaa

SEQ ID NO: 200655 - DNA, 35 bp, Artificial Sequence
  Synthetic oligonucleotide
tgtgaacgacggggtgcaggctagggggaaataaa

SEQ ID NO: 200656 - DNA, 35 bp, Artificial Sequence
  Synthetic oligonucleotide
atgactgcgagtaggggagggctacgggggttcaa

SEQ ID NO: 200657 - DNA, 36 bp, Artificial Sequence
  Synthetic oligonucleotide
aaagacgggggagaaggcggatcggcgtatgctgaa

SEQ ID NO: 200658 - DNA, 35 bp, Artificial Sequence
  Synthetic oligonucleotide
gccattgcacgtttgaccactcatccggtttaaca

SEQ ID NO: 200659 - DNA, 36 bp, Artificial Sequence
  Synthetic oligonucleotide
gagcgcctcacatccggtgccctttctactcgcaca

SEQ ID NO: 200660 - DNA, 36 bp, Artificial Sequence
  Synthetic oligonucleotide
tcacgccgccccctcgctatttatggaaaggaccca

SEQ ID NO: 200661 - DNA, 36 bp, Artificial Sequence
  Synthetic oligonucleotide
tactacaccccttcgaatcgtgcttttggacgccca

SEQ ID NO: 200662 - DNA, 29 bp, Artificial Sequence
  Synthetic oligonucleotide
ttgcgccctcaacctgtcgcccttactca

SEQ ID NO: 200663 - DNA, 36 bp, Artificial Sequence
  Synthetic oligonucleotide
tagccaccgccattgaacctacactcgtcttgctca

SEQ ID NO: 200664 - DNA, 35 bp, Artificial Sequence
  Synthetic oligonucleotide
gtaaaccatccccctccacaccatgactgcggtca

SEQ ID NO: 200665 - DNA, 35 bp, Artificial Sequence
  Synthetic oligonucleotide
atcgcgacacctattatgtccccctctcagtttca

SEQ ID NO: 200666 - DNA, 37 bp, Artificial Sequence
  Synthetic oligonucleotide
aaggggagggacggtaaggcggataacacgactcaga

SEQ ID NO: 200667 - DNA, 35 bp, Artificial Sequence
  Synthetic oligonucleotide
acaccggggaggaaggggtatttcggagggagaga

SEQ ID NO: 200668 - DNA, 37 bp, Artificial Sequence
  Synthetic oligonucleotide
acccagccttgtcctgtgctcacgatcccgccctaga

SEQ ID NO: 200669 - DNA, 37 bp, Artificial Sequence
  Synthetic oligonucleotide
tcacgcgttacccgctgcattcctatccgtctttaga

SEQ ID NO: 200670 - DNA, 36 bp, Artificial Sequence
  Synthetic oligonucleotide
gtcgagaggcgggcatgggggggtactatcgaacga

SEQ ID NO: 200671 - DNA, 35 bp, Artificial Sequence
  Synthetic oligonucleotide
atgccgcccaccccattgattaagcgtactgacga

SEQ ID NO: 200672 - DNA, 36 bp, Artificial Sequence
  Synthetic oligonucleotide
tgacaactgactaattgcttcatgaatacgccccga

SEQ ID NO: 200673 - DNA, 37 bp, Artificial Sequence
  Synthetic oligonucleotide
gacaggcttaactgtgcgttcaaactaccgcctccga

SEQ ID NO: 200674 - DNA, 35 bp, Artificial Sequence
  Synthetic oligonucleotide
gacgcccttccttgtagactcagaattctccgcga

SEQ ID NO: 200675 - DNA, 36 bp, Artificial Sequence
  Synthetic oligonucleotide
agccacgcatcacctcttactctactccccgggcga

SEQ ID NO: 200676 - DNA, 37 bp, Artificial Sequence
  Synthetic oligonucleotide
tgagccggtacggatgtggttcatttcctcccctcga

SEQ ID NO: 200677 - DNA, 37 bp, Artificial Sequence
  Synthetic oligonucleotide
ggtcagggaggggagggaagaggggcgttcctttcga

SEQ ID NO: 200678 - DNA, 35 bp, Artificial Sequence
  Synthetic oligonucleotide
acgagaaaggggggggagataataaagagccagga

SEQ ID NO: 200679 - DNA, 37 bp, Artificial Sequence
  Synthetic oligonucleotide
gagggggacatgaggggcgaagaaggtgtggtgcgga

SEQ ID NO: 200680 - DNA, 37 bp, Artificial Sequence
  Synthetic oligonucleotide
aactgggggcacatggggacaaactatcggtagggga

SEQ ID NO: 200681 - DNA, 37 bp, Artificial Sequence
  Synthetic oligonucleotide
gacaacgggggggaggcacagggggggttactatgga

SEQ ID NO: 200682 - DNA, 37 bp, Artificial Sequence
  Synthetic oligonucleotide
tacacgctgagctccatacgaccctgcctctccatga

SEQ ID NO: 200683 - DNA, 36 bp, Artificial Sequence
  Synthetic oligonucleotide
tagccgcatacgatcctgttcaattctacgccctga

SEQ ID NO: 200684 - DNA, 38 bp, Artificial Sequence
  Synthetic oligonucleotide
atgactcgtcaatatctccgtcctgtctcgtcgcctga

SEQ ID NO: 200685 - DNA, 35 bp, Artificial Sequence
  Synthetic oligonucleotide
ttgccaccctgcatagttcattcgaccactcctga

SEQ ID NO: 200686 - DNA, 37 bp, Artificial Sequence
  Synthetic oligonucleotide
tcacgacgggtggacgggagggggtcagagaggctga

SEQ ID NO: 200687 - DNA, 38 bp, Artificial Sequence
  Synthetic oligonucleotide
tcataggtcgggcggagggtgggtgtaggacacggtga

SEQ ID NO: 200688 - DNA, 38 bp, Artificial Sequence
  Synthetic oligonucleotide
tactgccccattctgttccctagcacgacggttcttga

SEQ ID NO: 200689 - DNA, 36 bp, Artificial Sequence
  Synthetic oligonucleotide
aacagccacgcagcttctgtacaccatccctgttga

SEQ ID NO: 200690 - DNA, 35 bp, Artificial Sequence
  Synthetic oligonucleotide
gagcccagtcaagccctgcaccatcgcggtcacta

SEQ ID NO: 200691 - DNA, 35 bp, Artificial Sequence
  Synthetic oligonucleotide
gaatgcaaagaagggaagggggataggggcatgta

SEQ ID NO: 200692 - DNA, 35 bp, Artificial Sequence
  Synthetic oligonucleotide
gcaagctacttgcgcttagtttcggtacttcccac

SEQ ID NO: 200693 - DNA, 35 bp, Artificial Sequence
  Synthetic oligonucleotide
agcacacaatgcgtgtcttttcgaactccccgtac

SEQ ID NO: 200694 - DNA, 34 bp, Artificial Sequence
  Synthetic oligonucleotide
tcaacaagcgcacccttcgccccgtcccgcgccc

SEQ ID NO: 200695 - DNA, 35 bp, Artificial Sequence
  Synthetic oligonucleotide
tgagcctccccctctgcgtgtcatgctgattgccc

SEQ ID NO: 200696 - DNA, 35 bp, Artificial Sequence
  Synthetic oligonucleotide
tccacccagcctcggttttctattccagtactccc

SEQ ID NO: 200697 - DNA, 32 bp, Artificial Sequence
  Synthetic oligonucleotide
tatgtatcgcccccacgagtcttttgcttccc

SEQ ID NO: 200698 - DNA, 35 bp, Artificial Sequence
  Synthetic oligonucleotide
tgtacgcatcgaggcaattatatcgcccacctgcc

SEQ ID NO: 200699 - DNA, 35 bp, Artificial Sequence
  Synthetic oligonucleotide
accgtgggtgcgctgtttacgttgtacgcctgtcc

SEQ ID NO: 200700 - DNA, 35 bp, Artificial Sequence
  Synthetic oligonucleotide
gcacctccataagtcgtacccgaggtcactgttcc

SEQ ID NO: 200701 - DNA, 35 bp, Artificial Sequence
  Synthetic oligonucleotide
tgccaacccccactcaatgtttcggatcattcatc

SEQ ID NO: 200702 - DNA, 35 bp, Artificial Sequence
  Synthetic oligonucleotide
tagcaccacattgctcgtccgtgacccatcgcctc

SEQ ID NO: 200703 - DNA, 35 bp, Artificial Sequence
  Synthetic oligonucleotide
gaactgtgcctcgcatcatcttactaacaactctc

SEQ ID NO: 200704 - DNA, 35 bp, Artificial Sequence
  Synthetic oligonucleotide
ttggccaatacgattcgtgttctccgcgccccttc

SEQ ID NO: 200705 - DNA, 35 bp, Artificial Sequence
  Synthetic oligonucleotide
tacaaccgtactcttagtatacctgcacccggttc

SEQ ID NO: 200706 - DNA, 34 bp, Artificial Sequence
  Synthetic oligonucleotide
ttggcacctccacatgatttacccctccctgttc

SEQ ID NO: 200707 - DNA, 35 bp, Artificial Sequence
  Synthetic oligonucleotide
gggggtgagggtcggggggggtgtagcagggaccg

SEQ ID NO: 200708 - DNA, 35 bp, Artificial Sequence
  Synthetic oligonucleotide
tccagcacaccgcttaccaaccgtacccttacccg

SEQ ID NO: 200709 - DNA, 35 bp, Artificial Sequence
  Synthetic oligonucleotide
tggtggcctgatgttagtcttagctccctcctccg

SEQ ID NO: 200710 - DNA, 35 bp, Artificial Sequence
  Synthetic oligonucleotide
gccatctgcatgctttaactactctccgcgtggcg

SEQ ID NO: 200711 - DNA, 35 bp, Artificial Sequence
  Synthetic oligonucleotide
gcctcgcctccgttccccattgttattcgtattcg

SEQ ID NO: 200712 - DNA, 35 bp, Artificial Sequence
  Synthetic oligonucleotide
agcacctcggttcgaaccttggccttacatcttcg

SEQ ID NO: 200713 - DNA, 35 bp, Artificial Sequence
  Synthetic oligonucleotide
atgtgtggcggggggggatatagagataatcatgg

SEQ ID NO: 200714 - DNA, 35 bp, Artificial Sequence
  Synthetic oligonucleotide
tcccgccacgggccatcaagaacctcccccattgg

SEQ ID NO: 200715 - DNA, 35 bp, Artificial Sequence
  Synthetic oligonucleotide
atcgacctggccacattcttccttcctccgcaatg

SEQ ID NO: 200716 - DNA, 35 bp, Artificial Sequence
  Synthetic oligonucleotide
gtgggaagggggacgagtaagggaaggggacgatg

SEQ ID NO: 200717 - DNA, 35 bp, Artificial Sequence
  Synthetic oligonucleotide
ttgacgcgaggggagaatcggatgaacgaagggtg

SEQ ID NO: 200718 - DNA, 35 bp, Artificial Sequence
  Synthetic oligonucleotide
accacacccacgtgccgttttgaactcattccaat

SEQ ID NO: 200719 - DNA, 35 bp, Artificial Sequence
  Synthetic oligonucleotide
atgggagggaggggcgggtaagaggcagggggcat

SEQ ID NO: 200720 - DNA, 32 bp, Artificial Sequence
  Synthetic oligonucleotide
gtcgaacatccagcccttgagccacacgttat

SEQ ID NO: 200721 - DNA, 35 bp, Artificial Sequence
  Synthetic oligonucleotide
gcaccagcactacgtcttactcgctccagcatcct

SEQ ID NO: 200722 - DNA, 35 bp, Artificial Sequence
  Synthetic oligonucleotide
gaaggggtggagagaaggcacgttgaagagaggct

SEQ ID NO: 200723 - DNA, 35 bp, Artificial Sequence
  Synthetic oligonucleotide
tttcaacgtaacacctgttcagatgtccctctcgt

SEQ ID NO: 200724 - DNA, 35 bp, Artificial Sequence
  Synthetic oligonucleotide
tgcggatctacctctccgtcgcgtgagcccatatt

SEQ ID NO: 200725 - DNA, 35 bp, Artificial Sequence
  Synthetic oligonucleotide
gcaccatcacacctgccgtatggtgacttgtcttt

SEQ ID NO: 200726 - DNA, 36 bp, Artificial Sequence
  Synthetic oligonucleotide
tcacgtacgcatggggggactaaaggcggtggtaaa

SEQ ID NO: 200727 - DNA, 35 bp, Artificial Sequence
  Synthetic oligonucleotide
ttcgtccccggctacatggccctccattcatgcaa

SEQ ID NO: 200728 - DNA, 30 bp, Artificial Sequence
  Synthetic oligonucleotide
ttgacatcccactctgttagtcttccacca

SEQ ID NO: 200729 - DNA, 36 bp, Artificial Sequence
  Synthetic oligonucleotide
acgcaccatcgcctagtctgttcccatctgcctcca

SEQ ID NO: 200730 - DNA, 35 bp, Artificial Sequence
  Synthetic oligonucleotide
gcgctagcgctagtcgattactctgttccgctcca

SEQ ID NO: 200731 - DNA, 35 bp, Artificial Sequence
  Synthetic oligonucleotide
ttgcacttatcagccgctcgccgagtccgcttcca

SEQ ID NO: 200732 - DNA, 36 bp, Artificial Sequence
  Synthetic oligonucleotide
gatgcacctccgatactctggccgttcccctttgca

SEQ ID NO: 200733 - DNA, 36 bp, Artificial Sequence
  Synthetic oligonucleotide
gcgacgtggcctcaccgcatttatgattgcctctca

SEQ ID NO: 200734 - DNA, 36 bp, Artificial Sequence
  Synthetic oligonucleotide
gatccgcgcttgaactcgtccgcccctttgctctca

SEQ ID NO: 200735 - DNA, 37 bp, Artificial Sequence
  Synthetic oligonucleotide
gactcatcacccctctcgcgtcgttcctctaggaaga

SEQ ID NO: 200736 - DNA, 37 bp, Artificial Sequence
  Synthetic oligonucleotide
agtgagaggcgggtaaggtatgctcgggagggggaga

SEQ ID NO: 200737 - DNA, 37 bp, Artificial Sequence
  Synthetic oligonucleotide
taacacccctcatctgtccagttccctcaccgtgaga

SEQ ID NO: 200738 - DNA, 36 bp, Artificial Sequence
  Synthetic oligonucleotide
acatcaacctagttgtacctaattgccacttcccga

SEQ ID NO: 200739 - DNA, 38 bp, Artificial Sequence
  Synthetic oligonucleotide
aactagggggtgggggggcttgggaaccacaagcgcga

SEQ ID NO: 200740 - DNA, 37 bp, Artificial Sequence
  Synthetic oligonucleotide
gatctccctcccctctgttcccgagctgcctggtcga

SEQ ID NO: 200741 - DNA, 37 bp, Artificial Sequence
  Synthetic oligonucleotide
acaacagtgatcgggtggggggactacgagggcagga

SEQ ID NO: 200742 - DNA, 36 bp, Artificial Sequence
  Synthetic oligonucleotide
ttcacggtaagatgggcggggggaacggatgacgga

SEQ ID NO: 200743 - DNA, 37 bp, Artificial Sequence
  Synthetic oligonucleotide
gagggtagccgaggactctaggaacggaggagaggga

SEQ ID NO: 200744 - DNA, 36 bp, Artificial Sequence
  Synthetic oligonucleotide
gtcgtgaacgggatggaggtgcaattatgggaggga

SEQ ID NO: 200745 - DNA, 35 bp, Artificial Sequence
  Synthetic oligonucleotide
ttccgcccgggccttcccatgtacagattcttgga

SEQ ID NO: 200746 - DNA, 37 bp, Artificial Sequence
  Synthetic oligonucleotide
gtgggcgacagggtagaggaagggaaaccggggatga

SEQ ID NO: 200747 - DNA, 37 bp, Artificial Sequence
  Synthetic oligonucleotide
gctccgtgcctcggtactatctctgtcatacgtatga

SEQ ID NO: 200748 - DNA, 36 bp, Artificial Sequence
  Synthetic oligonucleotide
acgctacgccggctactttcgacctatcttcgctga

SEQ ID NO: 200749 - DNA, 38 bp, Artificial Sequence
  Synthetic oligonucleotide
ttggtgcgcaagtaaagggcaagggcggtgagggttga

SEQ ID NO: 200750 - DNA, 38 bp, Artificial Sequence
  Synthetic oligonucleotide
actcagagaggaggggggcgaggagacatgctgtttga

SEQ ID NO: 200751 - DNA, 36 bp, Artificial Sequence
  Synthetic oligonucleotide
gtcaccgctatcgtgccattgctactcgtcttcata

SEQ ID NO: 200752 - DNA, 36 bp, Artificial Sequence
  Synthetic oligonucleotide
gcaccctccacgagtcctaatcacctgtcttaccta

SEQ ID NO: 200753 - DNA, 35 bp, Artificial Sequence
  Synthetic oligonucleotide
atgatgacgtgtcgatatgcatttaccaccctcta

SEQ ID NO: 200754 - DNA, 36 bp, Artificial Sequence
  Synthetic oligonucleotide
agggtgggcgggtcgtagaagtaccatcgcggggta

SEQ ID NO: 200755 - DNA, 35 bp, Artificial Sequence
  Synthetic oligonucleotide
acgcaactctgctgatccatgccactcttcttaac

SEQ ID NO: 200756 - DNA, 35 bp, Artificial Sequence
  Synthetic oligonucleotide
ggtgacgcccctgttagttatacctagcccctacc

SEQ ID NO: 200757 - DNA, 35 bp, Artificial Sequence
  Synthetic oligonucleotide
agcacgccacgtgcatgcttttcgccaccaaaccc

SEQ ID NO: 200758 - DNA, 34 bp, Artificial Sequence
  Synthetic oligonucleotide
tcagatctgcgcccagtgtatgtcctccgcgccc

SEQ ID NO: 200759 - DNA, 35 bp, Artificial Sequence
  Synthetic oligonucleotide
tccgacggccttaggttgctgccacattcgctccc

SEQ ID NO: 200760 - DNA, 34 bp, Artificial Sequence
  Synthetic oligonucleotide
tgtgcctcccagccccagaccgtttctgcccgcc

SEQ ID NO: 200761 - DNA, 35 bp, Artificial Sequence
  Synthetic oligonucleotide
ttacatcgggatgagtgaagctgggggggagggcc

SEQ ID NO: 200762 - DNA, 35 bp, Artificial Sequence
  Synthetic oligonucleotide
tgatacgcaatctgacctgcctggtactatcctcc

SEQ ID NO: 200763 - DNA, 35 bp, Artificial Sequence
  Synthetic oligonucleotide
gccgactggtcggcgagtgtaaacacttttattcc

SEQ ID NO: 200764 - DNA, 35 bp, Artificial Sequence
  Synthetic oligonucleotide
gtatgtgcctgctgccgcctaagacgagcttttcc

SEQ ID NO: 200765 - DNA, 35 bp, Artificial Sequence
  Synthetic oligonucleotide
ttgagcatctgaacgtcttcactcccgtccatagc

SEQ ID NO: 200766 - DNA, 35 bp, Artificial Sequence
  Synthetic oligonucleotide
atgtgcacggaagggaggaaaagtggaggaggcgc

SEQ ID NO: 200767 - DNA, 35 bp, Artificial Sequence
  Synthetic oligonucleotide
tttaccgcccgatctgctttcgtacaccccttggc

SEQ ID NO: 200768 - DNA, 35 bp, Artificial Sequence
  Synthetic oligonucleotide
accacacctgccaaaccggtgtactgacttcttgc

SEQ ID NO: 200769 - DNA, 35 bp, Artificial Sequence
  Synthetic oligonucleotide
gcagtcctagatcgtttgtcagcccccgcttcatc

SEQ ID NO: 200770 - DNA, 35 bp, Artificial Sequence
  Synthetic oligonucleotide
tgtgcatcacggtcctacgcgtacatttctttttc

SEQ ID NO: 200771 - DNA, 35 bp, Artificial Sequence
  Synthetic oligonucleotide
gtcaccactcgcacatcttgaacggcccttccgag

SEQ ID NO: 200772 - DNA, 35 bp, Artificial Sequence
  Synthetic oligonucleotide
atctgcctccattgacctattcgcacgggtttccg

SEQ ID NO: 200773 - DNA, 35 bp, Artificial Sequence
  Synthetic oligonucleotide
gtgacgaggaaagaagtaggagggaacgcgggtcg

SEQ ID NO: 200774 - DNA, 35 bp, Artificial Sequence
  Synthetic oligonucleotide
accgcataccactggccttattgacttcccacctg

SEQ ID NO: 200775 - DNA, 35 bp, Artificial Sequence
  Synthetic oligonucleotide
ttgccgttccatcgtcgccgagtttaatccccttg

SEQ ID NO: 200776 - DNA, 35 bp, Artificial Sequence
  Synthetic oligonucleotide
tccgcccccttctaccgttgtatgattgttccact

SEQ ID NO: 200777 - DNA, 35 bp, Artificial Sequence
  Synthetic oligonucleotide
atagcctcatcccgttggacaccgacgtttcgcct

SEQ ID NO: 200778 - DNA, 35 bp, Artificial Sequence
  Synthetic oligonucleotide
ttccgtccgctctctcacgtgtcgtcctgtttcct

SEQ ID NO: 200779 - DNA, 35 bp, Artificial Sequence
  Synthetic oligonucleotide
gtcaaccccctggcatcgtgctatatttctgcgct

SEQ ID NO: 200780 - DNA, 35 bp, Artificial Sequence
  Synthetic oligonucleotide
accgcgtgtaagggatgagggtgggaggtgagagt

SEQ ID NO: 200781 - DNA, 35 bp, Artificial Sequence
  Synthetic oligonucleotide
tctacgccatttcctccgtacattgtgactctggt

SEQ ID NO: 200782 - DNA, 35 bp, Artificial Sequence
  Synthetic oligonucleotide
acacccgcccgacctgtcatcctgagttcactatt

SEQ ID NO: 200783 - DNA, 35 bp, Artificial Sequence
  Synthetic oligonucleotide
gctagtagcacggatccgaaatcgtaccacccctt

SEQ ID NO: 200784 - DNA, 35 bp, Artificial Sequence
  Synthetic oligonucleotide
tgatccgcgcctgcctatcctcgggttacgccttt

SEQ ID NO: 200785 - DNA, 35 bp, Artificial Sequence
  Synthetic oligonucleotide
gacgggcgggggggggacaagcggaagggcgtaaa

SEQ ID NO: 200786 - DNA, 36 bp, Artificial Sequence
  Synthetic oligonucleotide
gtgacaagcaggaggaattagaggtggagcacagaa

SEQ ID NO: 200787 - DNA, 36 bp, Artificial Sequence
  Synthetic oligonucleotide
tacctgccgggggggggtaaaatgcttgggagggaa

SEQ ID NO: 200788 - DNA, 36 bp, Artificial Sequence
  Synthetic oligonucleotide
tgttgacagagcggggaaatgggatgatagggggaa

SEQ ID NO: 200789 - DNA, 36 bp, Artificial Sequence
  Synthetic oligonucleotide
acacgacaccatctcacgcgtaaactggagtgccca

SEQ ID NO: 200790 - DNA, 35 bp, Artificial Sequence
  Synthetic oligonucleotide
accgttaccgccacatttgctcctcctctgtgcca

SEQ ID NO: 200791 - DNA, 36 bp, Artificial Sequence
  Synthetic oligonucleotide
tatgccctccacttgtcctcttggtacgtgtatcca

SEQ ID NO: 200792 - DNA, 34 bp, Artificial Sequence
  Synthetic oligonucleotide
tgggacaccctcacgccacgccttgacgccctca

SEQ ID NO: 200793 - DNA, 37 bp, Artificial Sequence
  Synthetic oligonucleotide
tacgcaggccccctcctcctcttgatcgttatgcaga

SEQ ID NO: 200794 - DNA, 37 bp, Artificial Sequence
  Synthetic oligonucleotide
gtcaacctcctgcccgcttcgcacttcaccttcgaga

SEQ ID NO: 200795 - DNA, 37 bp, Artificial Sequence
  Synthetic oligonucleotide
acagacaagagcgcttggggctggaggaggagggaga

SEQ ID NO: 200796 - DNA, 37 bp, Artificial Sequence
  Synthetic oligonucleotide
ggaggggcaggtgcgggtaagtggggcagagtggaga

SEQ ID NO: 200797 - DNA, 37 bp, Artificial Sequence
  Synthetic oligonucleotide
ttggcacgaggaggagggataggcataggtggtgaga

SEQ ID NO: 200798 - DNA, 37 bp, Artificial Sequence
  Synthetic oligonucleotide
atgccgggtgagcctgggagggaccgggaatgcacga

SEQ ID NO: 200799 - DNA, 37 bp, Artificial Sequence
  Synthetic oligonucleotide
gacgggggggtgggttgattgaggtgacagtagacga

SEQ ID NO: 200800 - DNA, 36 bp, Artificial Sequence
  Synthetic oligonucleotide
tagtgtcctcaccccgttctcttcctgcccgcccga

SEQ ID NO: 200801 - DNA, 35 bp, Artificial Sequence
  Synthetic oligonucleotide
acacacacccacaactgattaagtcgaaacgtcga

SEQ ID NO: 200802 - DNA, 35 bp, Artificial Sequence
  Synthetic oligonucleotide
gtaccacctctataacgcctgtacacctcaactga

SEQ ID NO: 200803 - DNA, 38 bp, Artificial Sequence
  Synthetic oligonucleotide
gcaacctgctcccaccgtggacttcgcctccatactga

SEQ ID NO: 200804 - DNA, 37 bp, Artificial Sequence
  Synthetic oligonucleotide
gagtagcatggcggggggggggaggatacagccgtga

SEQ ID NO: 200805 - DNA, 38 bp, Artificial Sequence
  Synthetic oligonucleotide
tgggacgggtggagcatagggaagagcggaggtggtga

SEQ ID NO: 200806 - DNA, 38 bp, Artificial Sequence
  Synthetic oligonucleotide
ttagagcgccgacccgattgccaccctcccccatgtga

SEQ ID NO: 200807 - DNA, 38 bp, Artificial Sequence
  Synthetic oligonucleotide
tagcgatcgcacttagtgttgcctctttcgccctttga

SEQ ID NO: 200808 - DNA, 35 bp, Artificial Sequence
  Synthetic oligonucleotide
ttgtcacacccgtacccccagtccaatctctttga

SEQ ID NO: 200809 - DNA, 37 bp, Artificial Sequence
  Synthetic oligonucleotide
agcgtaggtacaagaggaaggggtagggacggcggta

SEQ ID NO: 200810 - DNA, 35 bp, Artificial Sequence
  Synthetic oligonucleotide
gtgacggaaaacggaggaaatagggagggctggta

SEQ ID NO: 200811 - DNA, 36 bp, Artificial Sequence
  Synthetic oligonucleotide
taccagcgcaattgccgatccaccttctcgtttgta

SEQ ID NO: 200812 - DNA, 36 bp, Artificial Sequence
  Synthetic oligonucleotide
gcaacgacccgtgtaccctctcgctgtacgccctta

SEQ ID NO: 200813 - DNA, 35 bp, Artificial Sequence
  Synthetic oligonucleotide
gtgccatacgcagaactgcgctatccaaacctgac

SEQ ID NO: 200814 - DNA, 35 bp, Artificial Sequence
  Synthetic oligonucleotide
gcacgccagtctcccatctgcgcaaccccggtgac

SEQ ID NO: 200815 - DNA, 35 bp, Artificial Sequence
  Synthetic oligonucleotide
taccctcgctcccttggtaggatccattcacttac

SEQ ID NO: 200816 - DNA, 35 bp, Artificial Sequence
  Synthetic oligonucleotide
acaccgcaacctgctgactcccttagtgtggaacc

SEQ ID NO: 200817 - DNA, 35 bp, Artificial Sequence
  Synthetic oligonucleotide
gctgcccgacacctggtcgcgcgccgttaaccacc

SEQ ID NO: 200818 - DNA, 35 bp, Artificial Sequence
  Synthetic oligonucleotide
tcctgccaccacatcgcatactctttctcggtacc

SEQ ID NO: 200819 - DNA, 35 bp, Artificial Sequence
  Synthetic oligonucleotide
actcgccccatctctctgtttcgcagaactgcgcc

SEQ ID NO: 200820 - DNA, 35 bp, Artificial Sequence
  Synthetic oligonucleotide
tcccgcccccatctctatatcatgtcgctaatgcc

SEQ ID NO: 200821 - DNA, 35 bp, Artificial Sequence
  Synthetic oligonucleotide
gacacgcctccgctagtcaggccgtcgcacctgcc

SEQ ID NO: 200822 - DNA, 35 bp, Artificial Sequence
  Synthetic oligonucleotide
ttacgtaccgtccaagtgttgcccctgccgaccgc

SEQ ID NO: 200823 - DNA, 35 bp, Artificial Sequence
  Synthetic oligonucleotide
attcaccccgccccgattcacaatatcgtgccatc

SEQ ID NO: 200824 - DNA, 35 bp, Artificial Sequence
  Synthetic oligonucleotide
gtgcacagtaagttacgtcattccggctctttatc

SEQ ID NO: 200825 - DNA, 35 bp, Artificial Sequence
  Synthetic oligonucleotide
tccagcacccaatgcatcgtacattactttcactc

SEQ ID NO: 200826 - DNA, 35 bp, Artificial Sequence
  Synthetic oligonucleotide
gataaccggtacccctagccgcccttcttgtactc

SEQ ID NO: 200827 - DNA, 35 bp, Artificial Sequence
  Synthetic oligonucleotide
gagatagctgccatgtttttaccgtcctgcacctc

SEQ ID NO: 200828 - DNA, 35 bp, Artificial Sequence
  Synthetic oligonucleotide
ttgcgcatctcctgtctctcggtctctcgtaagtc

SEQ ID NO: 200829 - DNA, 35 bp, Artificial Sequence
  Synthetic oligonucleotide
gtgggctggggcgggtgaacagggcaattgaattc

SEQ ID NO: 200830 - DNA, 35 bp, Artificial Sequence
  Synthetic oligonucleotide
gagagctgtcaggtgcactcttgtctacacccttc

SEQ ID NO: 200831 - DNA, 35 bp, Artificial Sequence
  Synthetic oligonucleotide
tgtagggcgggaggggtgcggttcggtggctctag

SEQ ID NO: 200832 - DNA, 35 bp, Artificial Sequence
  Synthetic oligonucleotide
tcatcccaatcatctgagtttttagcctttccacg

SEQ ID NO: 200833 - DNA, 35 bp, Artificial Sequence
  Synthetic oligonucleotide
acaacttcagcgccctctgaccgacctgtcctccg

SEQ ID NO: 200834 - DNA, 35 bp, Artificial Sequence
  Synthetic oligonucleotide
gacccgtcccagatgcttttttcctccctaacagg

SEQ ID NO: 200835 - DNA, 36 bp, Artificial Sequence
  Synthetic oligonucleotide
tgtgcacggtgcagatctcttcgaccactcccttgg

SEQ ID NO: 200836 - DNA, 35 bp, Artificial Sequence
  Synthetic oligonucleotide
gatgcaccgagcggatccccttaccctcagtttgg

SEQ ID NO: 200837 - DNA, 35 bp, Artificial Sequence
  Synthetic oligonucleotide
atccaccccctcccgatgtccatcgttgtcttact

SEQ ID NO: 200838 - DNA, 33 bp, Artificial Sequence
  Synthetic oligonucleotide
tcccgcggccacttctgcctattgttcacttct

SEQ ID NO: 200839 - DNA, 35 bp, Artificial Sequence
  Synthetic oligonucleotide
tgtgtgcgtgcagactggagctcctctcgccttct

SEQ ID NO: 200840 - DNA, 35 bp, Artificial Sequence
  Synthetic oligonucleotide
gtttcagcacacacccattgtctctctcgctccgt

SEQ ID NO: 200841 - DNA, 35 bp, Artificial Sequence
  Synthetic oligonucleotide
actccccgccgtggtcgcattggttagtattccgt

SEQ ID NO: 200842 - DNA, 35 bp, Artificial Sequence
  Synthetic oligonucleotide
gtgaggacggctgtagtagcggggggcggcactgt

SEQ ID NO: 200843 - DNA, 35 bp, Artificial Sequence
  Synthetic oligonucleotide
acatgctgtcgttccatacggtagtagtgctcctt

SEQ ID NO: 200844 - DNA, 35 bp, Artificial Sequence
  Synthetic oligonucleotide
tgttacctcctgtgattagctcccatgagtctctt

SEQ ID NO: 200845 - DNA, 35 bp, Artificial Sequence
  Synthetic oligonucleotide
atcgcggtcaagggaacggaagcaggaaggggaaa

SEQ ID NO: 200846 - DNA, 36 bp, Artificial Sequence
  Synthetic oligonucleotide
acagccccaatttttgttactgcctcttgcgctcaa

SEQ ID NO: 200847 - DNA, 36 bp, Artificial Sequence
  Synthetic oligonucleotide
aaagaggggaggcggtgcggtggtcggtaaggcgaa

SEQ ID NO: 200848 - DNA, 36 bp, Artificial Sequence
  Synthetic oligonucleotide
gggaagggagagagagggtggtatagacagagggaa

SEQ ID NO: 200849 - DNA, 35 bp, Artificial Sequence
  Synthetic oligonucleotide
gggagggcaagggagcctacgggaggtattgttaa

SEQ ID NO: 200850 - DNA, 35 bp, Artificial Sequence
  Synthetic oligonucleotide
tgttcgcctcacaccatgctatcgaccggtctaca

SEQ ID NO: 200851 - DNA, 36 bp, Artificial Sequence
  Synthetic oligonucleotide
taccgcgatcagttggcaaattccccacgcgctcca

SEQ ID NO: 200852 - DNA, 36 bp, Artificial Sequence
  Synthetic oligonucleotide
gtgcgatagccggttctctgttcttcgttccttcca

SEQ ID NO: 200853 - DNA, 35 bp, Artificial Sequence
  Synthetic oligonucleotide
tttggaccaccgccccgattccgtttcagtgagca

SEQ ID NO: 200854 - DNA, 35 bp, Artificial Sequence
  Synthetic oligonucleotide
atccgccctcggtgtaatgccccgcctgcgccgca

SEQ ID NO: 200855 - DNA, 35 bp, Artificial Sequence
  Synthetic oligonucleotide
accacccgcccgttgctcatgttcttcgcttggca

SEQ ID NO: 200856 - DNA, 36 bp, Artificial Sequence
  Synthetic oligonucleotide
ttcacctcccgcagaatcggttctcactcactctca

SEQ ID NO: 200857 - DNA, 36 bp, Artificial Sequence
  Synthetic oligonucleotide
aaagacacagatgtatgggggtggtggagcgggtca

SEQ ID NO: 200858 - DNA, 35 bp, Artificial Sequence
  Synthetic oligonucleotide
tcgctccgacaccgattcaccctcgccctgtttca

SEQ ID NO: 200859 - DNA, 36 bp, Artificial Sequence
  Synthetic oligonucleotide
acatcgtcggttagtactccccctctttgtgccaga

SEQ ID NO: 200860 - DNA, 36 bp, Artificial Sequence
  Synthetic oligonucleotide
ttgaggtacgaggggagggagcaattggtcggtaga

SEQ ID NO: 200861 - DNA, 36 bp, Artificial Sequence
  Synthetic oligonucleotide
gtggacggaagacgggagtaagtaggtaagggtaga

SEQ ID NO: 200862 - DNA, 37 bp, Artificial Sequence
  Synthetic oligonucleotide
agcacagcagatctctctctcccctctcacaggacga

SEQ ID NO: 200863 - DNA, 37 bp, Artificial Sequence
  Synthetic oligonucleotide
gaccaccgttcctgccttccctgacatgtcttgtcga

SEQ ID NO: 200864 - DNA, 37 bp, Artificial Sequence
  Synthetic oligonucleotide
tacgggcgggaggtgtgggtagagccggagcttagga

SEQ ID NO: 200865 - DNA, 37 bp, Artificial Sequence
  Synthetic oligonucleotide
agtagagagtgagcaagggaaatcaggagggggcgga

SEQ ID NO: 200866 - DNA, 37 bp, Artificial Sequence
  Synthetic oligonucleotide
ttggagagggagatagaaacggacgcagatcggggga

SEQ ID NO: 200867 - DNA, 37 bp, Artificial Sequence
  Synthetic oligonucleotide
ttggacaaggcggaggggcatcaaggccgggtgggga

SEQ ID NO: 200868 - DNA, 37 bp, Artificial Sequence
  Synthetic oligonucleotide
atggatgcggaatccgatatgcacctctcgctctgga

SEQ ID NO: 200869 - DNA, 35 bp, Artificial Sequence
  Synthetic oligonucleotide
tggacgggaaagggtgcggagggtaactcattgga

SEQ ID NO: 200870 - DNA, 35 bp, Artificial Sequence
  Synthetic oligonucleotide
ttgaccgcgcctacctcccgcccgtcgaattatga

SEQ ID NO: 200871 - DNA, 38 bp, Artificial Sequence
  Synthetic oligonucleotide
gctcacttcgcctgccatttatcgaggacctttcctga

SEQ ID NO: 200872 - DNA, 38 bp, Artificial Sequence
  Synthetic oligonucleotide
tcagccgccccctagcttgttgaaacgcctctctctga

SEQ ID NO: 200873 - DNA, 37 bp, Artificial Sequence
  Synthetic oligonucleotide
tgagtgtctgctcgcttatctgttcgtgcctccgtga

SEQ ID NO: 200874 - DNA, 38 bp, Artificial Sequence
  Synthetic oligonucleotide
tcaacggggggggatgaagaagcagaacgaccaggtga

SEQ ID NO: 200875 - DNA, 38 bp, Artificial Sequence
  Synthetic oligonucleotide
tgatgcgggacaagcaaggagggggcacagtggggtga

SEQ ID NO: 200876 - DNA, 37 bp, Artificial Sequence
  Synthetic oligonucleotide
tccatcctcgctttttcaccgcgacatctcccattga

SEQ ID NO: 200877 - DNA, 36 bp, Artificial Sequence
  Synthetic oligonucleotide
tgtccgggatgggtgggacaatgggaggatcattga

SEQ ID NO: 200878 - DNA, 38 bp, Artificial Sequence
  Synthetic oligonucleotide
tgcgcccagatccttgattcgccgccctcgtttcttga

SEQ ID NO: 200879 - DNA, 36 bp, Artificial Sequence
  Synthetic oligonucleotide
gtatgccgccgtatcctctgcctatcaagcttttga

SEQ ID NO: 200880 - DNA, 36 bp, Artificial Sequence
  Synthetic oligonucleotide
gcaccgcgggtgttttgccactttcccgctgatcta

SEQ ID NO: 200881 - DNA, 35 bp, Artificial Sequence
  Synthetic oligonucleotide
atcaccgccgactcccccacgtaatgcttgtgtta

SEQ ID NO: 200882 - DNA, 38 bp, Artificial Sequence
  Synthetic oligonucleotide
acaggaggcggatgggacgtggtgtgggcggatcttta

SEQ ID NO: 200883 - DNA, 35 bp, Artificial Sequence
  Synthetic oligonucleotide
gtccgtaccggcacactgaatcatgacccttcgac

SEQ ID NO: 200884 - DNA, 35 bp, Artificial Sequence
  Synthetic oligonucleotide
gtgccaaccctcatcccaattgctttacaggctac

SEQ ID NO: 200885 - DNA, 35 bp, Artificial Sequence
  Synthetic oligonucleotide
gacgggccagagctgtcctccgcagttatacatcc

SEQ ID NO: 200886 - DNA, 35 bp, Artificial Sequence
  Synthetic oligonucleotide
agcctatgccaactgcctacatcgaaacttgatcc

SEQ ID NO: 200887 - DNA, 33 bp, Artificial Sequence
  Synthetic oligonucleotide
tcagacgctctgagcttgttcctacacccccgc

SEQ ID NO: 200888 - DNA, 35 bp, Artificial Sequence
  Synthetic oligonucleotide
tacctagccctggtgttctgtcctctctcacgcgc

SEQ ID NO: 200889 - DNA, 35 bp, Artificial Sequence
  Synthetic oligonucleotide
aatgacacccctgatttaggtaacaccctttgcgc

SEQ ID NO: 200890 - DNA, 35 bp, Artificial Sequence
  Synthetic oligonucleotide
gcgctcccctcacgctcgcatcaccctattagtgc

SEQ ID NO: 200891 - DNA, 35 bp, Artificial Sequence
  Synthetic oligonucleotide
gccacgcattatcgtaaaagccacccctgtttatc

SEQ ID NO: 200892 - DNA, 35 bp, Artificial Sequence
  Synthetic oligonucleotide
tctcacgaggcgtgtcagtccgatacttcctcgtc

SEQ ID NO: 200893 - DNA, 35 bp, Artificial Sequence
  Synthetic oligonucleotide
tgtgatacctccgctgagcacctgtggtccttgtc

SEQ ID NO: 200894 - DNA, 35 bp, Artificial Sequence
  Synthetic oligonucleotide
gaggacgcactctgtactttgcccgtttttaattc

SEQ ID NO: 200895 - DNA, 35 bp, Artificial Sequence
  Synthetic oligonucleotide
tgtgcgctgcctcctccgctttaccatttacgttc

SEQ ID NO: 200896 - DNA, 35 bp, Artificial Sequence
  Synthetic oligonucleotide
tgaggggagggatagggataggaagctactcgcag

SEQ ID NO: 200897 - DNA, 35 bp, Artificial Sequence
  Synthetic oligonucleotide
aacccgcctctcacgttcacgctacgacaataccg

SEQ ID NO: 200898 - DNA, 35 bp, Artificial Sequence
  Synthetic oligonucleotide
tctagcatacgtccgcacctgctgtcccttagtcg

SEQ ID NO: 200899 - DNA, 35 bp, Artificial Sequence
  Synthetic oligonucleotide
agactacatccgttcccctttcccgcccagccgtg

SEQ ID NO: 200900 - DNA, 35 bp, Artificial Sequence
  Synthetic oligonucleotide
gacacccctgccttggtacccagaccgatccaaat

SEQ ID NO: 200901 - DNA, 35 bp, Artificial Sequence
  Synthetic oligonucleotide
agtacccccgaagttccgtaccgcctctccattat

SEQ ID NO: 200902 - DNA, 35 bp, Artificial Sequence
  Synthetic oligonucleotide
gacgcagtcgccgacccttggattcttcgttaact

SEQ ID NO: 200903 - DNA, 35 bp, Artificial Sequence
  Synthetic oligonucleotide
atccaccccctcccgatgtccatcgttttcgtact

SEQ ID NO: 200904 - DNA, 35 bp, Artificial Sequence
  Synthetic oligonucleotide
gacgtgagaatccgtgtcgtcatcaccaccttgct

SEQ ID NO: 200905 - DNA, 35 bp, Artificial Sequence
  Synthetic oligonucleotide
tgcccaaacgcccttacgtcctccgactccgcatt

SEQ ID NO: 200906 - DNA, 35 bp, Artificial Sequence
  Synthetic oligonucleotide
tccctccgaccttgctgctattccagctgctcctt

SEQ ID NO: 200907 - DNA, 35 bp, Artificial Sequence
  Synthetic oligonucleotide
tacgccgcctgggcgcgcatactacgaattggttt

SEQ ID NO: 200908 - DNA, 36 bp, Artificial Sequence
  Synthetic oligonucleotide
gtgagcccggccaagaataggagtaggggagggaaa

SEQ ID NO: 200909 - DNA, 35 bp, Artificial Sequence
  Synthetic oligonucleotide
gtgatgacgaaagggggactccaagggcgggacaa

SEQ ID NO: 200910 - DNA, 36 bp, Artificial Sequence
  Synthetic oligonucleotide
aaggagggggcgggtaaggttaggaggtacagataa

SEQ ID NO: 200911 - DNA, 36 bp, Artificial Sequence
  Synthetic oligonucleotide
ggtcaacccccctcgtttttagtccagttcgtcaca

SEQ ID NO: 200912 - DNA, 36 bp, Artificial Sequence
  Synthetic oligonucleotide
aacccacagcgcttatcctgtttgctgcaattcaca

SEQ ID NO: 200913 - DNA, 36 bp, Artificial Sequence
  Synthetic oligonucleotide
gagacaccccccctcatggtaatcctgcccagtaca

SEQ ID NO: 200914 - DNA, 36 bp, Artificial Sequence
  Synthetic oligonucleotide
gtgcacccctctttgagagtttgacctgccattaca

SEQ ID NO: 200915 - DNA, 36 bp, Artificial Sequence
  Synthetic oligonucleotide
gacatcctgcccggattggcgatcaggaccgcccca

SEQ ID NO: 200916 - DNA, 35 bp, Artificial Sequence
  Synthetic oligonucleotide
attgcgcccagtgcgttcccaagcccttgatccca

SEQ ID NO: 200917 - DNA, 36 bp, Artificial Sequence
  Synthetic oligonucleotide
gacactgcgacagtgcgctcttttcctttcgttcca

SEQ ID NO: 200918 - DNA, 36 bp, Artificial Sequence
  Synthetic oligonucleotide
gacatcctaatggcccccttcaccagtgtgcacgca

SEQ ID NO: 200919 - DNA, 35 bp, Artificial Sequence
  Synthetic oligonucleotide
gttccatccatagattctcggggcgatacctcgca

SEQ ID NO: 200920 - DNA, 37 bp, Artificial Sequence
  Synthetic oligonucleotide
gttggagggagacggggagcgcgacaggaactcaaga

SEQ ID NO: 200921 - DNA, 34 bp, Artificial Sequence
  Synthetic oligonucleotide
tagcatagtcacacagcacctcccttccgaacga

SEQ ID NO: 200922 - DNA, 36 bp, Artificial Sequence
  Synthetic oligonucleotide
ggttgcgggagagggaacatatgggggggctaacga

SEQ ID NO: 200923 - DNA, 36 bp, Artificial Sequence
  Synthetic oligonucleotide
tttcgcgggcgggctgatgggtgggttagtggacga

SEQ ID NO: 200924 - DNA, 36 bp, Artificial Sequence
  Synthetic oligonucleotide
tcccccgtcgtttcacagcgcactcatcagttccga

SEQ ID NO: 200925 - DNA, 37 bp, Artificial Sequence
  Synthetic oligonucleotide
gccggagaagccgaatgaaggggcgatggggacagga

SEQ ID NO: 200926 - DNA, 37 bp, Artificial Sequence
  Synthetic oligonucleotide
tgcccatgcccttgcttttgactgccccgcttttgga

SEQ ID NO: 200927 - DNA, 36 bp, Artificial Sequence
  Synthetic oligonucleotide
gaccgccatgtcccattgaatcatccttcgccatga

SEQ ID NO: 200928 - DNA, 38 bp, Artificial Sequence
  Synthetic oligonucleotide
gtgaaacacgaaggtgaggataagtggggtggggatga

SEQ ID NO: 200929 - DNA, 35 bp, Artificial Sequence
  Synthetic oligonucleotide
actactacgcctcctatgtcatcaattcatcctga

SEQ ID NO: 200930 - DNA, 36 bp, Artificial Sequence
  Synthetic oligonucleotide
tgcagggtggctgggggggggttgactcaatagtga

SEQ ID NO: 200931 - DNA, 38 bp, Artificial Sequence
  Synthetic oligonucleotide
ttaacaggggccgggaagggacgagtgggcggtcgtga

SEQ ID NO: 200932 - DNA, 38 bp, Artificial Sequence
  Synthetic oligonucleotide
tccaccgcccacatctttcgtcactgtccttggggtga

SEQ ID NO: 200933 - DNA, 37 bp, Artificial Sequence
  Synthetic oligonucleotide
tgaaggtgcgagctagaaagaagggggcggaatgtga

SEQ ID NO: 200934 - DNA, 37 bp, Artificial Sequence
  Synthetic oligonucleotide
tcacgctcgaccgtgtgtctgccctcgcaccccttga

SEQ ID NO: 200935 - DNA, 38 bp, Artificial Sequence
  Synthetic oligonucleotide
gtgccctcgccacttgattcttcacctcaacgcgttga

SEQ ID NO: 200936 - DNA, 36 bp, Artificial Sequence
  Synthetic oligonucleotide
accaacccggtatattataggccctggctcctccta

SEQ ID NO: 200937 - DNA, 35 bp, Artificial Sequence
  Synthetic oligonucleotide
tccgaatgcccctgcccgtcatcccagtaaggtta

SEQ ID NO: 200938 - DNA, 34 bp, Artificial Sequence
  Synthetic oligonucleotide
ttgtggacggtagtcccagcgattctcctgccac

SEQ ID NO: 200939 - DNA, 35 bp, Artificial Sequence
  Synthetic oligonucleotide
tccacgtacatacgctttttatcgcgacgctccac

SEQ ID NO: 200940 - DNA, 35 bp, Artificial Sequence
  Synthetic oligonucleotide
gatccatccacagtaatgctaggcctgacttgcac

SEQ ID NO: 200941 - DNA, 35 bp, Artificial Sequence
  Synthetic oligonucleotide
gctgaccacggtgttcacgttccctctttctatac

SEQ ID NO: 200942 - DNA, 35 bp, Artificial Sequence
  Synthetic oligonucleotide
accctccgcgcacctgtgcacctccgctcccgtac

SEQ ID NO: 200943 - DNA, 35 bp, Artificial Sequence
  Synthetic oligonucleotide
gaccacgcctcgttcgttgacaaatgtctgtttac

SEQ ID NO: 200944 - DNA, 35 bp, Artificial Sequence
  Synthetic oligonucleotide
gtgcacgcacctgcccgcggtgatcaaggccctcc

SEQ ID NO: 200945 - DNA, 35 bp, Artificial Sequence
  Synthetic oligonucleotide
gattccgcgcccctcgatcagtccagccggtgtcc

SEQ ID NO: 200946 - DNA, 35 bp, Artificial Sequence
  Synthetic oligonucleotide
agataaccgccgctctctgctctgaccccattggc

SEQ ID NO: 200947 - DNA, 35 bp, Artificial Sequence
  Synthetic oligonucleotide
atcacaagttcgccgttactcccattcctattggc

SEQ ID NO: 200948 - DNA, 35 bp, Artificial Sequence
  Synthetic oligonucleotide
gtcatctctgccccccgataagctttgtgcaatgc

SEQ ID NO: 200949 - DNA, 35 bp, Artificial Sequence
  Synthetic oligonucleotide
tggtgccgctcaagcctagtcccctttgatcctgc

SEQ ID NO: 200950 - DNA, 35 bp, Artificial Sequence
  Synthetic oligonucleotide
gcaagctgccatctgtccctgtccacgtcctactc

SEQ ID NO: 200951 - DNA, 35 bp, Artificial Sequence
  Synthetic oligonucleotide
agtgcgctcctgccctgaccgtttctgtacccctc

SEQ ID NO: 200952 - DNA, 35 bp, Artificial Sequence
  Synthetic oligonucleotide
gccctgccagtatccgggaagtccatccattcgtc

SEQ ID NO: 200953 - DNA, 35 bp, Artificial Sequence
  Synthetic oligonucleotide
gtagtggcccccgctttgctctttctcctgcattc

SEQ ID NO: 200954 - DNA, 35 bp, Artificial Sequence
  Synthetic oligonucleotide
gccaacgaaacatcttggtactgcctctagccttc

SEQ ID NO: 200955 - DNA, 35 bp, Artificial Sequence
  Synthetic oligonucleotide
tgtcgccggtagctacttatttggccatttttttc

SEQ ID NO: 200956 - DNA, 35 bp, Artificial Sequence
  Synthetic oligonucleotide
gacatccagctgagccttagtgccttacccccccg

SEQ ID NO: 200957 - DNA, 35 bp, Artificial Sequence
  Synthetic oligonucleotide
ttgtcatgcagtcacgttcccttaccaccctgctg

SEQ ID NO: 200958 - DNA, 35 bp, Artificial Sequence
  Synthetic oligonucleotide
gatagccgtgcagacctcttctgattatgttccat

SEQ ID NO: 200959 - DNA, 35 bp, Artificial Sequence
  Synthetic oligonucleotide
ttgatgggacgacggtaggaagggcatgtatagat

SEQ ID NO: 200960 - DNA, 35 bp, Artificial Sequence
  Synthetic oligonucleotide
gatgcacctcagctgcctttttcatctctgtgcct

SEQ ID NO: 200961 - DNA, 35 bp, Artificial Sequence
  Synthetic oligonucleotide
gactggcacatggcacctatgctactggacctcct

SEQ ID NO: 200962 - DNA, 35 bp, Artificial Sequence
  Synthetic oligonucleotide
ggatcgcagaggtgtgtctccatccgtcatttcct

SEQ ID NO: 200963 - DNA, 35 bp, Artificial Sequence
  Synthetic oligonucleotide
tgagcccacgctgccgttgtcatttctccccatct

SEQ ID NO: 200964 - DNA, 35 bp, Artificial Sequence
  Synthetic oligonucleotide
gactgcgttagaagcatggttccctctcgcattct

SEQ ID NO: 200965 - DNA, 35 bp, Artificial Sequence
  Synthetic oligonucleotide
tcatcctgcttggttggtgtcattgcttgttccgt

SEQ ID NO: 200966 - DNA, 35 bp, Artificial Sequence
  Synthetic oligonucleotide
gcaccatggctacccctgacacccgccccttgggt

SEQ ID NO: 200967 - DNA, 35 bp, Artificial Sequence
  Synthetic oligonucleotide
gttctcccactgcccgctatgctgaatctttcctt

SEQ ID NO: 200968 - DNA, 35 bp, Artificial Sequence
  Synthetic oligonucleotide
ttcgcgagcaccctctccttattagacgccttctt

SEQ ID NO: 200969 - DNA, 35 bp, Artificial Sequence
  Synthetic oligonucleotide
gtgcacctcccattgactattgcatgactcctaaa

SEQ ID NO: 200970 - DNA, 36 bp, Artificial Sequence
  Synthetic oligonucleotide
tcaatcatgcacaatgttctcgctcccttgcactaa

SEQ ID NO: 200971 - DNA, 36 bp, Artificial Sequence
  Synthetic oligonucleotide
ttaacagccccacactgaatttgtcacggccatcca

SEQ ID NO: 200972 - DNA, 35 bp, Artificial Sequence
  Synthetic oligonucleotide
ttgtacactgtgtgtcataacccacccctctttca

SEQ ID NO: 200973 - DNA, 37 bp, Artificial Sequence
  Synthetic oligonucleotide
tactccccgatgttgcatctcgttctctttccacaga

SEQ ID NO: 200974 - DNA, 37 bp, Artificial Sequence
  Synthetic oligonucleotide
gcaggaggagggagggggaagcagccctaattccaga

SEQ ID NO: 200975 - DNA, 37 bp, Artificial Sequence
  Synthetic oligonucleotide
tgcatccccctaccattgttaccaaatctgtctacga

SEQ ID NO: 200976 - DNA, 37 bp, Artificial Sequence
  Synthetic oligonucleotide
attcaccgtagcgtgctccctctccagttggttacga

SEQ ID NO: 200977 - DNA, 37 bp, Artificial Sequence
  Synthetic oligonucleotide
ttgaaggagggtcaaggggtcaagggcgggccaagga

SEQ ID NO: 200978 - DNA, 37 bp, Artificial Sequence
  Synthetic oligonucleotide
gaagaagccagggaaggggcgggacgattactaagga

SEQ ID NO: 200979 - DNA, 37 bp, Artificial Sequence
  Synthetic oligonucleotide
atccgccgccattggccatcacttgtgcccttcggga

SEQ ID NO: 200980 - DNA, 38 bp, Artificial Sequence
  Synthetic oligonucleotide
ggacgtcacatagtagcgcgctgttcccttctctctga

SEQ ID NO: 200981 - DNA, 38 bp, Artificial Sequence
  Synthetic oligonucleotide
gagacgccccaccatgatcatcggcctcaccccagtga

SEQ ID NO: 200982 - DNA, 37 bp, Artificial Sequence
  Synthetic oligonucleotide
gacaccctcatagtgatactttgctcgccttatttga

SEQ ID NO: 200983 - DNA, 36 bp, Artificial Sequence
  Synthetic oligonucleotide
tgccgaccgccctcgcatatacatgccagtacacta

SEQ ID NO: 200984 - DNA, 36 bp, Artificial Sequence
  Synthetic oligonucleotide
atcggaggtaggcgggtgagtggaggtggatcctta

SEQ ID NO: 200985 - DNA, 36 bp, Artificial Sequence
  Synthetic oligonucleotide
gcccccccccaatgtaatgtagcgaaggctatctta

SEQ ID NO: 200986 - DNA, 36 bp, Artificial Sequence
  Synthetic oligonucleotide
agatggaggagcatgggaggtgaggcttacgggtta

SEQ ID NO: 200987 - DNA, 35 bp, Artificial Sequence
  Synthetic oligonucleotide
aatgggcggagtgggtaaatggagggcttaccaac

SEQ ID NO: 200988 - DNA, 36 bp, Artificial Sequence
  Synthetic oligonucleotide
tagaacgcagagctgcccttccttcactgttccacc

SEQ ID NO: 200989 - DNA, 35 bp, Artificial Sequence
  Synthetic oligonucleotide
actccccgaactgtcataataccggtgcgcttgcc

SEQ ID NO: 200990 - DNA, 35 bp, Artificial Sequence
  Synthetic oligonucleotide
aacctgcgccccttctgcttttgattcgcgttgcc

SEQ ID NO: 200991 - DNA, 35 bp, Artificial Sequence
  Synthetic oligonucleotide
tgctcccctcagtccgcctttgatgccctttctcc

SEQ ID NO: 200992 - DNA, 35 bp, Artificial Sequence
  Synthetic oligonucleotide
tagcatccacgtgattgcgttaccccctctgcctc

SEQ ID NO: 200993 - DNA, 35 bp, Artificial Sequence
  Synthetic oligonucleotide
gaggaaccacgtccgtcttagccatgatcatcctc

SEQ ID NO: 200994 - DNA, 35 bp, Artificial Sequence
  Synthetic oligonucleotide
atgatgcgcctgcactttaatagtcttggcccttc

SEQ ID NO: 200995 - DNA, 35 bp, Artificial Sequence
  Synthetic oligonucleotide
tatgtcgccccacctgttttatggcatttcccttc

SEQ ID NO: 200996 - DNA, 35 bp, Artificial Sequence
  Synthetic oligonucleotide
gatactagcgcgttcctatcagatctttgtccttc

SEQ ID NO: 200997 - DNA, 35 bp, Artificial Sequence
  Synthetic oligonucleotide
acagatcgcctcgaacgcatagttcggcctctttc

SEQ ID NO: 200998 - DNA, 35 bp, Artificial Sequence
  Synthetic oligonucleotide
tgcgggtcatcctatccattcagttctggtctttc

SEQ ID NO: 200999 - DNA, 35 bp, Artificial Sequence
  Synthetic oligonucleotide
acgcaacccagtcgcaccgtccacggcatcctacg

SEQ ID NO: 201000 - DNA, 35 bp, Artificial Sequence
  Synthetic oligonucleotide
agcctcactcaccctgccggacccaaaccttgtcg

SEQ ID NO: 201001 - DNA, 35 bp, Artificial Sequence
  Synthetic oligonucleotide
atgggagatcggaggggtagcgaaagttggagcgg

SEQ ID NO: 201002 - DNA, 34 bp, Artificial Sequence
  Synthetic oligonucleotide
atgagggagggatcgcgggggtacagatacatgg

SEQ ID NO: 201003 - DNA, 35 bp, Artificial Sequence
  Synthetic oligonucleotide
accacaccgcggtccggaaatttccataggcctct

SEQ ID NO: 201004 - DNA, 35 bp, Artificial Sequence
  Synthetic oligonucleotide
acgcacgctctgctttacatgattccactccacgt

SEQ ID NO: 201005 - DNA, 35 bp, Artificial Sequence
  Synthetic oligonucleotide
tatgtcgccctcatcatgccggtaggagccacggt

SEQ ID NO: 201006 - DNA, 35 bp, Artificial Sequence
  Synthetic oligonucleotide
tgaccgctcccccagcgcatgagcatacccaggtt

SEQ ID NO: 201007 - DNA, 35 bp, Artificial Sequence
  Synthetic oligonucleotide
atgtccccgctccctcgtttatagcatctggcttt

SEQ ID NO: 201008 - DNA, 35 bp, Artificial Sequence
  Synthetic oligonucleotide
acatgctgcatggcgtaggccaacatcccttcttt

SEQ ID NO: 201009 - DNA, 37 bp, Artificial Sequence
  Synthetic oligonucleotide
attcgccgatctgtgcgtctatcgttacgtccatcaa

SEQ ID NO: 201010 - DNA, 36 bp, Artificial Sequence
  Synthetic oligonucleotide
tgctccatcgcggcgtatccttcgagctatttaaca

SEQ ID NO: 201011 - DNA, 35 bp, Artificial Sequence
  Synthetic oligonucleotide
gtcacctctggctggattaccgccgcaacattaca

SEQ ID NO: 201012 - DNA, 36 bp, Artificial Sequence
  Synthetic oligonucleotide
gaggagaggtgaaatacgggtggagtcgacgtggca

SEQ ID NO: 201013 - DNA, 37 bp, Artificial Sequence
  Synthetic oligonucleotide
gagggagtgtagcaggagcgatgggaggaggaacaga

SEQ ID NO: 201014 - DNA, 37 bp, Artificial Sequence
  Synthetic oligonucleotide
tagtactgggggaggagggtaggaccacaggtagaga

SEQ ID NO: 201015 - DNA, 36 bp, Artificial Sequence
  Synthetic oligonucleotide
tatgcacgggattggtgtgggggggcaaacgtgaga

SEQ ID NO: 201016 - DNA, 37 bp, Artificial Sequence
  Synthetic oligonucleotide
gtccgacagggaggaagggcgcacgagtaggggtaga

SEQ ID NO: 201017 - DNA, 37 bp, Artificial Sequence
  Synthetic oligonucleotide
tacccttatcgcagatgctaccgcaccacctttacga

SEQ ID NO: 201018 - DNA, 37 bp, Artificial Sequence
  Synthetic oligonucleotide
ggacagatagggaggataaacgaacgaacggaaagga

SEQ ID NO: 201019 - DNA, 37 bp, Artificial Sequence
  Synthetic oligonucleotide
gacccgccgccacatgcctcctacccctcctagcgga

SEQ ID NO: 201020 - DNA, 37 bp, Artificial Sequence
  Synthetic oligonucleotide
gcccgggcggggtgtcctaggggagcgtattagggga

SEQ ID NO: 201021 - DNA, 37 bp, Artificial Sequence
  Synthetic oligonucleotide
tgtgcggtctcagactattcgcactatcacccctgga

SEQ ID NO: 201022 - DNA, 37 bp, Artificial Sequence
  Synthetic oligonucleotide
taggagggccggaatggggcgcaacccaagggttgga

SEQ ID NO: 201023 - DNA, 38 bp, Artificial Sequence
  Synthetic oligonucleotide
ctacacctcatacaatgcccactacagactgatcctga

SEQ ID NO: 201024 - DNA, 38 bp, Artificial Sequence
  Synthetic oligonucleotide
tattgacgcccatgtgccctcgtactccatcattttga

SEQ ID NO: 201025 - DNA, 36 bp, Artificial Sequence
  Synthetic oligonucleotide
accgcccctccacctgaatcctgtttcaacggttta

SEQ ID NO: 201026 - DNA, 35 bp, Artificial Sequence
  Synthetic oligonucleotide
tatccacgttgtggagtccatacgctccgttccac

SEQ ID NO: 201027 - DNA, 35 bp, Artificial Sequence
  Synthetic oligonucleotide
gtgaccgatccatccgcttccttagacttgggcac

SEQ ID NO: 201028 - DNA, 35 bp, Artificial Sequence
  Synthetic oligonucleotide
atccacccgtgcctctatcgcagaaaggctatcac

SEQ ID NO: 201029 - DNA, 35 bp, Artificial Sequence
  Synthetic oligonucleotide
acctcgcctaagacatgctcctggtctcacgctac

SEQ ID NO: 201030 - DNA, 35 bp, Artificial Sequence
  Synthetic oligonucleotide
gcccaatcgacgagattgctgtccacgccatttac

SEQ ID NO: 201031 - DNA, 35 bp, Artificial Sequence
  Synthetic oligonucleotide
atgtccgtgtccctgtcagttctctcttcgtgccc

SEQ ID NO: 201032 - DNA, 36 bp, Artificial Sequence
  Synthetic oligonucleotide
tacagccgcacacaacagttattccccctgcctagc

SEQ ID NO: 201033 - DNA, 35 bp, Artificial Sequence
  Synthetic oligonucleotide
tgtcgcggcctggtgtgcctattcccaaccgccgc

SEQ ID NO: 201034 - DNA, 35 bp, Artificial Sequence
  Synthetic oligonucleotide
tgtcaccccaatcatgtcgccatgaccttttctgc

SEQ ID NO: 201035 - DNA, 35 bp, Artificial Sequence
  Synthetic oligonucleotide
gaactacttgccgtcgtactacgccacctgcttgc

SEQ ID NO: 201036 - DNA, 35 bp, Artificial Sequence
  Synthetic oligonucleotide
gtgacgcgtcaacaccgcttatctcgtctgtaatc

SEQ ID NO: 201037 - DNA, 35 bp, Artificial Sequence
  Synthetic oligonucleotide
gttgttgccaccacttttcagagggactgtacctc

SEQ ID NO: 201038 - DNA, 35 bp, Artificial Sequence
  Synthetic oligonucleotide
tacctgcgtgagctatgcatcctcgatttgccctc

SEQ ID NO: 201039 - DNA, 35 bp, Artificial Sequence
  Synthetic oligonucleotide
tagcgccggcctccatgaattcagtgccttccgtc

SEQ ID NO: 201040 - DNA, 35 bp, Artificial Sequence
  Synthetic oligonucleotide
ggtttcgcaccatgcctcgaatcgtcctcccgttc

SEQ ID NO: 201041 - DNA, 35 bp, Artificial Sequence
  Synthetic oligonucleotide
tagacccatgcagccagctcacaccctgctttccg

SEQ ID NO: 201042 - DNA, 35 bp, Artificial Sequence
  Synthetic oligonucleotide
tgtgggatgcgcatagggaaggtaaatcgggaggg

SEQ ID NO: 201043 - DNA, 35 bp, Artificial Sequence
  Synthetic oligonucleotide
tgccatgatcagggacgaaggggaagaagtagggg

SEQ ID NO: 201044 - DNA, 35 bp, Artificial Sequence
  Synthetic oligonucleotide
tagacgtgagcggtaatggcgaaagaggggggggg

SEQ ID NO: 201045 - DNA, 35 bp, Artificial Sequence
  Synthetic oligonucleotide
ggatactcacatcccggttcagccactacttcctg

SEQ ID NO: 201046 - DNA, 35 bp, Artificial Sequence
  Synthetic oligonucleotide
attgtaaggtggggggggtgtaaggcgacggcttg

SEQ ID NO: 201047 - DNA, 35 bp, Artificial Sequence
  Synthetic oligonucleotide
attggcaccaccgttcggaactcctggcattccct

SEQ ID NO: 201048 - DNA, 35 bp, Artificial Sequence
  Synthetic oligonucleotide
ttgccgatcctgttcctaccgcagttgcccacgct

SEQ ID NO: 201049 - DNA, 36 bp, Artificial Sequence
  Synthetic oligonucleotide
ggacgcatcaacgggacatatggtggggcgggggaa

SEQ ID NO: 201050 - DNA, 36 bp, Artificial Sequence
  Synthetic oligonucleotide
tagccgccggggcatgaggagggtggtagtgggtaa

SEQ ID NO: 201051 - DNA, 36 bp, Artificial Sequence
  Synthetic oligonucleotide
aggaccccccccgctttgctatgacagttgaaccca

SEQ ID NO: 201052 - DNA, 35 bp, Artificial Sequence
  Synthetic oligonucleotide
atgaagccagggagatgacggtgaagaaggggcca

SEQ ID NO: 201053 - DNA, 36 bp, Artificial Sequence
  Synthetic oligonucleotide
gccaagtcgctgtcactatgaccttgaactcctcca

SEQ ID NO: 201054 - DNA, 37 bp, Artificial Sequence
  Synthetic oligonucleotide
atgcggacgggacgggtgggggtgaaggggcgaaaga

SEQ ID NO: 201055 - DNA, 37 bp, Artificial Sequence
  Synthetic oligonucleotide
gtgggcggacggggttgaggatgacggtttgcgcaga

SEQ ID NO: 201056 - DNA, 37 bp, Artificial Sequence
  Synthetic oligonucleotide
tgaagtgggaaacgggtgaatccaagagagggggaga

SEQ ID NO: 201057 - DNA, 36 bp, Artificial Sequence
  Synthetic oligonucleotide
tgcaaccgcccttctctttacgtgtcctctgcccga

SEQ ID NO: 201058 - DNA, 36 bp, Artificial Sequence
  Synthetic oligonucleotide
gactggggaaaagacggggaaatgggtacggggcga

SEQ ID NO: 201059 - DNA, 36 bp, Artificial Sequence
  Synthetic oligonucleotide
acgaacgggccggaactgaagaggtggaacttggga

SEQ ID NO: 201060 - DNA, 36 bp, Artificial Sequence
  Synthetic oligonucleotide
taagagagcagaagacggtagaaacaaggggatgga

SEQ ID NO: 201061 - DNA, 37 bp, Artificial Sequence
  Synthetic oligonucleotide
gggggaggtggggtgtcacggacggtacaactatgga

SEQ ID NO: 201062 - DNA, 38 bp, Artificial Sequence
  Synthetic oligonucleotide
tcgagccgtctgactcgttgccggtccctcctcgctga

SEQ ID NO: 201063 - DNA, 38 bp, Artificial Sequence
  Synthetic oligonucleotide
tttgcctcccatccttaacgttatcatagtccgggtga

SEQ ID NO: 201064 - DNA, 35 bp, Artificial Sequence
  Synthetic oligonucleotide
tgaggccatcgatcgggtggtctgagggggggtga

SEQ ID NO: 201065 - DNA, 36 bp, Artificial Sequence
  Synthetic oligonucleotide
gagcctacttccgcggctgggcgtgctcccttcgta

SEQ ID NO: 201066 - DNA, 35 bp, Artificial Sequence
  Synthetic oligonucleotide
gtgagagaagggggcgtgtcgggaccagtgtggta

SEQ ID NO: 201067 - DNA, 35 bp, Artificial Sequence
  Synthetic oligonucleotide
gactcgaccacacccgccgtttccatgagccctta

SEQ ID NO: 201068 - DNA, 36 bp, Artificial Sequence
  Synthetic oligonucleotide
gtatccgccaaacgctataggtagttcccctcttta

SEQ ID NO: 201069 - DNA, 35 bp, Artificial Sequence
  Synthetic oligonucleotide
ctcacaatctcacctggaccatcttgagcggttta

SEQ ID NO: 201070 - DNA, 34 bp, Artificial Sequence
  Synthetic oligonucleotide
tgtgccgtcataatgccctctccacgccactccc

SEQ ID NO: 201071 - DNA, 35 bp, Artificial Sequence
  Synthetic oligonucleotide
acccgcccacagggtgttgagcccgattctgcgcc

SEQ ID NO: 201072 - DNA, 35 bp, Artificial Sequence
  Synthetic oligonucleotide
gcgagcacgttcgttttgcgccccactgccttggc

SEQ ID NO: 201073 - DNA, 35 bp, Artificial Sequence
  Synthetic oligonucleotide
tgagaggcaccatatgcgttttccgccactctctc

SEQ ID NO: 201074 - DNA, 35 bp, Artificial Sequence
  Synthetic oligonucleotide
tccgctcgctgcactccgcgtggccctcttatgtc

SEQ ID NO: 201075 - DNA, 35 bp, Artificial Sequence
  Synthetic oligonucleotide
tttcatcccccgtgctgttcgaacagcgaattttc

SEQ ID NO: 201076 - DNA, 35 bp, Artificial Sequence
  Synthetic oligonucleotide
ggagggtgccgaagtaggggagggatcacggtagg

SEQ ID NO: 201077 - DNA, 35 bp, Artificial Sequence
  Synthetic oligonucleotide
tgagacgagtggtgccgagtgagggggaatgatgg

SEQ ID NO: 201078 - DNA, 35 bp, Artificial Sequence
  Synthetic oligonucleotide
gaccgctccgccgaatattctctcatcttaacatg

SEQ ID NO: 201079 - DNA, 35 bp, Artificial Sequence
  Synthetic oligonucleotide
tcattaccgcccagcctctcaaggtccaaatcctg

SEQ ID NO: 201080 - DNA, 35 bp, Artificial Sequence
  Synthetic oligonucleotide
tgctcctacatcgtgacaatgacccccgtctcctg

SEQ ID NO: 201081 - DNA, 35 bp, Artificial Sequence
  Synthetic oligonucleotide
atcgacgggcgggaggggttttcgaccatccattg

SEQ ID NO: 201082 - DNA, 35 bp, Artificial Sequence
  Synthetic oligonucleotide
tattgccacctctgcatctcgttcaatatactttg

SEQ ID NO: 201083 - DNA, 35 bp, Artificial Sequence
  Synthetic oligonucleotide
tgccgacgggtggtaagggggagctttaaggggat

SEQ ID NO: 201084 - DNA, 35 bp, Artificial Sequence
  Synthetic oligonucleotide
acagccgaccattcgccatcacgggccttgctact

SEQ ID NO: 201085 - DNA, 35 bp, Artificial Sequence
  Synthetic oligonucleotide
attgcccctgcatcatgtcatctccgtgacgatct

SEQ ID NO: 201086 - DNA, 31 bp, Artificial Sequence
  Synthetic oligonucleotide
gatggggtgggactgtagtctgtactgcggt

SEQ ID NO: 201087 - DNA, 35 bp, Artificial Sequence
  Synthetic oligonucleotide
gccccgtgccggtaaacccacgctattattatggt

SEQ ID NO: 201088 - DNA, 35 bp, Artificial Sequence
  Synthetic oligonucleotide
gttccgccccagctcgataggctctcgatcatctt

SEQ ID NO: 201089 - DNA, 35 bp, Artificial Sequence
  Synthetic oligonucleotide
gcaaaggggggatcaggaagggggggtggccggtt

SEQ ID NO: 201090 - DNA, 35 bp, Artificial Sequence
  Synthetic oligonucleotide
gaccccagtcgcgacctgcatattaatccgttgtt

SEQ ID NO: 201091 - DNA, 36 bp, Artificial Sequence
  Synthetic oligonucleotide
tgcatcccgacctgcattctcaatgagtcccttgaa

SEQ ID NO: 201092 - DNA, 35 bp, Artificial Sequence
  Synthetic oligonucleotide
tgacaacccagagagtacaaacggggagggggtaa

SEQ ID NO: 201093 - DNA, 36 bp, Artificial Sequence
  Synthetic oligonucleotide
gtggtgaggatggtgcgtacaggggcggtgggaaga

SEQ ID NO: 201094 - DNA, 37 bp, Artificial Sequence
  Synthetic oligonucleotide
atcgaaggtgcaggtggagaggcgtggcggctacaga

SEQ ID NO: 201095 - DNA, 37 bp, Artificial Sequence
  Synthetic oligonucleotide
gtggccgggtgggtgggaggtgaaagcatcctctaga

SEQ ID NO: 201096 - DNA, 36 bp, Artificial Sequence
  Synthetic oligonucleotide
gttgtggctcagatccttctccaccgtgccattaga

SEQ ID NO: 201097 - DNA, 36 bp, Artificial Sequence
  Synthetic oligonucleotide
tgtctgtccgacagaacaatagccctccgcctccga

SEQ ID NO: 201098 - DNA, 35 bp, Artificial Sequence
  Synthetic oligonucleotide
gaggtcaaggacagtggaagtaggaaaggcgagga

SEQ ID NO: 201099 - DNA, 35 bp, Artificial Sequence
  Synthetic oligonucleotide
acgatgggatcggggggggaagcaagtccaacgga

SEQ ID NO: 201100 - DNA, 37 bp, Artificial Sequence
  Synthetic oligonucleotide
gcaagcacacagttatattgccttccacctccacgga

SEQ ID NO: 201101 - DNA, 37 bp, Artificial Sequence
  Synthetic oligonucleotide
aaggacgagtaggggggtgagtgaacgcaagggcgga

SEQ ID NO: 201102 - DNA, 37 bp, Artificial Sequence
  Synthetic oligonucleotide
gtgcataaggcaaaagagggcgaagtaaggtgaggga

SEQ ID NO: 201103 - DNA, 37 bp, Artificial Sequence
  Synthetic oligonucleotide
aatgggagcgggaaggggtgtgtccgtcaagagggga

SEQ ID NO: 201104 - DNA, 36 bp, Artificial Sequence
  Synthetic oligonucleotide
gtaccaccctccctgtcctgaatgatgtcccgtgga

SEQ ID NO: 201105 - DNA, 37 bp, Artificial Sequence
  Synthetic oligonucleotide
actagccgccgggatgggcgggggggaagtccgtgga

SEQ ID NO: 201106 - DNA, 38 bp, Artificial Sequence
  Synthetic oligonucleotide
atagggcgggtcagggggggttgtagacgcctcagtga

SEQ ID NO: 201107 - DNA, 38 bp, Artificial Sequence
  Synthetic oligonucleotide
gataggggaagtggtggcgtagtgacgaagtgcggtga

SEQ ID NO: 201108 - DNA, 38 bp, Artificial Sequence
  Synthetic oligonucleotide
tccagccctcatctagttcctccgacgctcgcttgtga

SEQ ID NO: 201109 - DNA, 38 bp, Artificial Sequence
  Synthetic oligonucleotide
gcactgtcggctcgtctaactgcggtgccttcccttga

SEQ ID NO: 201110 - DNA, 37 bp, Artificial Sequence
  Synthetic oligonucleotide
atggcggggccaggggaaggggagggttgtcagttga

SEQ ID NO: 201111 - DNA, 37 bp, Artificial Sequence
  Synthetic oligonucleotide
tactgccctgactgtaaagcctccctactaccgttga

SEQ ID NO: 201112 - DNA, 35 bp, Artificial Sequence
  Synthetic oligonucleotide
gcatcgccccaagtgagcgctcctgtaccctttga

SEQ ID NO: 201113 - DNA, 35 bp, Artificial Sequence
  Synthetic oligonucleotide
gcatccccctgtatatctcgcgccagcactgccta

SEQ ID NO: 201114 - DNA, 36 bp, Artificial Sequence
  Synthetic oligonucleotide
accacgcatcacccgcgttctcaccccactgttcta

SEQ ID NO: 201115 - DNA, 35 bp, Artificial Sequence
  Synthetic oligonucleotide
agtggagagaaggatgggatgggatgttaaatgta

SEQ ID NO: 201116 - DNA, 35 bp, Artificial Sequence
  Synthetic oligonucleotide
tttgcgtgcgtcggggagggaagggtgggactgta

SEQ ID NO: 201117 - DNA, 35 bp, Artificial Sequence
  Synthetic oligonucleotide
atccacacaaggccagggagtggaggggggagaac

SEQ ID NO: 201118 - DNA, 35 bp, Artificial Sequence
  Synthetic oligonucleotide
ttgactcgccgatcgccctttaaactagctacgac

SEQ ID NO: 201119 - DNA, 35 bp, Artificial Sequence
  Synthetic oligonucleotide
gccatttgctcagggtacatgcgttactgctcccc

SEQ ID NO: 201120 - DNA, 35 bp, Artificial Sequence
  Synthetic oligonucleotide
ttgatgccctcccatagaatagagttctctcgtcc

SEQ ID NO: 201121 - DNA, 35 bp, Artificial Sequence
  Synthetic oligonucleotide
gatgaaggggtaatgagggtatgactacggagggc

SEQ ID NO: 201122 - DNA, 35 bp, Artificial Sequence
  Synthetic oligonucleotide
atccccatctggctccggtgtccacctttaccatc

SEQ ID NO: 201123 - DNA, 35 bp, Artificial Sequence
  Synthetic oligonucleotide
acactcgcctcatagtgctaccctcccttgaagtc

SEQ ID NO: 201124 - DNA, 35 bp, Artificial Sequence
  Synthetic oligonucleotide
tgctcatctgcctcttcttgcctaggagctcattc

SEQ ID NO: 201125 - DNA, 35 bp, Artificial Sequence
  Synthetic oligonucleotide
tccgccgacctcctctcttcttagacactggcttc

SEQ ID NO: 201126 - DNA, 35 bp, Artificial Sequence
  Synthetic oligonucleotide
atctcctcaccagttgggcgtagaaccgtcctttc

SEQ ID NO: 201127 - DNA, 35 bp, Artificial Sequence
  Synthetic oligonucleotide
tcccatgtcacattgcatcttccctcgctgtctcg

SEQ ID NO: 201128 - DNA, 35 bp, Artificial Sequence
  Synthetic oligonucleotide
attacccgcatttgattataacctcgtcccgttcg

SEQ ID NO: 201129 - DNA, 35 bp, Artificial Sequence
  Synthetic oligonucleotide
aacgagggacgggagggcgggtcaagaggggaagg

SEQ ID NO: 201130 - DNA, 36 bp, Artificial Sequence
  Synthetic oligonucleotide
tgtggacgtcaagtttttttgtacctcattccctgg

SEQ ID NO: 201131 - DNA, 35 bp, Artificial Sequence
  Synthetic oligonucleotide
aacacgtgccccttgtgtgcctgccccccgttatg

SEQ ID NO: 201132 - DNA, 35 bp, Artificial Sequence
  Synthetic oligonucleotide
accgagaggggcggagtggagggaaggtgtgtgtg

SEQ ID NO: 201133 - DNA, 35 bp, Artificial Sequence
  Synthetic oligonucleotide
gcaaacatcacctgcagcctcgggccttaggctat

SEQ ID NO: 201134 - DNA, 35 bp, Artificial Sequence
  Synthetic oligonucleotide
aaggggcagaagtatggggaggcaagaggggcagt

SEQ ID NO: 201135 - DNA, 35 bp, Artificial Sequence
  Synthetic oligonucleotide
gcgggagcaagtcaggccgcccgcctaagcccctt

SEQ ID NO: 201136 - DNA, 35 bp, Artificial Sequence
  Synthetic oligonucleotide
gttccaccactctgctgccctctccgtgttatgtt

SEQ ID NO: 201137 - DNA, 34 bp, Artificial Sequence
  Synthetic oligonucleotide
atgttgtgcctcgagatcccttttgcccctcttt

SEQ ID NO: 201138 - DNA, 33 bp, Artificial Sequence
  Synthetic oligonucleotide
gccgcccacctctaccagtctgccatgtctttt

SEQ ID NO: 201139 - DNA, 35 bp, Artificial Sequence
  Synthetic oligonucleotide
gagtcgacggccggaggagaagagggtgtagtttt

SEQ ID NO: 201140 - DNA, 36 bp, Artificial Sequence
  Synthetic oligonucleotide
ccatcgcgggaggatatggcgaaggagggggaggaa

SEQ ID NO: 201141 - DNA, 36 bp, Artificial Sequence
  Synthetic oligonucleotide
gcgcggtggcgccgggttggagggtaggagtaggaa

SEQ ID NO: 201142 - DNA, 35 bp, Artificial Sequence
  Synthetic oligonucleotide
tacgcgcctcacttgccctcttccccttcgttgaa

SEQ ID NO: 201143 - DNA, 36 bp, Artificial Sequence
  Synthetic oligonucleotide
acacacactcctgctcattgcacagacccatattaa

SEQ ID NO: 201144 - DNA, 36 bp, Artificial Sequence
  Synthetic oligonucleotide
ggagtgactggggagagaggagggtggcgcttgaca

SEQ ID NO: 201145 - DNA, 35 bp, Artificial Sequence
  Synthetic oligonucleotide
gcgtgcatgggtgggatgtcaagatggggagggca

SEQ ID NO: 201146 - DNA, 34 bp, Artificial Sequence
  Synthetic oligonucleotide
tgcggggggggggacggtggacggcactggatca

SEQ ID NO: 201147 - DNA, 35 bp, Artificial Sequence
  Synthetic oligonucleotide
tcgaagcgcactcgcctaagtaccgcactctgtca

SEQ ID NO: 201148 - DNA, 36 bp, Artificial Sequence
  Synthetic oligonucleotide
acccgcacgccagatccatgtcccaccttccgcaga

SEQ ID NO: 201149 - DNA, 37 bp, Artificial Sequence
  Synthetic oligonucleotide
tcagcgccctcggtctgtctgccccttcattctacga

SEQ ID NO: 201150 - DNA, 37 bp, Artificial Sequence
  Synthetic oligonucleotide
gcgaaccgtacgcctgttttatccctgcctttcccga

SEQ ID NO: 201151 - DNA, 36 bp, Artificial Sequence
  Synthetic oligonucleotide
gcaatgcagtgggagggagatggtggggcaggccga

SEQ ID NO: 201152 - DNA, 37 bp, Artificial Sequence
  Synthetic oligonucleotide
gacgacccgctcctcacgcagtccgctacaatttcga

SEQ ID NO: 201153 - DNA, 36 bp, Artificial Sequence
  Synthetic oligonucleotide
attcgccccctgtatctgtgccatcttgaatccgga

SEQ ID NO: 201154 - DNA, 35 bp, Artificial Sequence
  Synthetic oligonucleotide
taggacgggagactggggtggtggagcaggtggga

SEQ ID NO: 201155 - DNA, 37 bp, Artificial Sequence
  Synthetic oligonucleotide
gatgtgccagccgctctttgccacctacgtaccatga

SEQ ID NO: 201156 - DNA, 37 bp, Artificial Sequence
  Synthetic oligonucleotide
taggggaggacagcagggcgggtagactgacagatga

SEQ ID NO: 201157 - DNA, 37 bp, Artificial Sequence
  Synthetic oligonucleotide
gccaccacgcccacttagtttagcctccgctccctga

SEQ ID NO: 201158 - DNA, 37 bp, Artificial Sequence
  Synthetic oligonucleotide
attgcgcgcaagcagggagggggcaagggatgagtga

SEQ ID NO: 201159 - DNA, 37 bp, Artificial Sequence
  Synthetic oligonucleotide
gatagggaaccaggaggggtatagggggtaaagttga

SEQ ID NO: 201160 - DNA, 27 bp, Artificial Sequence
  Synthetic oligonucleotide
tgactgcccgacccccatctgcagcta

SEQ ID NO: 201161 - DNA, 36 bp, Artificial Sequence
  Synthetic oligonucleotide
tgccaccccacgcaagtgtatctttgcctcctatta

SEQ ID NO: 201162 - DNA, 35 bp, Artificial Sequence
  Synthetic oligonucleotide
tgaatcggctgattgtgccttctgtttcgcgccac

SEQ ID NO: 201163 - DNA, 35 bp, Artificial Sequence
  Synthetic oligonucleotide
agctcgtcactgtatgtcccgtctcgaccgctgcc

SEQ ID NO: 201164 - DNA, 35 bp, Artificial Sequence
  Synthetic oligonucleotide
tcagagcacacttacgctgttctaaccgtccatcc

SEQ ID NO: 201165 - DNA, 35 bp, Artificial Sequence
  Synthetic oligonucleotide
aagccattgcaggacgatgtaatcctctctcttcc

SEQ ID NO: 201166 - DNA, 29 bp, Artificial Sequence
  Synthetic oligonucleotide
ttgcccgccctgtaattcctgtctttcgc

SEQ ID NO: 201167 - DNA, 34 bp, Artificial Sequence
  Synthetic oligonucleotide
tcaccttgcgtgcatttcctgtctccgccactgc

SEQ ID NO: 201168 - DNA, 35 bp, Artificial Sequence
  Synthetic oligonucleotide
taacgcgtagttggccctccacagcctcttcctgc

SEQ ID NO: 201169 - DNA, 35 bp, Artificial Sequence
  Synthetic oligonucleotide
tgacgcctctgtgcccgcaattcacgtacttcctc

SEQ ID NO: 201170 - DNA, 35 bp, Artificial Sequence
  Synthetic oligonucleotide
tcaccccccccggcatcagcttccacgtcgctttc

SEQ ID NO: 201171 - DNA, 35 bp, Artificial Sequence
  Synthetic oligonucleotide
acctctagtgccacctgtttcttttatgtcgcaag

SEQ ID NO: 201172 - DNA, 35 bp, Artificial Sequence
  Synthetic oligonucleotide
tcccaccgccccatctttgcatatgccctgctacg

SEQ ID NO: 201173 - DNA, 35 bp, Artificial Sequence
  Synthetic oligonucleotide
ttcgccccccagtccttctatcgttgaccacgccg

SEQ ID NO: 201174 - DNA, 35 bp, Artificial Sequence
  Synthetic oligonucleotide
gaaggagagaggcgggtacggataagcactggggg

SEQ ID NO: 201175 - DNA, 35 bp, Artificial Sequence
  Synthetic oligonucleotide
acacggagtgtgtcccagcatttaaccttgcgctg

SEQ ID NO: 201176 - DNA, 35 bp, Artificial Sequence
  Synthetic oligonucleotide
ggagggccagcctacttagcgttctgtcttaccat

SEQ ID NO: 201177 - DNA, 35 bp, Artificial Sequence
  Synthetic oligonucleotide
gctgccggaacgtggggggatagggcaatcgggat

SEQ ID NO: 201178 - DNA, 35 bp, Artificial Sequence
  Synthetic oligonucleotide
atcacatcccaagcgtatatggttcctttatccct

SEQ ID NO: 201179 - DNA, 35 bp, Artificial Sequence
  Synthetic oligonucleotide
gatacatccgatagccttccgtccctgacgtgcct

SEQ ID NO: 201180 - DNA, 35 bp, Artificial Sequence
  Synthetic oligonucleotide
gtctaacaggcacactacaacgacgaacattcgct

SEQ ID NO: 201181 - DNA, 34 bp, Artificial Sequence
  Synthetic oligonucleotide
gtacgcgggtggtaattcacgctcccttttttgt

SEQ ID NO: 201182 - DNA, 36 bp, Artificial Sequence
  Synthetic oligonucleotide
aacacgccgatgtgggaggggtcggaaacggggaaa

SEQ ID NO: 201183 - DNA, 35 bp, Artificial Sequence
  Synthetic oligonucleotide
aacagggaggggggggtacacaggccctatgggaa

SEQ ID NO: 201184 - DNA, 36 bp, Artificial Sequence
  Synthetic oligonucleotide
acagatgctgcacctgatcagatccgcctattcaca

SEQ ID NO: 201185 - DNA, 35 bp, Artificial Sequence
  Synthetic oligonucleotide
agccaccctgttcttgtcttgttacgccatctaca

SEQ ID NO: 201186 - DNA, 35 bp, Artificial Sequence
  Synthetic oligonucleotide
tgtccgtgcgtccctcgatgctgccctattcctca

SEQ ID NO: 201187 - DNA, 35 bp, Artificial Sequence
  Synthetic oligonucleotide
gtgtcctgcgccgcctcagtcatgagccctattca

SEQ ID NO: 201188 - DNA, 35 bp, Artificial Sequence
  Synthetic oligonucleotide
aaccttgccgcacgatcttactcgcaactacttca

SEQ ID NO: 201189 - DNA, 37 bp, Artificial Sequence
  Synthetic oligonucleotide
tgacggaggggaaggtagcaagaccaggggggagaga

SEQ ID NO: 201190 - DNA, 36 bp, Artificial Sequence
  Synthetic oligonucleotide
tcttgcccgcccttatacacacaccttcttccgaga

SEQ ID NO: 201191 - DNA, 37 bp, Artificial Sequence
  Synthetic oligonucleotide
agaatgggtgggcggggagggctctagtcacttacga

SEQ ID NO: 201192 - DNA, 37 bp, Artificial Sequence
  Synthetic oligonucleotide
tgccaaccccgctcatctgttttactctccctctcga

SEQ ID NO: 201193 - DNA, 35 bp, Artificial Sequence
  Synthetic oligonucleotide
tgcccgctccccaattcgtctttaagcacggtcga

SEQ ID NO: 201194 - DNA, 37 bp, Artificial Sequence
  Synthetic oligonucleotide
gaatgggtgagcggaaaggaacagtacagcgagcgga

SEQ ID NO: 201195 - DNA, 37 bp, Artificial Sequence
  Synthetic oligonucleotide
tcaaggggcggtgaaggggctagtacatgtggcggga

SEQ ID NO: 201196 - DNA, 37 bp, Artificial Sequence
  Synthetic oligonucleotide
acagtaggaggggaagagaggagacgtcacccatgga

SEQ ID NO: 201197 - DNA, 37 bp, Artificial Sequence
  Synthetic oligonucleotide
gggtacgacagaggaaaatggaggagtagaggatgga

SEQ ID NO: 201198 - DNA, 35 bp, Artificial Sequence
  Synthetic oligonucleotide
tgccacctacatgatctcgtttcccccaacactga

SEQ ID NO: 201199 - DNA, 38 bp, Artificial Sequence
  Synthetic oligonucleotide
tccaaagcctcagatcgacgcatcccttacctacctga

SEQ ID NO: 201200 - DNA, 38 bp, Artificial Sequence
  Synthetic oligonucleotide
gaaggacagccggagtatggagggagggtagggcgtga

SEQ ID NO: 201201 - DNA, 37 bp, Artificial Sequence
  Synthetic oligonucleotide
ggaggggcacagggagcggatgagcatgcacatgtga

SEQ ID NO: 201202 - DNA, 37 bp, Artificial Sequence
  Synthetic oligonucleotide
agccaactccgtacgcgcctctcttcgccacttgtga

SEQ ID NO: 201203 - DNA, 37 bp, Artificial Sequence
  Synthetic oligonucleotide
agcacaccgccctcgtcgttggttcacctgattttga

SEQ ID NO: 201204 - DNA, 36 bp, Artificial Sequence
  Synthetic oligonucleotide
gtccaccgcacatgtgtacgtctccgccatccccta

SEQ ID NO: 201205 - DNA, 35 bp, Artificial Sequence
  Synthetic oligonucleotide
tagtgtccgccctcctgtctgcatttagtccccta

SEQ ID NO: 201206 - DNA, 35 bp, Artificial Sequence
  Synthetic oligonucleotide
atgggggggcaagtggcgggaggatgtcgtgcgta

SEQ ID NO: 201207 - DNA, 35 bp, Artificial Sequence
  Synthetic oligonucleotide
atgcaagtgccgggtagcacgggggacgaggggta

SEQ ID NO: 201208 - DNA, 35 bp, Artificial Sequence
  Synthetic oligonucleotide
aacacacaggaggtagagggattgtgaaggggcac

SEQ ID NO: 201209 - DNA, 35 bp, Artificial Sequence
  Synthetic oligonucleotide
ttgatgcgccccactgcagtcaccgttggttctac

SEQ ID NO: 201210 - DNA, 35 bp, Artificial Sequence
  Synthetic oligonucleotide
gtgccacccgccagttatggtgaatttgccctacc

SEQ ID NO: 201211 - DNA, 35 bp, Artificial Sequence
  Synthetic oligonucleotide
tgccaggaagttgggctcccactcatgtctgctcc

SEQ ID NO: 201212 - DNA, 35 bp, Artificial Sequence
  Synthetic oligonucleotide
atgcactctgccagtttcaatatctccgtacgtcc

SEQ ID NO: 201213 - DNA, 35 bp, Artificial Sequence
  Synthetic oligonucleotide
tctgcgcagaggtcattttgctttatcttccacgc

SEQ ID NO: 201214 - DNA, 35 bp, Artificial Sequence
  Synthetic oligonucleotide
tcaaatcagacggggtaatcatcgcccctccctgc

SEQ ID NO: 201215 - DNA, 35 bp, Artificial Sequence
  Synthetic oligonucleotide
ttctgcgattcgcccgtgtacctccttgccgctgc

SEQ ID NO: 201216 - DNA, 35 bp, Artificial Sequence
  Synthetic oligonucleotide
gttccgtccatcatcatatccgaggcccggccatc

SEQ ID NO: 201217 - DNA, 35 bp, Artificial Sequence
  Synthetic oligonucleotide
tgaactgcctacatccaccgtggccctgcaaactc

SEQ ID NO: 201218 - DNA, 35 bp, Artificial Sequence
  Synthetic oligonucleotide
gtcgccgtacaccagggatcgcctgtactttgctc

SEQ ID NO: 201219 - DNA, 35 bp, Artificial Sequence
  Synthetic oligonucleotide
gaggccctccgcagcctgtgactccttatcgcttc

SEQ ID NO: 201220 - DNA, 35 bp, Artificial Sequence
  Synthetic oligonucleotide
accgagggcgaacgaaaaacggagtaaggggggcg

SEQ ID NO: 201221 - DNA, 35 bp, Artificial Sequence
  Synthetic oligonucleotide
atgatagttggacagaagatggggaaggccggctg

SEQ ID NO: 201222 - DNA, 35 bp, Artificial Sequence
  Synthetic oligonucleotide
tgcgtgcccgcccctctgttcgttactttgtcaat

SEQ ID NO: 201223 - DNA, 35 bp, Artificial Sequence
  Synthetic oligonucleotide
ttcgcgacgcccaatgtctttgccccattgctcct

SEQ ID NO: 201224 - DNA, 35 bp, Artificial Sequence
  Synthetic oligonucleotide
attgcaaagctcaacctgcctacgttacttgtcct

SEQ ID NO: 201225 - DNA, 34 bp, Artificial Sequence
  Synthetic oligonucleotide
ttagtcagttcagccgccccatcaaccgagctct

SEQ ID NO: 201226 - DNA, 35 bp, Artificial Sequence
  Synthetic oligonucleotide
tgctcgctctgcccgccacacctcttgcttgtagt

SEQ ID NO: 201227 - DNA, 35 bp, Artificial Sequence
  Synthetic oligonucleotide
tacccgccgatatactcacttctactgctttctgt

SEQ ID NO: 201228 - DNA, 35 bp, Artificial Sequence
  Synthetic oligonucleotide
tttgacaggtatgtctgcttctcgatccccctctt

SEQ ID NO: 201229 - DNA, 35 bp, Artificial Sequence
  Synthetic oligonucleotide
gtgcgcctctccgcccgaaactgactggtaacgtt

SEQ ID NO: 201230 - DNA, 35 bp, Artificial Sequence
  Synthetic oligonucleotide
gtagagcgacggcgtctatttctacaccttttcaa

SEQ ID NO: 201231 - DNA, 36 bp, Artificial Sequence
  Synthetic oligonucleotide
gagacgcgggaggttagcgggaaggatccggtgaca

SEQ ID NO: 201232 - DNA, 36 bp, Artificial Sequence
  Synthetic oligonucleotide
gagcggtggacaaagggggggattatggtgagacca

SEQ ID NO: 201233 - DNA, 36 bp, Artificial Sequence
  Synthetic oligonucleotide
ttgatcgtccacggcgtactctaaacctttcctcca

SEQ ID NO: 201234 - DNA, 36 bp, Artificial Sequence
  Synthetic oligonucleotide
gtctacgtccgccgggggattcgaccaccctctcca

SEQ ID NO: 201235 - DNA, 36 bp, Artificial Sequence
  Synthetic oligonucleotide
gtggggaggggacggacaagtgatgcgtgactggca

SEQ ID NO: 201236 - DNA, 36 bp, Artificial Sequence
  Synthetic oligonucleotide
gcgcactctatctggttacaatggcctctttctgca

SEQ ID NO: 201237 - DNA, 36 bp, Artificial Sequence
  Synthetic oligonucleotide
ttacacagcgcaactttgctttggcacctttcatca

SEQ ID NO: 201238 - DNA, 36 bp, Artificial Sequence
  Synthetic oligonucleotide
tagcactccctttacctggacacagttctgctatca

SEQ ID NO: 201239 - DNA, 36 bp, Artificial Sequence
  Synthetic oligonucleotide
acgacgggccagcagaactcttgcccacacttctca

SEQ ID NO: 201240 - DNA, 36 bp, Artificial Sequence
  Synthetic oligonucleotide
tccatcaggtgtgatctccgttcgctggcttattca

SEQ ID NO: 201241 - DNA, 36 bp, Artificial Sequence
  Synthetic oligonucleotide
gaccctacctcgttgtctatcgctcccgacacttca

SEQ ID NO: 201242 - DNA, 35 bp, Artificial Sequence
  Synthetic oligonucleotide
tctgtccactcctccgcttgtttggtcaggtttca

SEQ ID NO: 201243 - DNA, 37 bp, Artificial Sequence
  Synthetic oligonucleotide
gagggagaagaaggcggttataggcacacgggtaaga

SEQ ID NO: 201244 - DNA, 35 bp, Artificial Sequence
  Synthetic oligonucleotide
gtggggagggcaggtagggggacaggaaactgcga

SEQ ID NO: 201245 - DNA, 36 bp, Artificial Sequence
  Synthetic oligonucleotide
tgagcctacctcattcagttctatcggttctttcga

SEQ ID NO: 201246 - DNA, 37 bp, Artificial Sequence
  Synthetic oligonucleotide
agcggggttgacaggggggggcggatcagtaaaggga

SEQ ID NO: 201247 - DNA, 37 bp, Artificial Sequence
  Synthetic oligonucleotide
tgacagcatgcgggaagaagggggaggacgacgggga

SEQ ID NO: 201248 - DNA, 36 bp, Artificial Sequence
  Synthetic oligonucleotide
accaaacggaggcaggaggggtaggaaatgggtgga

SEQ ID NO: 201249 - DNA, 37 bp, Artificial Sequence
  Synthetic oligonucleotide
tgataggacgggaaagggaagtgagcatgtcaaatga

SEQ ID NO: 201250 - DNA, 35 bp, Artificial Sequence
  Synthetic oligonucleotide
tccacaacgccctgtttcacatcgtccacatctga

SEQ ID NO: 201251 - DNA, 36 bp, Artificial Sequence
  Synthetic oligonucleotide
tactccacacatgcactaaaactgtccccccagtga

SEQ ID NO: 201252 - DNA, 38 bp, Artificial Sequence
  Synthetic oligonucleotide
gaggggggtgggcaagatcgtgttgggggcagacgtga

SEQ ID NO: 201253 - DNA, 38 bp, Artificial Sequence
  Synthetic oligonucleotide
gccaagcgttcaggcgcctcgcatatactctctcttga

SEQ ID NO: 201254 - DNA, 36 bp, Artificial Sequence
  Synthetic oligonucleotide
tgacagtcatcacccacgtgcctttaatccatccta

SEQ ID NO: 201255 - DNA, 35 bp, Artificial Sequence
  Synthetic oligonucleotide
agtccacacgccacattagttcccaactgctctta

SEQ ID NO: 201256 - DNA, 35 bp, Artificial Sequence
  Synthetic oligonucleotide
acaccatctcatacctccgctgcgggaccacgcac

SEQ ID NO: 201257 - DNA, 35 bp, Artificial Sequence; identical to SEQ ID NO: 43192
  Synthetic oligonucleotide

SEQ ID NO: 201258 - DNA, 35 bp, Artificial Sequence
  Synthetic oligonucleotide
tacgcacctgcctcgtaaaacactatagctgaacc

SEQ ID NO: 201259 - DNA, 35 bp, Artificial Sequence
  Synthetic oligonucleotide
tcactcatccatgccgcttttaggcccggttcacc

SEQ ID NO: 201260 - DNA, 35 bp, Artificial Sequence
  Synthetic oligonucleotide
gccatcggcgaatggttccatcgttcatcctcccc

SEQ ID NO: 201261 - DNA, 35 bp, Artificial Sequence
  Synthetic oligonucleotide
tatgatgtgcgaacctatccgttgtactctagccc

SEQ ID NO: 201262 - DNA, 35 bp, Artificial Sequence
  Synthetic oligonucleotide
atccccacacgcagccaatatctcacggaggtccc

SEQ ID NO: 201263 - DNA, 35 bp, Artificial Sequence
  Synthetic oligonucleotide
agtccgtccgcctcgtatctggttcgttcgcagcc

SEQ ID NO: 201264 - DNA, 35 bp, Artificial Sequence
  Synthetic oligonucleotide
atgccgttctcctctgtacctcccgtcaggcacgc

SEQ ID NO: 201265 - DNA, 35 bp, Artificial Sequence
  Synthetic oligonucleotide
tacaggcgcgatgggtagggaagggcagggatggc

SEQ ID NO: 201266 - DNA, 35 bp, Artificial Sequence
  Synthetic oligonucleotide
ggaaccacgggccgggaggatgaagggaggactgc

SEQ ID NO: 201267 - DNA, 35 bp, Artificial Sequence
  Synthetic oligonucleotide
tcaagctgccatctgtccctgtccacggcctactc

SEQ ID NO: 201268 - DNA, 35 bp, Artificial Sequence
  Synthetic oligonucleotide
tcaccagtccggccagaatttgccaactttgcctc

SEQ ID NO: 201269 - DNA, 35 bp, Artificial Sequence
  Synthetic oligonucleotide
tacgacgataggatatgtgtcgcctgctgtttctc

SEQ ID NO: 201270 - DNA, 35 bp, Artificial Sequence
  Synthetic oligonucleotide
gccgagtgcttcagcggcgtacgggtccatccttc

SEQ ID NO: 201271 - DNA, 34 bp, Artificial Sequence
  Synthetic oligonucleotide
tccgcacctgctgcaccctcgccgaactgagttc

SEQ ID NO: 201272 - DNA, 35 bp, Artificial Sequence
  Synthetic oligonucleotide
ttcgatcgggttgatgcacgttacttccgccgttc

SEQ ID NO: 201273 - DNA, 35 bp, Artificial Sequence
  Synthetic oligonucleotide
gccctccacactgcttctgagccacgatctctttc

SEQ ID NO: 201274 - DNA, 34 bp, Artificial Sequence
  Synthetic oligonucleotide
ttcgagcgaccttggctttctcctgtctctttag

SEQ ID NO: 201275 - DNA, 35 bp, Artificial Sequence
  Synthetic oligonucleotide
tgtacctacagccacccaccatcgagttttccccg

SEQ ID NO: 201276 - DNA, 35 bp, Artificial Sequence
  Synthetic oligonucleotide
ttgccacccatctgtaccgccacctgcgccccgcg

SEQ ID NO: 201277 - DNA, 35 bp, Artificial Sequence
  Synthetic oligonucleotide
actgtcgccccgtttctaagttccatcatcttgcg

SEQ ID NO: 201278 - DNA, 35 bp, Artificial Sequence
  Synthetic oligonucleotide
tgaaagaggaggggagaaggaacggtacggagtgg

SEQ ID NO: 201279 - DNA, 35 bp, Artificial Sequence
  Synthetic oligonucleotide
gacccgcaccatctatgtctccctaggaacaactg

SEQ ID NO: 201280 - DNA, 35 bp, Artificial Sequence
  Synthetic oligonucleotide
atcccccgtggcctgttagctctgcctcttgtttg

SEQ ID NO: 201281 - DNA, 34 bp, Artificial Sequence
  Synthetic oligonucleotide
gatgacacgagctgtgcctcccagttacttacct

SEQ ID NO: 201282 - DNA, 35 bp, Artificial Sequence
  Synthetic oligonucleotide
tccgcgcctcacctgtcatcaccgtacgcggccct

SEQ ID NO: 201283 - DNA, 35 bp, Artificial Sequence
  Synthetic oligonucleotide
aacatggtgcgggggggctgtgaggggttgagcct

SEQ ID NO: 201284 - DNA, 35 bp, Artificial Sequence
  Synthetic oligonucleotide
gtcccgcccgtcttttttaggcgccttactacagt

SEQ ID NO: 201285 - DNA, 35 bp, Artificial Sequence
  Synthetic oligonucleotide
gataaggaggcagatagggcataagaggggagggt

SEQ ID NO: 201286 - DNA, 35 bp, Artificial Sequence
  Synthetic oligonucleotide
tccaggcaggaccgccgcctgctattgatccatgt

SEQ ID NO: 201287 - DNA, 35 bp, Artificial Sequence
  Synthetic oligonucleotide
tccgacttcactatagcctcacaacatcctcccaa

SEQ ID NO: 201288 - DNA, 36 bp, Artificial Sequence
  Synthetic oligonucleotide
tggagtaggttaggcgggaagcaggggagctgagaa

SEQ ID NO: 201289 - DNA, 36 bp, Artificial Sequence
  Synthetic oligonucleotide
gtgctcccccagccattccttgccgactacccataa

SEQ ID NO: 201290 - DNA, 35 bp, Artificial Sequence
  Synthetic oligonucleotide
atccgcgtgagcactctatctacctgccgctgaca

SEQ ID NO: 201291 - DNA, 36 bp, Artificial Sequence
  Synthetic oligonucleotide
tgacccatcgcctttgacgtcactttgatctataca

SEQ ID NO: 201292 - DNA, 36 bp, Artificial Sequence
  Synthetic oligonucleotide
tgagtgggaagtctcgggtaatcgggcgggtgacca

SEQ ID NO: 201293 - DNA, 35 bp, Artificial Sequence
  Synthetic oligonucleotide
tgatccacagatgtgttcgtctgctgcccttccca

SEQ ID NO: 201294 - DNA, 36 bp, Artificial Sequence
  Synthetic oligonucleotide
tccaccccctgtgcgattagtgtcttcttgccgcca

SEQ ID NO: 201295 - DNA, 36 bp, Artificial Sequence
  Synthetic oligonucleotide
gtgccccccgccgacgttccatttagcctggctcca

SEQ ID NO: 201296 - DNA, 36 bp, Artificial Sequence
  Synthetic oligonucleotide
tgtgccgcagaaggggagtagtgtggcgggggggca

SEQ ID NO: 201297 - DNA, 36 bp, Artificial Sequence
  Synthetic oligonucleotide
gagatgcatccaatcctgtaccctctgtcaaattca

SEQ ID NO: 201298 - DNA, 37 bp, Artificial Sequence
  Synthetic oligonucleotide
ggggggggagggggaggtaattgcacaatcaaccaga

SEQ ID NO: 201299 - DNA, 36 bp, Artificial Sequence
  Synthetic oligonucleotide
acatccggggtgggaagtggggaatgggtctgtcga

SEQ ID NO: 201300 - DNA, 37 bp, Artificial Sequence
  Synthetic oligonucleotide
agtggaagagaacaggtgtggataggtgcaggaggga

SEQ ID NO: 201301 - DNA, 38 bp, Artificial Sequence
  Synthetic oligonucleotide
aacaccgcccgcacgtgtaattcacccccacctactga

SEQ ID NO: 201302 - DNA, 36 bp, Artificial Sequence
  Synthetic oligonucleotide
tgattcccgcccacacttgtcatctgtactgcctga

SEQ ID NO: 201303 - DNA, 38 bp, Artificial Sequence
  Synthetic oligonucleotide
gccgggaaggtgggaatgggttagtagataggaagtga

SEQ ID NO: 201304 - DNA, 38 bp, Artificial Sequence
  Synthetic oligonucleotide
gggagggccagtgggtgggagtgctctcattaccgtga

SEQ ID NO: 201305 - DNA, 38 bp, Artificial Sequence
  Synthetic oligonucleotide
tcaggaggaggccgggggggcattagacaactcggtga

SEQ ID NO: 201306 - DNA, 37 bp, Artificial Sequence
  Synthetic oligonucleotide
tacctcctcaacggtcgttatgacccctttctattga

SEQ ID NO: 201307 - DNA, 38 bp, Artificial Sequence
  Synthetic oligonucleotide
ttgacacggcctttactggatatatcgcccttccttga

SEQ ID NO: 201308 - DNA, 35 bp, Artificial Sequence
  Synthetic oligonucleotide
atgtacgccgcctatctgaggcccgaaccacccta

SEQ ID NO: 201309 - DNA, 36 bp, Artificial Sequence
  Synthetic oligonucleotide
gcccgaaccggatgtccctcctcgcatatctcgcta

SEQ ID NO: 201310 - DNA, 35 bp, Artificial Sequence
  Synthetic oligonucleotide
accatcccccctccgtgcatcctgtacccaggcta

SEQ ID NO: 201311 - DNA, 36 bp, Artificial Sequence
  Synthetic oligonucleotide
ttcacgcctcgactcctatatcgtgctttttccgta

SEQ ID NO: 201312 - DNA, 35 bp, Artificial Sequence
  Synthetic oligonucleotide
ttaggccccggctaccgtcgtttttctgctcacgc

SEQ ID NO: 201313 - DNA, 35 bp, Artificial Sequence
  Synthetic oligonucleotide
tccgcgttgatgctccctccccgctttgttgccgc

SEQ ID NO: 201314 - DNA, 35 bp, Artificial Sequence
  Synthetic oligonucleotide
tgcccagctccggagtctccagcacttcgctccgc

SEQ ID NO: 201315 - DNA, 35 bp, Artificial Sequence
  Synthetic oligonucleotide
tgtgacctagcctcactggtatcacgttcttcctc

SEQ ID NO: 201316 - DNA, 35 bp, Artificial Sequence
  Synthetic oligonucleotide
tgacccttcgaggtgccgtttgaatccccatcgtc

SEQ ID NO: 201317 - DNA, 34 bp, Artificial Sequence
  Synthetic oligonucleotide
aacatccagtgggatgcacgacctctcgcttgtc

SEQ ID NO: 201318 - DNA, 34 bp, Artificial Sequence
  Synthetic oligonucleotide
tccgcacctgatgccccctcgccgaactgagttc

SEQ ID NO: 201319 - DNA, 35 bp, Artificial Sequence
  Synthetic oligonucleotide
ggtgaagagggtggggagtagaacgcgaatatgag

SEQ ID NO: 201320 - DNA, 35 bp, Artificial Sequence
  Synthetic oligonucleotide
tgaatacatgcgccattctccgtctctacatcacg

SEQ ID NO: 201321 - DNA, 35 bp, Artificial Sequence
  Synthetic oligonucleotide
tcagtgcgtcgccgtcaattcaggccctgtctacg

SEQ ID NO: 201322 - DNA, 35 bp, Artificial Sequence
  Synthetic oligonucleotide
tgacacatcctcccgctgaccgtattgcgaccgcg

SEQ ID NO: 201323 - DNA, 35 bp, Artificial Sequence
  Synthetic oligonucleotide
ggtgcgaagaggggaaacggaaggagtagaccggg

SEQ ID NO: 201324 - DNA, 35 bp, Artificial Sequence
  Synthetic oligonucleotide
gaagacggaagtactgtaggattggcaggaagggg

SEQ ID NO: 201325 - DNA, 35 bp, Artificial Sequence
  Synthetic oligonucleotide
accccatcaggctgtgtgccattatgcctctcctg

SEQ ID NO: 201326 - DNA, 35 bp, Artificial Sequence
  Synthetic oligonucleotide
gactggtaactttcccacctcattcttgctgtttg

SEQ ID NO: 201327 - DNA, 35 bp, Artificial Sequence
  Synthetic oligonucleotide
attccgcgtgcggatcatgaatttcgctaccttct

SEQ ID NO: 201328 - DNA, 35 bp, Artificial Sequence
  Synthetic oligonucleotide
tcttacgacgtgttgcctgttttagctccatttct

SEQ ID NO: 201329 - DNA, 35 bp, Artificial Sequence
  Synthetic oligonucleotide
gctccaaccgccgacaccagggcacagcactttct

SEQ ID NO: 201330 - DNA, 35 bp, Artificial Sequence
  Synthetic oligonucleotide
gcatccgccctccgccatgtaatcgtccacattgt

SEQ ID NO: 201331 - DNA, 35 bp, Artificial Sequence
  Synthetic oligonucleotide
gttgggaggggggtgagggcgcaaagtggggggaa

SEQ ID NO: 201332 - DNA, 36 bp, Artificial Sequence
  Synthetic oligonucleotide
tcgcaccctccggcttccgtgtctcgaccgccccca

SEQ ID NO: 201333 - DNA, 36 bp, Artificial Sequence
  Synthetic oligonucleotide
ttgggtgaggcggggttgggctaagcagatgatgca

SEQ ID NO: 201334 - DNA, 37 bp, Artificial Sequence
  Synthetic oligonucleotide
gaagtggcgagacaatggatggaggtagggcacaaga

SEQ ID NO: 201335 - DNA, 37 bp, Artificial Sequence
  Synthetic oligonucleotide
gagtagaaggagccaagggagaagggcagtttgcaga

SEQ ID NO: 201336 - DNA, 36 bp, Artificial Sequence
  Synthetic oligonucleotide
taacaagagaggcaaaaacggagagggggatgacga

SEQ ID NO: 201337 - DNA, 37 bp, Artificial Sequence
  Synthetic oligonucleotide
taccatcggatgaagcgtcttctgtcacacctcccga

SEQ ID NO: 201338 - DNA, 35 bp, Artificial Sequence
  Synthetic oligonucleotide
gtcatccccatctctaccaaccaggcgaacctcga

SEQ ID NO: 201339 - DNA, 37 bp, Artificial Sequence
  Synthetic oligonucleotide
gtcaaatgagggtggagatgtacagggcggagaggga

SEQ ID NO: 201340 - DNA, 31 bp, Artificial Sequence
  Synthetic oligonucleotide
tactatacgggggggagggtaagagagggga

SEQ ID NO: 201341 - DNA, 37 bp, Artificial Sequence
  Synthetic oligonucleotide
gcacagggctgtggtgaaggaggtgcatggaggggga

SEQ ID NO: 201342 - DNA, 37 bp, Artificial Sequence
  Synthetic oligonucleotide
tcatgagaggtggaaatgtggcatgagatgtggggga

SEQ ID NO: 201343 - DNA, 37 bp, Artificial Sequence
  Synthetic oligonucleotide
tccagtggaggaatgggtgagggggggtcacaatgga

SEQ ID NO: 201344 - DNA, 38 bp, Artificial Sequence
  Synthetic oligonucleotide
atgaccccgccccgtgccaactaagacacaatcagtga

SEQ ID NO: 201345 - DNA, 38 bp, Artificial Sequence
  Synthetic oligonucleotide
gacacaggaaaggggggtcgtagggatggcgctcgtga

SEQ ID NO: 201346 - DNA, 38 bp, Artificial Sequence
  Synthetic oligonucleotide
gcaaggggcgagacgagaagaaaggcaaaagggggtga

SEQ ID NO: 201347 - DNA, 38 bp, Artificial Sequence
  Synthetic oligonucleotide
tgcccaccaccgcgcgataagcttcctcctatgggtga

SEQ ID NO: 201348 - DNA, 38 bp, Artificial Sequence
  Synthetic oligonucleotide
acacccactgttagtcccgtctactcaacagtctttga

SEQ ID NO: 201349 - DNA, 35 bp, Artificial Sequence
  Synthetic oligonucleotide
gtgcaacgtaagcccgcccccaccgttactccata

SEQ ID NO: 201350 - DNA, 35 bp, Artificial Sequence
  Synthetic oligonucleotide
ttagcgactcatctcgtatgttcctgccccccgta

SEQ ID NO: 201351 - DNA, 35 bp, Artificial Sequence
  Synthetic oligonucleotide
gagagggtgggagggtactcattgctccgggtgac

SEQ ID NO: 201352 - DNA, 35 bp, Artificial Sequence
  Synthetic oligonucleotide
gatgcacattgccgcccagagatcgcgcttcaacc

SEQ ID NO: 201353 - DNA, 35 bp, Artificial Sequence
  Synthetic oligonucleotide
gatccgcattatgcgctgcctgcctctatttggcc

SEQ ID NO: 201354 - DNA, 35 bp, Artificial Sequence
  Synthetic oligonucleotide
gaggactgctgctggtcgcgccccgtccaaaatcc

SEQ ID NO: 201355 - DNA, 35 bp, Artificial Sequence
  Synthetic oligonucleotide
tagactagcctgcctgtgctccatctccgtcctcc

SEQ ID NO: 201356 - DNA, 35 bp, Artificial Sequence
  Synthetic oligonucleotide
gtgagctcgcactgtgagcaatttcagtcacttcc

SEQ ID NO: 201357 - DNA, 35 bp, Artificial Sequence
  Synthetic oligonucleotide
gccgcaggacactcacgaacgttctggatacttcc

SEQ ID NO: 201358 - DNA, 35 bp, Artificial Sequence
  Synthetic oligonucleotide
gtggactcctaagcgtctaagtaaccggcccttcc

SEQ ID NO: 201359 - DNA, 35 bp, Artificial Sequence
  Synthetic oligonucleotide
ttgcaagctgtcgggtctttcgccatatgttttcc

SEQ ID NO: 201360 - DNA, 35 bp, Artificial Sequence
  Synthetic oligonucleotide
gctgacccctgtcgtcttgcccgtaaaccccactc

SEQ ID NO: 201361 - DNA, 35 bp, Artificial Sequence
  Synthetic oligonucleotide
atggaagccactgcggctcacttgacttcgttctc

SEQ ID NO: 201362 - DNA, 35 bp, Artificial Sequence
  Synthetic oligonucleotide
tcagtaacatccgtaatcctggtcacgagcctttc

SEQ ID NO: 201363 - DNA, 35 bp, Artificial Sequence
  Synthetic oligonucleotide
tgtctccgcccgttctatgaaccaccatcacaaag

SEQ ID NO: 201364 - DNA, 35 bp, Artificial Sequence
  Synthetic oligonucleotide
acagccccgcccgctaatagtacctctcgagtaag

SEQ ID NO: 201365 - DNA, 35 bp, Artificial Sequence
  Synthetic oligonucleotide
gagggaaggtgtgaaatagagtggggcgagttcag

SEQ ID NO: 201366 - DNA, 35 bp, Artificial Sequence
  Synthetic oligonucleotide
atgggaggggtggcgggtaatcgggaacaaaaccg

SEQ ID NO: 201367 - DNA, 35 bp, Artificial Sequence
  Synthetic oligonucleotide
gcctccagtccgtcctggtctatcagaccccttcg

SEQ ID NO: 201368 - DNA, 35 bp, Artificial Sequence
  Synthetic oligonucleotide
aactagggacgggagggcgggtcaagaggggacgg

SEQ ID NO: 201369 - DNA, 35 bp, Artificial Sequence
  Synthetic oligonucleotide
gccaagacggtgtgggaagggtggtagactgatgg

SEQ ID NO: 201370 - DNA, 35 bp, Artificial Sequence
  Synthetic oligonucleotide
gtggggcgcatgggaggagtaggttgcagggccat

SEQ ID NO: 201371 - DNA, 35 bp, Artificial Sequence
  Synthetic oligonucleotide
gatctacctccgtgcctcttgaggctaattatcat

SEQ ID NO: 201372 - DNA, 35 bp, Artificial Sequence
  Synthetic oligonucleotide
gcacctgccacttctggacggcctcctctccgact

SEQ ID NO: 201373 - DNA, 35 bp, Artificial Sequence
  Synthetic oligonucleotide
tacgacaggaagcgtgttaccgcctgtccatccct

SEQ ID NO: 201374 - DNA, 35 bp, Artificial Sequence
  Synthetic oligonucleotide
gatgctccattttgcgtccttcctcgtctttgcct

SEQ ID NO: 201375 - DNA, 35 bp, Artificial Sequence
  Synthetic oligonucleotide
atcgcatcaaatgtaccggtggtttcgcgccctct

SEQ ID NO: 201376 - DNA, 35 bp, Artificial Sequence
  Synthetic oligonucleotide
gacgactagcctcagcgaactgctcacaatcctgt

SEQ ID NO: 201377 - DNA, 36 bp, Artificial Sequence
  Synthetic oligonucleotide
tgaaggagcagggaggtaacgggcatcgatcttgtt

SEQ ID NO: 201378 - DNA, 36 bp, Artificial Sequence
  Synthetic oligonucleotide
aagagcaaggggggaggtgaacagggctggcttaca

SEQ ID NO: 201379 - DNA, 35 bp, Artificial Sequence
  Synthetic oligonucleotide
gtgaatcctcatgtcccagtccaagccccttgcca

SEQ ID NO: 201380 - DNA, 35 bp, Artificial Sequence
  Synthetic oligonucleotide
acactacaagtacagctagtcgcgcccgccatgca

SEQ ID NO: 201381 - DNA, 35 bp, Artificial Sequence
  Synthetic oligonucleotide
gttgcgccccggttgttctattggccgtccattca

SEQ ID NO: 201382 - DNA, 36 bp, Artificial Sequence
  Synthetic oligonucleotide
tccaccacagtgcgactatgtcacttcgttccttca

SEQ ID NO: 201383 - DNA, 35 bp, Artificial Sequence
  Synthetic oligonucleotide
acttggcctccatggatatgacccgccgctgttca

SEQ ID NO: 201384 - DNA, 37 bp, Artificial Sequence
  Synthetic oligonucleotide
gttagctgagtcgcgggggggtagagcaaaattcaga

SEQ ID NO: 201385 - DNA, 36 bp, Artificial Sequence
  Synthetic oligonucleotide
ggtgtagggagcggaaagggggcaggtatgagtaga

SEQ ID NO: 201386 - DNA, 37 bp, Artificial Sequence
  Synthetic oligonucleotide
tgatccagcgtcactcgtcccccgtttcctcgcccga

SEQ ID NO: 201387 - DNA, 37 bp, Artificial Sequence
  Synthetic oligonucleotide
agtggggttggaaggcgaggaaagggggcgcaggcga

SEQ ID NO: 201388 - DNA, 37 bp, Artificial Sequence
  Synthetic oligonucleotide
tcgtcccctccagtgtcattgcctcttgcccttagga

SEQ ID NO: 201389 - DNA, 37 bp, Artificial Sequence
  Synthetic oligonucleotide
aacaggtgcagggatgggctatggtacagggtgggga

SEQ ID NO: 201390 - DNA, 35 bp, Artificial Sequence
  Synthetic oligonucleotide
gggacggggaacgaatagaggacgagggatatgga

SEQ ID NO: 201391 - DNA, 37 bp, Artificial Sequence
  Synthetic oligonucleotide
gcaccttaacatgcgaacagcactgccctcacttgga

SEQ ID NO: 201392 - DNA, 35 bp, Artificial Sequence
  Synthetic oligonucleotide
acacgactcgacgagttttcgagttctcctcctga

SEQ ID NO: 201393 - DNA, 38 bp, Artificial Sequence
  Synthetic oligonucleotide
aagatgcgaggggaggcgtagaaggtcgttgcgtctga

SEQ ID NO: 201394 - DNA, 38 bp, Artificial Sequence
  Synthetic oligonucleotide
aaggtggagggaggatagcaagagtggggatgtagtga

SEQ ID NO: 201395 - DNA, 36 bp, Artificial Sequence
  Synthetic oligonucleotide
tgtatgcgaggagtaaagggggggcgttagaggtga

SEQ ID NO: 201396 - DNA, 38 bp, Artificial Sequence
  Synthetic oligonucleotide
gtagggtgcaagacggcgaaaaggggaggcaatggtga

SEQ ID NO: 201397 - DNA, 38 bp, Artificial Sequence
  Synthetic oligonucleotide
aaggaggggcgaggcaagggtaaggtggcgtcctgtga

SEQ ID NO: 201398 - DNA, 38 bp, Artificial Sequence
  Synthetic oligonucleotide
atcgccccttgcctcaacgttactgcatatcagcttga

SEQ ID NO: 201399 - DNA, 37 bp, Artificial Sequence
  Synthetic oligonucleotide
gtacacccgcccatgtttatccactctggcttgttga

SEQ ID NO: 201400 - DNA, 34 bp, Artificial Sequence
  Synthetic oligonucleotide
gatcaccctctatggcgccctggatctgctttga

SEQ ID NO: 201401 - DNA, 36 bp, Artificial Sequence
  Synthetic oligonucleotide
gtgtgttgaggtggaaaaaggagggaagagtcaata

SEQ ID NO: 201402 - DNA, 35 bp, Artificial Sequence
  Synthetic oligonucleotide
aagggagggggcaggagttacagtacaaggatata

SEQ ID NO: 201403 - DNA, 35 bp, Artificial Sequence
  Synthetic oligonucleotide
ttcccaccaactgtgtaccgctccggaccaaccta

SEQ ID NO: 201404 - DNA, 36 bp, Artificial Sequence
  Synthetic oligonucleotide
tcacctagcgccttctccatgcgtgcgtatgtccta

SEQ ID NO: 201405 - DNA, 35 bp, Artificial Sequence
  Synthetic oligonucleotide
tccatggcacagcttttctccttagtcactgtcta

SEQ ID NO: 201406 - DNA, 35 bp, Artificial Sequence
  Synthetic oligonucleotide
tggagtgggggtgggcatggacagagggctgggta

SEQ ID NO: 201407 - DNA, 35 bp, Artificial Sequence
  Synthetic oligonucleotide
aaagcggggttgggagggacgataaacgggcgacc

SEQ ID NO: 201408 - DNA, 35 bp, Artificial Sequence
  Synthetic oligonucleotide
acaggcgatcgccagggcgtccctacctgcttacc

SEQ ID NO: 201409 - DNA, 35 bp, Artificial Sequence
  Synthetic oligonucleotide
acccgttagcaccgaccccgcgcccgtccgccccc

SEQ ID NO: 201410 - DNA, 35 bp, Artificial Sequence
  Synthetic oligonucleotide
gaatgaagatgtgccaattccattgatcctgctcc

SEQ ID NO: 201411 - DNA, 35 bp, Artificial Sequence
  Synthetic oligonucleotide
tacgcccccctccttgtgactaatgctagctttcc

SEQ ID NO: 201412 - DNA, 36 bp, Artificial Sequence
  Synthetic oligonucleotide
agagcaacctccgacttttcttcaatgtagcttcgc

SEQ ID NO: 201413 - DNA, 35 bp, Artificial Sequence
  Synthetic oligonucleotide
tcccagtcaggtctcttcttcccggtcaattttgc

SEQ ID NO: 201414 - DNA, 34 bp, Artificial Sequence
  Synthetic oligonucleotide
gccatcacccgctagattagtctcttcttcgatc

SEQ ID NO: 201415 - DNA, 35 bp, Artificial Sequence
  Synthetic oligonucleotide
tacagcaccaatggcttaagcacttgccctacctc

SEQ ID NO: 201416 - DNA, 35 bp, Artificial Sequence
  Synthetic oligonucleotide
tccacgtcacagggttgcccactttaacttccgtc

SEQ ID NO: 201417 - DNA, 35 bp, Artificial Sequence
  Synthetic oligonucleotide
aacgtggcgtactccatgttttggccatttctttc

SEQ ID NO: 201418 - DNA, 35 bp, Artificial Sequence
  Synthetic oligonucleotide
acacacgtagagggatgggaggttgaagcagtcag

SEQ ID NO: 201419 - DNA, 35 bp, Artificial Sequence
  Synthetic oligonucleotide
gtggaaagccagtggatcgcgggggggagaagtcg

SEQ ID NO: 201420 - DNA, 35 bp, Artificial Sequence
  Synthetic oligonucleotide
gtttgacccggccagatatactagcctcctcttcg

SEQ ID NO: 201421 - DNA, 35 bp, Artificial Sequence
  Synthetic oligonucleotide
gtgagtgtgcgcggtagttcggggggcggagtaaa

SEQ ID NO: 201422 - DNA, 36 bp, Artificial Sequence
  Synthetic oligonucleotide
gtggagaaggcggtggtggtaaggggccatacgcaa

SEQ ID NO: 201423 - DNA, 36 bp, Artificial Sequence
  Synthetic oligonucleotide
acgatgcggggggggaggttttgggccggtactaca

SEQ ID NO: 201424 - DNA, 35 bp, Artificial Sequence
  Synthetic oligonucleotide
ttcgccggcataatcgtggccgctcacactctcca

SEQ ID NO: 201425 - DNA, 36 bp, Artificial Sequence
  Synthetic oligonucleotide
ttaccacttgccacctggttctgtcaatacttttca

SEQ ID NO: 201426 - DNA, 37 bp, Artificial Sequence
  Synthetic oligonucleotide
gtcatgaaaggacgggagggggacggccgctagaaga

SEQ ID NO: 201427 - DNA, 36 bp, Artificial Sequence
  Synthetic oligonucleotide
gatgggagcaggaagggatgcgagaaggctgggaga

SEQ ID NO: 201428 - DNA, 37 bp, Artificial Sequence
  Synthetic oligonucleotide
gcgcaaggcgcaataattgtagaggggggggcgacga

SEQ ID NO: 201429 - DNA, 36 bp, Artificial Sequence
  Synthetic oligonucleotide
gcaggccacgtagcctgttgcccctctccgccagga

SEQ ID NO: 201430 - DNA, 37 bp, Artificial Sequence
  Synthetic oligonucleotide
agcggtgtaagagggccatgagcaggggacgggcgga

SEQ ID NO: 201431 - DNA, 36 bp, Artificial Sequence
  Synthetic oligonucleotide
ggaggccggtaaatgggggaggaggaagcataggga

SEQ ID NO: 201432 - DNA, 36 bp, Artificial Sequence
  Synthetic oligonucleotide
gtgaggacgcatagggaacaaacggggtgaggtgga

SEQ ID NO: 201433 - DNA, 36 bp, Artificial Sequence
  Synthetic oligonucleotide
ggttccacgcggcggtgggaagggacgggagggtga

SEQ ID NO: 201434 - DNA, 38 bp, Artificial Sequence
  Synthetic oligonucleotide
tgtggttcgcatccgatgtttcctcgttccatctttga

SEQ ID NO: 201435 - DNA, 36 bp, Artificial Sequence
  Synthetic oligonucleotide
tcacagaggcacgctttccgccctgttcgtttccta

SEQ ID NO: 201436 - DNA, 36 bp, Artificial Sequence
  Synthetic oligonucleotide
tgatcgcacgatgtaccttgtcctgatcttctgcta

SEQ ID NO: 201437 - DNA, 35 bp, Artificial Sequence
  Synthetic oligonucleotide
ttcacccacgctattatactgatcgagacgatcac

SEQ ID NO: 201438 - DNA, 36 bp, Artificial Sequence
  Synthetic oligonucleotide
gacctgcgcccttggacttaagccgtttttattccc

SEQ ID NO: 201439 - DNA, 35 bp, Artificial Sequence
  Synthetic oligonucleotide
gcatgccgcacattgttttctcttgcctctcatgc

SEQ ID NO: 201440 - DNA, 35 bp, Artificial Sequence
  Synthetic oligonucleotide
aactgagcccacccatttgccgttacaaccttgtc

SEQ ID NO: 201441 - DNA, 35 bp, Artificial Sequence
  Synthetic oligonucleotide
tccgtgtgggtgcaggaatcgggggagggagtaag

SEQ ID NO: 201442 - DNA, 35 bp, Artificial Sequence
  Synthetic oligonucleotide
accacgcctaatcccccctttcgcacgttagccgg

SEQ ID NO: 201443 - DNA, 35 bp, Artificial Sequence
  Synthetic oligonucleotide
gacggaggggaacgaggggggaatggggacaaggg

SEQ ID NO: 201444 - DNA, 35 bp, Artificial Sequence
  Synthetic oligonucleotide
ttcacgccgtacggtcttaagattctctcttccat

SEQ ID NO: 201445 - DNA, 35 bp, Artificial Sequence
  Synthetic oligonucleotide
atgattgccgctgcttttgtccgtctcgcctcact

SEQ ID NO: 201446 - DNA, 35 bp, Artificial Sequence
  Synthetic oligonucleotide
tgatgccccaaattgtactgcccctatctgtccgt

SEQ ID NO: 201447 - DNA, 35 bp, Artificial Sequence
  Synthetic oligonucleotide
gactcatcagcgtgtcgccctttaccgtccttggt

SEQ ID NO: 201448 - DNA, 34 bp, Artificial Sequence
  Synthetic oligonucleotide
gacacccctcaccgtttatccccaggggatcctt

SEQ ID NO: 201449 - DNA, 35 bp, Artificial Sequence
  Synthetic oligonucleotide
actgaccccaacgctgccactatacgttctcattt

SEQ ID NO: 201450 - DNA, 36 bp, Artificial Sequence
  Synthetic oligonucleotide
gagggcggggaaggggagtctggctaatcagtcaaa

SEQ ID NO: 201451 - DNA, 36 bp, Artificial Sequence
  Synthetic oligonucleotide
tgaacctgctgggagggatgggagagagggcctaaa

SEQ ID NO: 201452 - DNA, 36 bp, Artificial Sequence
  Synthetic oligonucleotide
ggaaagggggagataaatgcaggggaccgaaaacaa

SEQ ID NO: 201453 - DNA, 34 bp, Artificial Sequence
  Synthetic oligonucleotide
taacaatgagggggggggcgacgggatatggcaa

SEQ ID NO: 201454 - DNA, 35 bp, Artificial Sequence
  Synthetic oligonucleotide
gatgcgagatagggggggatggataggtttaggaa

SEQ ID NO: 201455 - DNA, 35 bp, Artificial Sequence
  Synthetic oligonucleotide
ggaccctcccctgatgcgcttggctcacccctgaa

SEQ ID NO: 201456 - DNA, 35 bp, Artificial Sequence
  Synthetic oligonucleotide
gtgcgttcgcccccgttagtgatttcctcttgtaa

SEQ ID NO: 201457 - DNA, 36 bp, Artificial Sequence
  Synthetic oligonucleotide
agtgtagcaccagtctcgctccaagtcccgccgcca

SEQ ID NO: 201458 - DNA, 35 bp, Artificial Sequence
  Synthetic oligonucleotide
acaggggggacgtgcaagcgtggggagagagagca

SEQ ID NO: 201459 - DNA, 34 bp, Artificial Sequence
  Synthetic oligonucleotide
tgcatccatactgtctcatactaccggcttcgca

SEQ ID NO: 201460 - DNA, 36 bp, Artificial Sequence
  Synthetic oligonucleotide
aggaaagcagaggggaggagtaaggggtggcgtgca

SEQ ID NO: 201461 - DNA, 36 bp, Artificial Sequence
  Synthetic oligonucleotide
acgctagccctccactgttacatgcccaccgcctca

SEQ ID NO: 201462 - DNA, 36 bp, Artificial Sequence
  Synthetic oligonucleotide
ggaacgcaaaagtgggggagtgatgaacggaagaga

SEQ ID NO: 201463 - DNA, 37 bp, Artificial Sequence
  Synthetic oligonucleotide
aagtgagggggtggaggcacgggccaagtcagggaga

SEQ ID NO: 201464 - DNA, 37 bp, Artificial Sequence
  Synthetic oligonucleotide
agggagggagaagcgcgaggggtgggatactatccga

SEQ ID NO: 201465 - DNA, 37 bp, Artificial Sequence
  Synthetic oligonucleotide
ttgatgcacacgagtgggcgggaatacagggaaggga

SEQ ID NO: 201466 - DNA, 37 bp, Artificial Sequence
  Synthetic oligonucleotide
gaagtggagcagtcatgaggggcgggttgaagatgga

SEQ ID NO: 201467 - DNA, 38 bp, Artificial Sequence
  Synthetic oligonucleotide
gggcgggaggggcagggtgctaacataggtctggatga

SEQ ID NO: 201468 - DNA, 37 bp, Artificial Sequence
  Synthetic oligonucleotide
ggaccatccactctgtgttgcgaatccctccctatga

SEQ ID NO: 201469 - DNA, 37 bp, Artificial Sequence
  Synthetic oligonucleotide
gaaacgagtgtgacggagcaggcgggagggggtatga

SEQ ID NO: 201470 - DNA, 38 bp, Artificial Sequence
  Synthetic oligonucleotide
tgcacagtcgcaagccggtccttccttgtctctcgtga

SEQ ID NO: 201471 - DNA, 36 bp, Artificial Sequence
  Synthetic oligonucleotide
agtcaggaggaggggggtgtgctccggagagggtga

SEQ ID NO: 201472 - DNA, 37 bp, Artificial Sequence
  Synthetic oligonucleotide
ggatatcccaactagtgggcgggagaagggtgggtga

SEQ ID NO: 201473 - DNA, 37 bp, Artificial Sequence
  Synthetic oligonucleotide
taggtgcgggagtcgggagagcgaaggagggggttga

SEQ ID NO: 201474 - DNA, 36 bp, Artificial Sequence
  Synthetic oligonucleotide
tcctaccgaccacaaggataatgtctgccttcccta

SEQ ID NO: 201475 - DNA, 36 bp, Artificial Sequence
  Synthetic oligonucleotide
gaagggacatgggggaaggctgaacgatgtgtggta

SEQ ID NO: 201476 - DNA, 35 bp, Artificial Sequence
  Synthetic oligonucleotide
tctgggtgggctggggataagctgtgggccgagac

SEQ ID NO: 201477 - DNA, 35 bp, Artificial Sequence
  Synthetic oligonucleotide
gacggagaggtgggagggggacgtacaatagtgac

SEQ ID NO: 201478 - DNA, 35 bp, Artificial Sequence
  Synthetic oligonucleotide
acctcaaggcacatttgctttgctccacctttccc

SEQ ID NO: 201479 - DNA, 35 bp, Artificial Sequence
  Synthetic oligonucleotide
acgacctgtgcagtccgactattactgtgcccgcc

SEQ ID NO: 201480 - DNA, 35 bp, Artificial Sequence
  Synthetic oligonucleotide
gaagccccgttcgcctttaatgaccgctcacatcc

SEQ ID NO: 201481 - DNA, 34 bp, Artificial Sequence
  Synthetic oligonucleotide
ttccagccggtccttctcggcgccaacaggttcc

SEQ ID NO: 201482 - DNA, 35 bp, Artificial Sequence
  Synthetic oligonucleotide
tcattaacgcacttccgctcggacgccccccccgc

SEQ ID NO: 201483 - DNA, 35 bp, Artificial Sequence
  Synthetic oligonucleotide
aacacgcaagaaggggggaccatgatggggagtgc

SEQ ID NO: 201484 - DNA, 35 bp, Artificial Sequence
  Synthetic oligonucleotide
tacattgccgccggtgcttctcgctgtcacgtatc

SEQ ID NO: 201485 - DNA, 35 bp, Artificial Sequence
  Synthetic oligonucleotide
tgcacacccgtcgatagacccgttgaccctccctc

SEQ ID NO: 201486 - DNA, 35 bp, Artificial Sequence
  Synthetic oligonucleotide
tcgaagcacgcaagtcaaaccattcaccgttcctc

SEQ ID NO: 201487 - DNA, 35 bp, Artificial Sequence
  Synthetic oligonucleotide
tatccgcctactcccgcgttagacgacactttgtc

SEQ ID NO: 201488 - DNA, 35 bp, Artificial Sequence
  Synthetic oligonucleotide
ggggtggctatctactaccctcccttcccaccccg

SEQ ID NO: 201489 - DNA, 35 bp, Artificial Sequence
  Synthetic oligonucleotide
acatcgtcgcctttgtcactttctatcgtgctccg

SEQ ID NO: 201490 - DNA, 35 bp, Artificial Sequence
  Synthetic oligonucleotide
aaggggggatgtaggacgatagagggatggacgcg

SEQ ID NO: 201491 - DNA, 35 bp, Artificial Sequence
  Synthetic oligonucleotide
gcgattcgtcagggaccgtttctacccatatcctg

SEQ ID NO: 201492 - DNA, 34 bp, Artificial Sequence
  Synthetic oligonucleotide
gtcaacgccggtttcgccttatttcgcgtctcat

SEQ ID NO: 201493 - DNA, 35 bp, Artificial Sequence
  Synthetic oligonucleotide
gagttggagagggggttataggaacagggggtgat

SEQ ID NO: 201494 - DNA, 35 bp, Artificial Sequence
  Synthetic oligonucleotide
gcctggcctctcctgccgctagtacctctagtact

SEQ ID NO: 201495 - DNA, 35 bp, Artificial Sequence
  Synthetic oligonucleotide
ggtcgctgccccattgtcccactgttacgctctct

SEQ ID NO: 201496 - DNA, 35 bp, Artificial Sequence
  Synthetic oligonucleotide
atcgccacgtcccctgccgtaccagaccatctctt

SEQ ID NO: 201497 - DNA, 35 bp, Artificial Sequence
  Synthetic oligonucleotide
tccactccacgatttggtatcccccgccacccgtt

SEQ ID NO: 201498 - DNA, 36 bp, Artificial Sequence
  Synthetic oligonucleotide
tacgttgggagggtgctgtgactgtagggtgggaaa

SEQ ID NO: 201499 - DNA, 36 bp, Artificial Sequence
  Synthetic oligonucleotide
tcagtatgcccagcgtgatcatgatccctccctaaa

SEQ ID NO: 201500 - DNA, 35 bp, Artificial Sequence
  Synthetic oligonucleotide
ggggacaaagctgggtggggttcttcctcggggaa

SEQ ID NO: 201501 - DNA, 36 bp, Artificial Sequence
  Synthetic oligonucleotide
tcaagagcgcccccatttctatcgtccaggcccgca

SEQ ID NO: 201502 - DNA, 29 bp, Artificial Sequence
  Synthetic oligonucleotide
ttgcgccctcaccctttcgcccttactca

SEQ ID NO: 201503 - DNA, 36 bp, Artificial Sequence
  Synthetic oligonucleotide
aacctcgcctcgtcctacctgtcccgacccatgtca

SEQ ID NO: 201504 - DNA, 35 bp, Artificial Sequence
  Synthetic oligonucleotide
gatgatgcggtccacatgttctattccatctgtca

SEQ ID NO: 201505 - DNA, 35 bp, Artificial Sequence
  Synthetic oligonucleotide
tcgcacttccatcacgtctatccttcgcctgttca

SEQ ID NO: 201506 - DNA, 36 bp, Artificial Sequence
  Synthetic oligonucleotide
gtgccacgctatgtatggccgcctcctcctcccaga

SEQ ID NO: 201507 - DNA, 37 bp, Artificial Sequence
  Synthetic oligonucleotide
aaccccatcacatgtcctttcaggaaactcgctacga

SEQ ID NO: 201508 - DNA, 36 bp, Artificial Sequence
  Synthetic oligonucleotide
aaggttcagggaggggaacaagcagagagggggcga

SEQ ID NO: 201509 - DNA, 37 bp, Artificial Sequence
  Synthetic oligonucleotide
agttgggggggcagaactaaacgggaggcaggatcga

SEQ ID NO: 201510 - DNA, 35 bp, Artificial Sequence
  Synthetic oligonucleotide
gagggatacacgatgggtgatgggacgggctggga

SEQ ID NO: 201511 - DNA, 37 bp, Artificial Sequence
  Synthetic oligonucleotide
aacgactcagaagggtggattgctaggggaacgtgga

SEQ ID NO: 201512 - DNA, 37 bp, Artificial Sequence
  Synthetic oligonucleotide
tcatcgccgccctcttaccatgagcgtcgtacactga

SEQ ID NO: 201513 - DNA, 37 bp, Artificial Sequence
  Synthetic oligonucleotide
tgagcgctgctgactatcttgcatcgttccaccctga

SEQ ID NO: 201514 - DNA, 38 bp, Artificial Sequence
  Synthetic oligonucleotide
gccccctaaaaacccgaccgtcttgaacagtctggtga

SEQ ID NO: 201515 - DNA, 37 bp, Artificial Sequence
  Synthetic oligonucleotide
gtagaacgcagatctcgtttcacctctctatctgtga

SEQ ID NO: 201516 - DNA, 38 bp, Artificial Sequence
  Synthetic oligonucleotide
aacgaagaggacggggtgaggttagcggataatattga

SEQ ID NO: 201517 - DNA, 38 bp, Artificial Sequence
  Synthetic oligonucleotide
ggagatcgacggaggacgggcaacagggggggacttga

SEQ ID NO: 201518 - DNA, 37 bp, Artificial Sequence
  Synthetic oligonucleotide
gcagaccgccgccgtgttgctactcattcaaccttga

SEQ ID NO: 201519 - DNA, 35 bp, Artificial Sequence
  Synthetic oligonucleotide
atcgcaagccaccccgcatttgggcatttccttta

SEQ ID NO: 201520 - DNA, 36 bp, Artificial Sequence
  Synthetic oligonucleotide
tgcaaaggccagacgtactgtcctatctctggttta

SEQ ID NO: 201521 - DNA, 35 bp, Artificial Sequence
  Synthetic oligonucleotide
tagtacgcgctcgctgtccgttacccgtgctatac

SEQ ID NO: 201522 - DNA, 35 bp, Artificial Sequence
  Synthetic oligonucleotide
ttcacgataagtgatcgctccatcgtgctttcacc

SEQ ID NO: 201523 - DNA, 35 bp, Artificial Sequence
  Synthetic oligonucleotide
acacccccaatgttcccttatagccgtgcgtaccc

SEQ ID NO: 201524 - DNA, 35 bp, Artificial Sequence
  Synthetic oligonucleotide
tcatcggtctcacgctcctcgacatgcatttaccc

SEQ ID NO: 201525 - DNA, 35 bp, Artificial Sequence
  Synthetic oligonucleotide
atccgccttcaccaccgccccctagcatagatcgc

SEQ ID NO: 201526 - DNA, 35 bp, Artificial Sequence
  Synthetic oligonucleotide
gtcataagtccgtgctttaacatcacacctctcgc

SEQ ID NO: 201527 - DNA, 35 bp, Artificial Sequence
  Synthetic oligonucleotide
tggtccctcctccggtatcagttactcttcacggc

SEQ ID NO: 201528 - DNA, 35 bp, Artificial Sequence
  Synthetic oligonucleotide
gagcccgcccccatgactctgttgtaacactcctc

SEQ ID NO: 201529 - DNA, 35 bp, Artificial Sequence
  Synthetic oligonucleotide
tccagaccgccccacgtgtacacttttttcccttc

SEQ ID NO: 201530 - DNA, 35 bp, Artificial Sequence
  Synthetic oligonucleotide
gacatcgcgtcttccgcattatggtcgtcctgttc

SEQ ID NO: 201531 - DNA, 35 bp, Artificial Sequence
  Synthetic oligonucleotide
gagagacggtgtgtgaggggcatgtgatgtgggag

SEQ ID NO: 201532 - DNA, 35 bp, Artificial Sequence
  Synthetic oligonucleotide
tcccacagccccatctttgcatatgccctgccacg

SEQ ID NO: 201533 - DNA, 35 bp, Artificial Sequence
  Synthetic oligonucleotide
tgaccatgctcgttgtcttcgaatcgccccacccg

SEQ ID NO: 201534 - DNA, 35 bp, Artificial Sequence
  Synthetic oligonucleotide
gctgaggggcatcacttgttggggagacgggtggg

SEQ ID NO: 201535 - DNA, 35 bp, Artificial Sequence
  Synthetic oligonucleotide
gacgcactgtgtcattttacgcgccctcctttatg

SEQ ID NO: 201536 - DNA, 35 bp, Artificial Sequence
  Synthetic oligonucleotide
gatggcctcttctccacgtaccacccgttacagtg

SEQ ID NO: 201537 - DNA, 35 bp, Artificial Sequence
  Synthetic oligonucleotide
tccgccgcctcaatgcgctcttccgtgtgcccttg

SEQ ID NO: 201538 - DNA, 35 bp, Artificial Sequence
  Synthetic oligonucleotide
gtccgcatctgactatatctcgtcatcactcgcct

SEQ ID NO: 201539 - DNA, 35 bp, Artificial Sequence
  Synthetic oligonucleotide
ggacaacgttgagatctttttgtcacatccccgct

SEQ ID NO: 201540 - DNA, 35 bp, Artificial Sequence
  Synthetic oligonucleotide
tgccagcacgcgctctgcatctcatccccgcttgt

SEQ ID NO: 201541 - DNA, 35 bp, Artificial Sequence
  Synthetic oligonucleotide
gaaacgtacgtgtgggccgccactccgactccatt

SEQ ID NO: 201542 - DNA, 35 bp, Artificial Sequence
  Synthetic oligonucleotide
gctgtcccgtgcctgtaacacctctcgcctggctt

SEQ ID NO: 201543 - DNA, 35 bp, Artificial Sequence
  Synthetic oligonucleotide
tagcccaggtcattacgtttacgcctcgttctttt

SEQ ID NO: 201544 - DNA, 36 bp, Artificial Sequence
  Synthetic oligonucleotide
ggtgggaggggtgggggggaaaataggctggataaa

SEQ ID NO: 201545 - DNA, 35 bp, Artificial Sequence
  Synthetic oligonucleotide
gtatcaccctcccgtaactcgacagttgtctaaca

SEQ ID NO: 201546 - DNA, 36 bp, Artificial Sequence
  Synthetic oligonucleotide
gtgccctctacacgtagtattgccccacgcctccca

SEQ ID NO: 201547 - DNA, 35 bp, Artificial Sequence
  Synthetic oligonucleotide
gaggatcagacatcatagtcgttaagcccccgcca

SEQ ID NO: 201548 - DNA, 36 bp, Artificial Sequence
  Synthetic oligonucleotide
gatcactccctctgttgccatccagatacggctgca

SEQ ID NO: 201549 - DNA, 36 bp, Artificial Sequence
  Synthetic oligonucleotide
tactcactccctgcctgtattatttgccacttctca

SEQ ID NO: 201550 - DNA, 35 bp, Artificial Sequence
  Synthetic oligonucleotide
tcaactcccgcctgttggccattgctccggtttca

SEQ ID NO: 201551 - DNA, 37 bp, Artificial Sequence
  Synthetic oligonucleotide
gagccagtgaagatgggtggggcagggggctcgtaga

SEQ ID NO: 201552 - DNA, 37 bp, Artificial Sequence
  Synthetic oligonucleotide
acaggacgggtctggtgcggggtggggcatatcagga

SEQ ID NO: 201553 - DNA, 37 bp, Artificial Sequence
  Synthetic oligonucleotide
ttcgcaccatctcatgccaccattttgtcgtctagga

SEQ ID NO: 201554 - DNA, 36 bp, Artificial Sequence
  Synthetic oligonucleotide
gtggaggtttagtgaatgggggaaaggtggagggga

SEQ ID NO: 201555 - DNA, 37 bp, Artificial Sequence
  Synthetic oligonucleotide
agagacagaggactgcggcgaaatcagaggatgggga

SEQ ID NO: 201556 - DNA, 38 bp, Artificial Sequence
  Synthetic oligonucleotide
gtcacagggcggacgagggaaagggggagatgggatga

SEQ ID NO: 201557 - DNA, 35 bp, Artificial Sequence
  Synthetic oligonucleotide
tgtgcacgcccagtctcctccgctatgacctatga

SEQ ID NO: 201558 - DNA, 35 bp, Artificial Sequence
  Synthetic oligonucleotide
acaggcgccaagaccgcgcttaccatccatcctga

SEQ ID NO: 201559 - DNA, 37 bp, Artificial Sequence
  Synthetic oligonucleotide
tcgaatggtcgggaactgaggggaaggggtacggtga

SEQ ID NO: 201560 - DNA, 38 bp, Artificial Sequence
  Synthetic oligonucleotide
gaggacggtgcggagtgatgggcgtccgggcggggtga

SEQ ID NO: 201561 - DNA, 38 bp, Artificial Sequence
  Synthetic oligonucleotide
attgtccgagcgcccttgtacctatctccctatggtga

SEQ ID NO: 201562 - DNA, 38 bp, Artificial Sequence
  Synthetic oligonucleotide
ttcgtaacgccgtatgccccccctcgacgcctacttga

SEQ ID NO: 201563 - DNA, 38 bp, Artificial Sequence
  Synthetic oligonucleotide
agagtgcgcacaatcgttttctaatttcgccaccttga

SEQ ID NO: 201564 - DNA, 36 bp, Artificial Sequence
  Synthetic oligonucleotide
gagcggggggggatagatcagggagaagagccaata

SEQ ID NO: 201565 - DNA, 36 bp, Artificial Sequence
  Synthetic oligonucleotide
ggggggacgaaggcggataggaaggtcagcaggata

SEQ ID NO: 201566 - DNA, 36 bp, Artificial Sequence
  Synthetic oligonucleotide
gacaacgctcgcttgttatctttccatctatgtcta

SEQ ID NO: 201567 - DNA, 36 bp, Artificial Sequence
  Synthetic oligonucleotide
aactcccactacctgccattcgagcctcggtactta

SEQ ID NO: 201568 - DNA, 34 bp, Artificial Sequence
  Synthetic oligonucleotide
aacagaaactgctgtgtctgccccccatctgcac

SEQ ID NO: 201569 - DNA, 35 bp, Artificial Sequence
  Synthetic oligonucleotide
gaggggcggtaacggggaaagaagggggttgctac

SEQ ID NO: 201570 - DNA, 35 bp, Artificial Sequence
  Synthetic oligonucleotide
tctggtcccatggctaatcgatcctgctgatctac

SEQ ID NO: 201571 - DNA, 35 bp, Artificial Sequence
  Synthetic oligonucleotide
aatctacgtgccctgggtctcgcgcctgccatgcc

SEQ ID NO: 201572 - DNA, 35 bp, Artificial Sequence
  Synthetic oligonucleotide
agcaccctcgatatctagcgcattctagccttgcc

SEQ ID NO: 201573 - DNA, 35 bp, Artificial Sequence
  Synthetic oligonucleotide
tcagcgaagcctctgcaacactatagctcctgtcc

SEQ ID NO: 201574 - DNA, 35 bp, Artificial Sequence
  Synthetic oligonucleotide
tccatgcggctcacttatgttttccactcgattcc

SEQ ID NO: 201575 - DNA, 34 bp, Artificial Sequence
  Synthetic oligonucleotide
tgcctggtcggtcctgttgctcctcagtccttcc

SEQ ID NO: 201576 - DNA, 35 bp, Artificial Sequence
  Synthetic oligonucleotide
gtgcgacgcgggatctttaatgcatcatccccatc

SEQ ID NO: 201577 - DNA, 35 bp, Artificial Sequence
  Synthetic oligonucleotide
atgagccacgctcccattgagaccgctcacctatc

SEQ ID NO: 201578 - DNA, 35 bp, Artificial Sequence
  Synthetic oligonucleotide
tatccacgtccgccatcaccagacatctgcctgtc

SEQ ID NO: 201579 - DNA, 34 bp, Artificial Sequence
  Synthetic oligonucleotide
tacgcctcaccgccttcgactctaatggagtgtc

SEQ ID NO: 201580 - DNA, 35 bp, Artificial Sequence
  Synthetic oligonucleotide
gtgctacagcacagccggctaacctactcgcattc

SEQ ID NO: 201581 - DNA, 35 bp, Artificial Sequence
  Synthetic oligonucleotide
acacaggggcgggacgggatggaaaacgatataag

SEQ ID NO: 201582 - DNA, 35 bp, Artificial Sequence
  Synthetic oligonucleotide
gtgccaccgcccctgtatgaccgagttagatgcag

SEQ ID NO: 201583 - DNA, 35 bp, Artificial Sequence
  Synthetic oligonucleotide
accatgctcgcaccacatttgccccgtacgctacg

SEQ ID NO: 201584 - DNA, 35 bp, Artificial Sequence
  Synthetic oligonucleotide
gtcacacgtccattagctctggttgcccctctccg

SEQ ID NO: 201585 - DNA, 35 bp, Artificial Sequence
  Synthetic oligonucleotide
ggagccagtgtgcttggtccaccattacttgtccg

SEQ ID NO: 201586 - DNA, 36 bp, Artificial Sequence
  Synthetic oligonucleotide
gtcaccacgctcagcagatacgtgtctaatctggtg

SEQ ID NO: 201587 - DNA, 35 bp, Artificial Sequence
  Synthetic oligonucleotide
gtggtgggcagggcggggtctgtatggacgcattg

SEQ ID NO: 201588 - DNA, 35 bp, Artificial Sequence
  Synthetic oligonucleotide
gctgaccgcgtccacatgcattttcgtcctgtcat

SEQ ID NO: 201589 - DNA, 35 bp, Artificial Sequence
  Synthetic oligonucleotide
gcgaacacgacgacgactttattgcggtttcccct

SEQ ID NO: 201590 - DNA, 35 bp, Artificial Sequence
  Synthetic oligonucleotide
gacggacgccacgtgagcatatttaccatccttct

SEQ ID NO: 201591 - DNA, 35 bp, Artificial Sequence
  Synthetic oligonucleotide
gccctccatccgtttctcgtagaactataaaagtt

SEQ ID NO: 201592 - DNA, 35 bp, Artificial Sequence
  Synthetic oligonucleotide
tgactccgcacctcaacgtggcttcggtacccttt

SEQ ID NO: 201593 - DNA, 35 bp, Artificial Sequence
  Synthetic oligonucleotide
gacacaaccgtttcatcgctccccgaagtttcttt

SEQ ID NO: 201594 - DNA, 35 bp, Artificial Sequence
  Synthetic oligonucleotide
acacggggtcaagtactgaaggggaggtgtggcaa

SEQ ID NO: 201595 - DNA, 36 bp, Artificial Sequence
  Synthetic oligonucleotide
tccactgcgacgcatctgatcatcgcccctctctaa

SEQ ID NO: 201596 - DNA, 34 bp, Artificial Sequence
  Synthetic oligonucleotide
ttccaccgtactctatgtgttcgtcccggcccca

SEQ ID NO: 201597 - DNA, 36 bp, Artificial Sequence
  Synthetic oligonucleotide
tctgtgcccagcgctccttacctattgggcttccca

SEQ ID NO: 201598 - DNA, 35 bp, Artificial Sequence
  Synthetic oligonucleotide
gtcacctgccccttcggtttagaaccactcgctca

SEQ ID NO: 201599 - DNA, 27 bp, Artificial Sequence
  Synthetic oligonucleotide
tgaacaccaggtgtcccacgcccttca

SEQ ID NO: 201600 - DNA, 36 bp, Artificial Sequence
  Synthetic oligonucleotide
gtcacgaccactggttctcgagtcactccgtcttca

SEQ ID NO: 201601 - DNA, 36 bp, Artificial Sequence
  Synthetic oligonucleotide
gctaggtggcacaagcgggaaaaaatggggggaaga

SEQ ID NO: 201602 - DNA, 35 bp, Artificial Sequence
  Synthetic oligonucleotide
atcctgcgcccatgtccctttcatgaccatcacga

SEQ ID NO: 201603 - DNA, 37 bp, Artificial Sequence
  Synthetic oligonucleotide
acgtccaccggcagctccgacttacattaccggccga

SEQ ID NO: 201604 - DNA, 37 bp, Artificial Sequence
  Synthetic oligonucleotide
tggatcgcgggagagggctggggggctgaatgcagga

SEQ ID NO: 201605 - DNA, 37 bp, Artificial Sequence
  Synthetic oligonucleotide
agcactcagccgcccgccttgtctccgtaatcacgga

SEQ ID NO: 201606 - DNA, 37 bp, Artificial Sequence
  Synthetic oligonucleotide
agtacactgggaggggcgtataaggggtcctcgggga

SEQ ID NO: 201607 - DNA, 34 bp, Artificial Sequence
  Synthetic oligonucleotide
gagtgagacatgggagggcgttttgggaggggga

SEQ ID NO: 201608 - DNA, 37 bp, Artificial Sequence
  Synthetic oligonucleotide
tggtagggaggaggagaactcaagcacggacggggga

SEQ ID NO: 201609 - DNA, 38 bp, Artificial Sequence
  Synthetic oligonucleotide
tgtaccgtcgcctctgccgccccctctcacgtaaatga

SEQ ID NO: 201610 - DNA, 38 bp, Artificial Sequence
  Synthetic oligonucleotide
ttgtgcgcctcagcacggcaccatactcttgttcctga

SEQ ID NO: 201611 - DNA, 38 bp, Artificial Sequence
  Synthetic oligonucleotide
gtctgggcagggatacatgtgaatgggaggggatctga

SEQ ID NO: 201612 - DNA, 38 bp, Artificial Sequence
  Synthetic oligonucleotide
gacacggcacaatgcgtacccttgctttcactctctga

SEQ ID NO: 201613 - DNA, 38 bp, Artificial Sequence
  Synthetic oligonucleotide
ttgtgggaacaggaagggggaagagtaggacgaattga

SEQ ID NO: 201614 - DNA, 38 bp, Artificial Sequence
  Synthetic oligonucleotide
gactcacagaggtgtgctcatcccccgcctttttttga

SEQ ID NO: 201615 - DNA, 36 bp, Artificial Sequence
  Synthetic oligonucleotide
tccgtcatccgcggtgacgcctttgccatactttta

SEQ ID NO: 201616 - DNA, 35 bp, Artificial Sequence
  Synthetic oligonucleotide
gacgctgtcgcccgaaacccccctggtcttgctac

SEQ ID NO: 201617 - DNA, 35 bp, Artificial Sequence
  Synthetic oligonucleotide
tccaacatcagccgggtacctttctcgcctcaccc

SEQ ID NO: 201618 - DNA, 35 bp, Artificial Sequence
  Synthetic oligonucleotide
aactcccgctccatgtgtctcccagcccctctgcc

SEQ ID NO: 201619 - DNA, 35 bp, Artificial Sequence
  Synthetic oligonucleotide
acatcagccgttaatgtcgcctcatacctctccgc

SEQ ID NO: 201620 - DNA, 35 bp, Artificial Sequence
  Synthetic oligonucleotide
gccattcgcacgtgtaacacccggtgtggtgcctc

SEQ ID NO: 201621 - DNA, 35 bp, Artificial Sequence
  Synthetic oligonucleotide
gtcccgccacttaggtttctgtccggctcctcctc

SEQ ID NO: 201622 - DNA, 35 bp, Artificial Sequence
  Synthetic oligonucleotide
gttgtgtcgctcgcccctttgcctctgccttcgtc

SEQ ID NO: 201623 - DNA, 35 bp, Artificial Sequence
  Synthetic oligonucleotide
gaagggcacacgctctcgagtaatcatttcctgtc

SEQ ID NO: 201624 - DNA, 35 bp, Artificial Sequence
  Synthetic oligonucleotide
atgatccgcagatctgggtccgttgttctgctgtc

SEQ ID NO: 201625 - DNA, 35 bp, Artificial Sequence
  Synthetic oligonucleotide
gtccgctcacagtgcgttgttactcccacgtgttc

SEQ ID NO: 201626 - DNA, 35 bp, Artificial Sequence
  Synthetic oligonucleotide
agatgggcgggtcgggggatgggtatattccgcag

SEQ ID NO: 201627 - DNA, 35 bp, Artificial Sequence
  Synthetic oligonucleotide
gaccttgccacttctgccatttgcgatattacacg

SEQ ID NO: 201628 - DNA, 35 bp, Artificial Sequence
  Synthetic oligonucleotide
aaccaccatcaaaggatctcttgcgaatctgcccg

SEQ ID NO: 201629 - DNA, 35 bp, Artificial Sequence
  Synthetic oligonucleotide
tctaacatgccgttggtatcgctccctcatctccg

SEQ ID NO: 201630 - DNA, 35 bp, Artificial Sequence
  Synthetic oligonucleotide
gacaacaacacaagggcactgtggacggggaggcg

SEQ ID NO: 201631 - DNA, 35 bp, Artificial Sequence
  Synthetic oligonucleotide
gtcccaccgcactaatgtttccttcgcccttttcg

SEQ ID NO: 201632 - DNA, 35 bp, Artificial Sequence
  Synthetic oligonucleotide
actatcagcccgctgctgttcgtccccttcaatgg

SEQ ID NO: 201633 - DNA, 35 bp, Artificial Sequence
  Synthetic oligonucleotide
atgtactgccgaccgttatgcttttttggtccttg

SEQ ID NO: 201634 - DNA, 35 bp, Artificial Sequence
  Synthetic oligonucleotide
tcaccgccaatcgtcacttagttcctggctaacct

SEQ ID NO: 201635 - DNA, 35 bp, Artificial Sequence
  Synthetic oligonucleotide
gtcgttcctccccccgtgataattccgatgtccct

SEQ ID NO: 201636 - DNA, 35 bp, Artificial Sequence
  Synthetic oligonucleotide
ttcgggcgctacttccgcgttgcctcgccacatct

SEQ ID NO: 201637 - DNA, 35 bp, Artificial Sequence
  Synthetic oligonucleotide
gtcaacctcgcgagtgcctacatttacaaacctct

SEQ ID NO: 201638 - DNA, 34 bp, Artificial Sequence
  Synthetic oligonucleotide
tgagccacgtacaacgtttacctcttatgccagt

SEQ ID NO: 201639 - DNA, 35 bp, Artificial Sequence
  Synthetic oligonucleotide
atcacgacagtgtaccccccgccttgtattacggt

SEQ ID NO: 201640 - DNA, 34 bp, Artificial Sequence
  Synthetic oligonucleotide
atgttgtgccgcctccttcttgccgcgatacctt

SEQ ID NO: 201641 - DNA, 35 bp, Artificial Sequence
  Synthetic oligonucleotide
gccccaccagtacctctgggtatgtatgttccttt

SEQ ID NO: 201642 - DNA, 36 bp, Artificial Sequence
  Synthetic oligonucleotide
ttccgcccaccctttgccagagacaactccaagtaa

SEQ ID NO: 201643 - DNA, 36 bp, Artificial Sequence
  Synthetic oligonucleotide
tgaccccttatgcattcttcgacctggtatttacca

SEQ ID NO: 201644 - DNA, 36 bp, Artificial Sequence
  Synthetic oligonucleotide
gtaatcatccagctgtgcgttttgtcctgtccccca

SEQ ID NO: 201645 - DNA, 36 bp, Artificial Sequence
  Synthetic oligonucleotide
gcccgctccaccaggggcatcagttcagccttccca

SEQ ID NO: 201646 - DNA, 35 bp, Artificial Sequence
  Synthetic oligonucleotide
tattgccccgaccgttcctgattcttgccctgcca

SEQ ID NO: 201647 - DNA, 35 bp, Artificial Sequence
  Synthetic oligonucleotide
tgcattgccagcctacctgccccttgtatgttcca

SEQ ID NO: 201648 - DNA, 36 bp, Artificial Sequence
  Synthetic oligonucleotide
aagggggagcgccggggagggataattcggggatca

SEQ ID NO: 201649 - DNA, 35 bp, Artificial Sequence
  Synthetic oligonucleotide
gtgcgggaacaagggtagggagttgggcattatca

SEQ ID NO: 201650 - DNA, 36 bp, Artificial Sequence
  Synthetic oligonucleotide
actgcctgccccaggtttcgtctcctaacggcctca

SEQ ID NO: 201651 - DNA, 35 bp, Artificial Sequence
  Synthetic oligonucleotide
gagccccgaacagcgcgtactggtggcccccttca

SEQ ID NO: 201652 - DNA, 37 bp, Artificial Sequence
  Synthetic oligonucleotide
gcgaacgctgtaggaacggaaaatatgggggggcaga

SEQ ID NO: 201653 - DNA, 37 bp, Artificial Sequence
  Synthetic oligonucleotide
ttcgctccatctgcgatcagcctctctgttggcccga

SEQ ID NO: 201654 - DNA, 37 bp, Artificial Sequence
  Synthetic oligonucleotide
gatggtgtgacgggaaaggcgataggacgtgggcgga

SEQ ID NO: 201655 - DNA, 37 bp, Artificial Sequence
  Synthetic oligonucleotide
ttaaaagcagggtgggagggctcgagcgacgacggga

SEQ ID NO: 201656 - DNA, 37 bp, Artificial Sequence
  Synthetic oligonucleotide
gtgaccgccacaggtactctcgtaacaccatacatga

SEQ ID NO: 201657 - DNA, 37 bp, Artificial Sequence
  Synthetic oligonucleotide
gacagagcaggggaggaaggatgcattggaggactga

SEQ ID NO: 201658 - DNA, 38 bp, Artificial Sequence
  Synthetic oligonucleotide
gcccgacgcgccggactccaatcaccgcccttccctga

SEQ ID NO: 201659 - DNA, 37 bp, Artificial Sequence
  Synthetic oligonucleotide
tacgagaccagggtagataggacgaggatgatcgtga

SEQ ID NO: 201660 - DNA, 38 bp, Artificial Sequence
  Synthetic oligonucleotide
tgaagcagggcgtggaagggggaatgtgagtggggtga

SEQ ID NO: 201661 - DNA, 38 bp, Artificial Sequence
  Synthetic oligonucleotide
gcaatgtggcagtcagggaaggggccgggagaatgtga

SEQ ID NO: 201662 - DNA, 36 bp, Artificial Sequence
  Synthetic oligonucleotide
gtgtcatcatccggcttgtagataacgctcccacta

SEQ ID NO: 201663 - DNA, 36 bp, Artificial Sequence
  Synthetic oligonucleotide
tcgctccgccgacgccttaccggcccaaccttgcta

SEQ ID NO: 201664 - DNA, 36 bp, Artificial Sequence
  Synthetic oligonucleotide
tgccgacgcccttgctatgccgcgatacccctagta

SEQ ID NO: 201665 - DNA, 34 bp, Artificial Sequence
  Synthetic oligonucleotide
gattgcccaactcgtaagtatcttcgtcccttta

SEQ ID NO: 201666 - DNA, 35 bp, Artificial Sequence
  Synthetic oligonucleotide
tagtaacaccgcccatagtttagacttagcctcac

SEQ ID NO: 201667 - DNA, 35 bp, Artificial Sequence
  Synthetic oligonucleotide
aagctcgatgcagtggtcatgtccagtcgctcccc

SEQ ID NO: 201668 - DNA, 32 bp, Artificial Sequence
  Synthetic oligonucleotide
gggacaccgccccaacccctcgaggactatcc

SEQ ID NO: 201669 - DNA, 35 bp, Artificial Sequence
  Synthetic oligonucleotide
tttgaggtcagatctgtgcccgtttaatcgcctcc

SEQ ID NO: 201670 - DNA, 35 bp, Artificial Sequence
  Synthetic oligonucleotide
actacctccggactcgttgctttatagaccctcgc

SEQ ID NO: 201671 - DNA, 35 bp, Artificial Sequence
  Synthetic oligonucleotide
ttgccaaccctagctcctgccatacactttgagtc

SEQ ID NO: 201672 - DNA, 35 bp, Artificial Sequence
  Synthetic oligonucleotide
tgcatgcctcagcttctctcgccctgccttctgtc

SEQ ID NO: 201673 - DNA, 35 bp, Artificial Sequence
  Synthetic oligonucleotide
acccccaccggcattcctttaacgaccgacgcttc

SEQ ID NO: 201674 - DNA, 35 bp, Artificial Sequence
  Synthetic oligonucleotide
gtgttgccccactggtctcctttcactgattcttc

SEQ ID NO: 201675 - DNA, 35 bp, Artificial Sequence
  Synthetic oligonucleotide
gactgccacccccctgccatacgtcccggccacag

SEQ ID NO: 201676 - DNA, 35 bp, Artificial Sequence
  Synthetic oligonucleotide
gtgaaccgggaaggaagttgagtggggtcggcccg

SEQ ID NO: 201677 - DNA, 35 bp, Artificial Sequence
  Synthetic oligonucleotide
aagacaagggcgtggcgggtcgatgggacgggtgg

SEQ ID NO: 201678 - DNA, 35 bp, Artificial Sequence
  Synthetic oligonucleotide
gggtcaactgactgggtgggctaggatccggggat

SEQ ID NO: 201679 - DNA, 35 bp, Artificial Sequence
  Synthetic oligonucleotide
tcacgaacagctaccatttttgtgccacgcaacct

SEQ ID NO: 201680 - DNA, 35 bp, Artificial Sequence
  Synthetic oligonucleotide
gatccgtcgggcccgagtcgagcgccttccaccct

SEQ ID NO: 201681 - DNA, 35 bp, Artificial Sequence
  Synthetic oligonucleotide
gaccgacacaccatctgaataatgaactccccgct

SEQ ID NO: 201682 - DNA, 35 bp, Artificial Sequence
  Synthetic oligonucleotide
tgtgatcagtccgtggccgttgttccgctctttct

SEQ ID NO: 201683 - DNA, 35 bp, Artificial Sequence
  Synthetic oligonucleotide
tgcatgtgcggatgtacctgatcgtcgccacctgt

SEQ ID NO: 201684 - DNA, 35 bp, Artificial Sequence
  Synthetic oligonucleotide
actgaactgtcctctgtctttggtgtcccgcaatt

SEQ ID NO: 201685 - DNA, 35 bp, Artificial Sequence
  Synthetic oligonucleotide
ttgagcacgttccttacctgttacatcggttaatt

SEQ ID NO: 201686 - DNA, 35 bp, Artificial Sequence
  Synthetic oligonucleotide
gaggtggcaccctgatatttttcgcgccatccgtt

SEQ ID NO: 201687 - DNA, 35 bp, Artificial Sequence
  Synthetic oligonucleotide
tgaacgcagccctcggtctccttgtctctagcttt

SEQ ID NO: 201688 - DNA, 36 bp, Artificial Sequence
  Synthetic oligonucleotide
ttcgacgcaagcccttgtatttctatctgctcccaa

SEQ ID NO: 201689 - DNA, 36 bp, Artificial Sequence
  Synthetic oligonucleotide
acctgccgaacgtcccgattgctcagctcctccaca

SEQ ID NO: 201690 - DNA, 35 bp, Artificial Sequence
  Synthetic oligonucleotide
acgtctctcccgccgatattttacggtacatgcca

SEQ ID NO: 201691 - DNA, 36 bp, Artificial Sequence
  Synthetic oligonucleotide
ggtaatgggggaaggcgggaagagatctgtgaagca

SEQ ID NO: 201692 - DNA, 36 bp, Artificial Sequence
  Synthetic oligonucleotide
atccatcgaatcacctgtttctcgtcgccagtttca

SEQ ID NO: 201693 - DNA, 37 bp, Artificial Sequence
  Synthetic oligonucleotide
ttggggccggtaggaggagttggggaagagctacaga

SEQ ID NO: 201694 - DNA, 37 bp, Artificial Sequence
  Synthetic oligonucleotide
gtgtgcgcccatctttcgtcttttcgtagacctacga

SEQ ID NO: 201695 - DNA, 37 bp, Artificial Sequence
  Synthetic oligonucleotide
atgtccgccctggttcccattggtttcgttctcccga

SEQ ID NO: 201696 - DNA, 36 bp, Artificial Sequence
  Synthetic oligonucleotide
ggtaacggggaggagggcggcatgagcgttcgggga

SEQ ID NO: 201697 - DNA, 38 bp, Artificial Sequence
  Synthetic oligonucleotide
aacgaagtggggaggaaatgcatagggtgggtcaatga

SEQ ID NO: 201698 - DNA, 38 bp, Artificial Sequence
  Synthetic oligonucleotide
gcaaggtcaatgtgtttcgccctatcactccatcatga

SEQ ID NO: 201699 - DNA, 38 bp, Artificial Sequence
  Synthetic oligonucleotide
tgagggcggagggaggggagtggatttggacggtatga

SEQ ID NO: 201700 - DNA, 38 bp, Artificial Sequence
  Synthetic oligonucleotide
atgcccgcccccgaaaatgtctgatccacttgcagtga

SEQ ID NO: 201701 - DNA, 36 bp, Artificial Sequence
  Synthetic oligonucleotide
tcagccacttctgaccctgtctgctcgtacgccgta

SEQ ID NO: 201702 - DNA, 36 bp, Artificial Sequence
  Synthetic oligonucleotide
tgtggtgctatctattgcggtagctgccttctttta

SEQ ID NO: 201703 - DNA, 35 bp, Artificial Sequence
  Synthetic oligonucleotide
gcccacgtgggaactgcatacctgggcaccttaac

SEQ ID NO: 201704 - DNA, 35 bp, Artificial Sequence
  Synthetic oligonucleotide
gatgtgtgccacttgttatgcggtcaatttaccac

SEQ ID NO: 201705 - DNA, 35 bp, Artificial Sequence
  Synthetic oligonucleotide
gcccaggtctgctgctaccttcgcgcttcgttacc

SEQ ID NO: 201706 - DNA, 35 bp, Artificial Sequence
  Synthetic oligonucleotide
acacccgtcctccgatccgcaaattagctccgccc

SEQ ID NO: 201707 - DNA, 35 bp, Artificial Sequence
  Synthetic oligonucleotide
gacgccacgactcgcgattgtgttcgctcacctcc

SEQ ID NO: 201708 - DNA, 35 bp, Artificial Sequence
  Synthetic oligonucleotide
tcagtggcgataagctgagtacgtcctaatcttcc

SEQ ID NO: 201709 - DNA, 35 bp, Artificial Sequence
  Synthetic oligonucleotide
tgttgtacgctacctgttattccagatcctgcctc

SEQ ID NO: 201710 - DNA, 35 bp, Artificial Sequence
  Synthetic oligonucleotide
gaggggcgggagcgggagaagcggacgggataaag

SEQ ID NO: 201711 - DNA, 35 bp, Artificial Sequence
  Synthetic oligonucleotide
accgggtacgggcagggtgggtggccagagaaacg

SEQ ID NO: 201712 - DNA, 35 bp, Artificial Sequence
  Synthetic oligonucleotide
tgacgattccagtatttgccatttcctgcccaccg

SEQ ID NO: 201713 - DNA, 35 bp, Artificial Sequence
  Synthetic oligonucleotide
gccacccctcaggccacctgttcacccgcatagcg

SEQ ID NO: 201714 - DNA, 35 bp, Artificial Sequence
  Synthetic oligonucleotide
tcagcgtgagggggtggagaggggttaattatgcg

SEQ ID NO: 201715 - DNA, 35 bp, Artificial Sequence
  Synthetic oligonucleotide
gagtatcggccgttgttcccgtcgcacctccctcg

SEQ ID NO: 201716 - DNA, 35 bp, Artificial Sequence
  Synthetic oligonucleotide
gctaacgccactaatctgttgtctcctccatctcg

SEQ ID NO: 201717 - DNA, 35 bp, Artificial Sequence
  Synthetic oligonucleotide
gagatgaggcggatagttacatgagggaaggccgg

SEQ ID NO: 201718 - DNA, 35 bp, Artificial Sequence
  Synthetic oligonucleotide
gtcagatcccatgtcctccgcagcctcccagcaat

SEQ ID NO: 201719 - DNA, 35 bp, Artificial Sequence
  Synthetic oligonucleotide
tacaccctctatatcgcgattgagctggtactcat

SEQ ID NO: 201720 - DNA, 35 bp, Artificial Sequence
  Synthetic oligonucleotide
gatgggtgggactagtaaatcgggacaatgggtat

SEQ ID NO: 201721 - DNA, 35 bp, Artificial Sequence
  Synthetic oligonucleotide
aaccaccgccagtatacatctaacaccgccgtgct

SEQ ID NO: 201722 - DNA, 35 bp, Artificial Sequence
  Synthetic oligonucleotide
tctgactcggcacaattgtagttaatcttcctcgt

SEQ ID NO: 201723 - DNA, 36 bp, Artificial Sequence
  Synthetic oligonucleotide
gacgggagggagccggggaagggaacggatcatcaa

SEQ ID NO: 201724 - DNA, 36 bp, Artificial Sequence
  Synthetic oligonucleotide
gttcatccgcctatgctaccctcgatagtgggctaa

SEQ ID NO: 201725 - DNA, 35 bp, Artificial Sequence
  Synthetic oligonucleotide
gtggttcgcatctgctcttcttatacggtccgcca

SEQ ID NO: 201726 - DNA, 35 bp, Artificial Sequence
  Synthetic oligonucleotide
tgtgcgctcgaaattttgtaaacgcctgccttcca

SEQ ID NO: 201727 - DNA, 36 bp, Artificial Sequence
  Synthetic oligonucleotide
atccgagtgagaggggtgaagtaggtggtgggagca

SEQ ID NO: 201728 - DNA, 37 bp, Artificial Sequence
  Synthetic oligonucleotide
gagatcaaacgagggagagtggtttagcaggtggaga

SEQ ID NO: 201729 - DNA, 36 bp, Artificial Sequence
  Synthetic oligonucleotide
gtcgggggaggaaaagagcggagagacgtcaatcga

SEQ ID NO: 201730 - DNA, 37 bp, Artificial Sequence
  Synthetic oligonucleotide
taggaggtggagaacgggggaggtaacacgtcaggga

SEQ ID NO: 201731 - DNA, 37 bp, Artificial Sequence
  Synthetic oligonucleotide
tgtatgcacgcctccgctactccatctgtctcttgga

SEQ ID NO: 201732 - DNA, 37 bp, Artificial Sequence
  Synthetic oligonucleotide
ttggtcaccgcagctgtgttgcgccctcctcacatga

SEQ ID NO: 201733 - DNA, 37 bp, Artificial Sequence
  Synthetic oligonucleotide
actatggagggccaataggagaagagggagaccatga

SEQ ID NO: 201734 - DNA, 37 bp, Artificial Sequence
  Synthetic oligonucleotide
acccacatccgtttcagaatcgtatcacctgtcctga

SEQ ID NO: 201735 - DNA, 38 bp, Artificial Sequence
  Synthetic oligonucleotide
acagggagaaaagggtgaggcggaaatgacagatctga

SEQ ID NO: 201736 - DNA, 38 bp, Artificial Sequence
  Synthetic oligonucleotide
tccgcgtgcgcatgcttgactctgaccccgccctctga

SEQ ID NO: 201737 - DNA, 38 bp, Artificial Sequence
  Synthetic oligonucleotide
gagagaagagaagatgggtcggggtacgaggggagtga

SEQ ID NO: 201738 - DNA, 38 bp, Artificial Sequence
  Synthetic oligonucleotide
tcgaccatgcctcaggctgcgtaagccccatctcttga

SEQ ID NO: 201739 - DNA, 35 bp, Artificial Sequence
  Synthetic oligonucleotide
gatacgtgcagggggagggggtcaggtgaaaacta

SEQ ID NO: 201740 - DNA, 35 bp, Artificial Sequence
  Synthetic oligonucleotide
tgcgtacaccggctaatggttcgtcctctcctgta

SEQ ID NO: 201741 - DNA, 35 bp, Artificial Sequence
  Synthetic oligonucleotide
gtggggagtggcgggaaggtatggggacggcatta

SEQ ID NO: 201742 - DNA, 35 bp, Artificial Sequence
  Synthetic oligonucleotide
gattgccgctctggtctatatcactgtgccgcacc

SEQ ID NO: 201743 - DNA, 35 bp, Artificial Sequence
  Synthetic oligonucleotide
gatcgcgggacgggcagatccgaggggcgggatcc

SEQ ID NO: 201744 - DNA, 35 bp, Artificial Sequence
  Synthetic oligonucleotide
tgactgtccgcgacctgctaggaaacgcccactcc

SEQ ID NO: 201745 - DNA, 35 bp, Artificial Sequence
  Synthetic oligonucleotide
tcgacattggcatgtgatatcttgttctatcttcc

SEQ ID NO: 201746 - DNA, 35 bp, Artificial Sequence
  Synthetic oligonucleotide
gcgattggtcaggatgcttcttctgccaatacctc

SEQ ID NO: 201747 - DNA, 35 bp, Artificial Sequence
  Synthetic oligonucleotide
tgacaacagctaaggcttgtgccccccctctcctc

SEQ ID NO: 201748 - DNA, 35 bp, Artificial Sequence
  Synthetic oligonucleotide
attggagcgcggccgtatgaactcgcgtccttctc

SEQ ID NO: 201749 - DNA, 35 bp, Artificial Sequence
  Synthetic oligonucleotide
ttgcaatggacccctggctgtctcctccatccttc

SEQ ID NO: 201750 - DNA, 35 bp, Artificial Sequence
  Synthetic oligonucleotide
gtgagctcctggtgctcgtggccctccttaagttc

SEQ ID NO: 201751 - DNA, 35 bp, Artificial Sequence
  Synthetic oligonucleotide
gacaccttcgatattcctcccgctgacgaaacccg

SEQ ID NO: 201752 - DNA, 35 bp, Artificial Sequence
  Synthetic oligonucleotide
tcagacctcctgtcgcccccatcgcgtgtgactcg

SEQ ID NO: 201753 - DNA, 35 bp, Artificial Sequence
  Synthetic oligonucleotide
acacaccacctaacatgtttgccgttccgctcttg

SEQ ID NO: 201754 - DNA, 35 bp, Artificial Sequence
  Synthetic oligonucleotide
actggagagacaagtggcgtttagagggggtgttg

SEQ ID NO: 201755 - DNA, 35 bp, Artificial Sequence
  Synthetic oligonucleotide
tagatagcggggggagtgaggtattggcggtcaat

SEQ ID NO: 201756 - DNA, 35 bp, Artificial Sequence
  Synthetic oligonucleotide
tatgccagtccaatattctcttaaccgtgccatgt

SEQ ID NO: 201757 - DNA, 35 bp, Artificial Sequence
  Synthetic oligonucleotide
gccaccccctgtccagtattgctctgcctttcaaa

SEQ ID NO: 201758 - DNA, 36 bp, Artificial Sequence
  Synthetic oligonucleotide
gagacagtggtggagtgttggggacggagtggctaa

SEQ ID NO: 201759 - DNA, 36 bp, Artificial Sequence
  Synthetic oligonucleotide
gggggggcgtgaacaatgaacgggaagggtggctaa

SEQ ID NO: 201760 - DNA, 35 bp, Artificial Sequence
  Synthetic oligonucleotide
ggtgcacctccatcgtttgttcttctcgttcacca

SEQ ID NO: 201761 - DNA, 37 bp, Artificial Sequence
  Synthetic oligonucleotide
tgaggtgggcaattttgaacggggaagggcgtgacga

SEQ ID NO: 201762 - DNA, 37 bp, Artificial Sequence
  Synthetic oligonucleotide
atggtcgcagacagaggatgggagatgggagtagcga

SEQ ID NO: 201763 - DNA, 37 bp, Artificial Sequence
  Synthetic oligonucleotide
tgttacaccgccaccttaacatatcatccgtccggga

SEQ ID NO: 201764 - DNA, 36 bp, Artificial Sequence
  Synthetic oligonucleotide
agcgatggcgggtggggccaagagggtagaggtgga

SEQ ID NO: 201765 - DNA, 35 bp, Artificial Sequence
  Synthetic oligonucleotide
atcctcccccgatacctggggctcatatctttgga

SEQ ID NO: 201766 - DNA, 38 bp, Artificial Sequence
  Synthetic oligonucleotide
gctagcacgtccagctctgccatctccccggcacctga

SEQ ID NO: 201767 - DNA, 35 bp, Artificial Sequence
  Synthetic oligonucleotide
gccccgcgcctcctttctctgtagtcatgtcgtga

SEQ ID NO: 201768 - DNA, 38 bp, Artificial Sequence
  Synthetic oligonucleotide
tgaccacggaggtaagtggggggtgggacatatggtga

SEQ ID NO: 201769 - DNA, 35 bp, Artificial Sequence
  Synthetic oligonucleotide
gtcaccccgtctcacgatctgctcaacctgttata

SEQ ID NO: 201770 - DNA, 36 bp, Artificial Sequence
  Synthetic oligonucleotide
gcatggccagtgtgatacctctacgccccttcacta

SEQ ID NO: 201771 - DNA, 35 bp, Artificial Sequence
  Synthetic oligonucleotide
tcccatcgtagcatgccagccgccccactctcgac

SEQ ID NO: 201772 - DNA, 35 bp, Artificial Sequence
  Synthetic oligonucleotide
gttgcgtgcgcttatgatgatgacctccaccttcc

SEQ ID NO: 201773 - DNA, 35 bp, Artificial Sequence
  Synthetic oligonucleotide
tccagatcacctgctctcgtgacgttctcctcctc

SEQ ID NO: 201774 - DNA, 35 bp, Artificial Sequence
  Synthetic oligonucleotide
atgccgctcgaattaaagtctgccagcccgtcctc

SEQ ID NO: 201775 - DNA, 35 bp, Artificial Sequence
  Synthetic oligonucleotide
atgacagcccgagagttcaacacgtgtctcttctc

SEQ ID NO: 201776 - DNA, 35 bp, Artificial Sequence
  Synthetic oligonucleotide
atcgccacggaagggatttatgcatcctgtccttc

SEQ ID NO: 201777 - DNA, 35 bp, Artificial Sequence
  Synthetic oligonucleotide
tacacactcggacgtaccatccccttcagggtttc

SEQ ID NO: 201778 - DNA, 35 bp, Artificial Sequence
  Synthetic oligonucleotide
tcacgtcgcacctttgcttttccctcgcccccatg

SEQ ID NO: 201779 - DNA, 35 bp, Artificial Sequence
  Synthetic oligonucleotide
tatgccccacattgtactcgcgatctaccaccctg

SEQ ID NO: 201780 - DNA, 35 bp, Artificial Sequence
  Synthetic oligonucleotide
gcacgccgcaccagtccgttatatcgttccttaat

SEQ ID NO: 201781 - DNA, 35 bp, Artificial Sequence
  Synthetic oligonucleotide
atgacctcctcttgttagccgcaccctcctttcgt

SEQ ID NO: 201782 - DNA, 35 bp, Artificial Sequence
  Synthetic oligonucleotide
gaccccatcgcacctctcccacgccacgtatctgt

SEQ ID NO: 201783 - DNA, 35 bp, Artificial Sequence
  Synthetic oligonucleotide
ttcgtcacgtgcaacaggcttcttcatcgttcctt

SEQ ID NO: 201784 - DNA, 35 bp, Artificial Sequence
  Synthetic oligonucleotide
acgtccatcaacatgtgccttagctcgctccattt

SEQ ID NO: 201785 - DNA, 35 bp, Artificial Sequence
  Synthetic oligonucleotide
gagaggtagtggaggggcgcgaacacagagtacaa

SEQ ID NO: 201786 - DNA, 36 bp, Artificial Sequence
  Synthetic oligonucleotide
aactgcgctgcccctgaagtcccgtgcccatttcaa

SEQ ID NO: 201787 - DNA, 35 bp, Artificial Sequence
  Synthetic oligonucleotide
tcccaccgcccgcttgccggaattagggccttaca

SEQ ID NO: 201788 - DNA, 36 bp, Artificial Sequence
  Synthetic oligonucleotide
tgacatcacgtttctgctacagttccgccctttcca

SEQ ID NO: 201789 - DNA, 35 bp, Artificial Sequence
  Synthetic oligonucleotide
atcccgctccatcctgtccttttgaccttcaggca

SEQ ID NO: 201790 - DNA, 35 bp, Artificial Sequence
  Synthetic oligonucleotide
tacgggggaaggcaggagaggggaaggtggaggca

SEQ ID NO: 201791 - DNA, 36 bp, Artificial Sequence
  Synthetic oligonucleotide
ggaccacaggccggcttgttactcttcaccgctgca

SEQ ID NO: 201792 - DNA, 35 bp, Artificial Sequence
  Synthetic oligonucleotide
ttaaccacactgccatagtgcatatgcacctatca

SEQ ID NO: 201793 - DNA, 36 bp, Artificial Sequence
  Synthetic oligonucleotide
accctgcgtagtcctgtttcgcagcactctctctca

SEQ ID NO: 201794 - DNA, 36 bp, Artificial Sequence
  Synthetic oligonucleotide
atgctcgcctgggtctgaactaacctcccgtcttca

SEQ ID NO: 201795 - DNA, 37 bp, Artificial Sequence
  Synthetic oligonucleotide
gacagacgagggtggaaagtgaggatgtggggacaga

SEQ ID NO: 201796 - DNA, 37 bp, Artificial Sequence
  Synthetic oligonucleotide
aaccggaggagggcgtaagagaagaagacggagcaga

SEQ ID NO: 201797 - DNA, 37 bp, Artificial Sequence
  Synthetic oligonucleotide
gtgggtgtccagggggagaaaagtggaatgacgcaga

SEQ ID NO: 201798 - DNA, 37 bp, Artificial Sequence
  Synthetic oligonucleotide
gaaggaaggcgagggggttggaccgcgggaagcgaga

SEQ ID NO: 201799 - DNA, 37 bp, Artificial Sequence
  Synthetic oligonucleotide
tatgcaataggtaagggtggctagaaggagggggaga

SEQ ID NO: 201800 - DNA, 37 bp, Artificial Sequence
  Synthetic oligonucleotide
tggacacgcccctgtacgttctggtctctctccacga

SEQ ID NO: 201801 - DNA, 37 bp, Artificial Sequence
  Synthetic oligonucleotide
acgtacccgcctgctaccccccttttgcatcacccga

SEQ ID NO: 201802 - DNA, 36 bp, Artificial Sequence
  Synthetic oligonucleotide
ggggggagtgtggacgaaggcaggaagaggcgccga

SEQ ID NO: 201803 - DNA, 37 bp, Artificial Sequence
  Synthetic oligonucleotide
ttccacgccggaccagcgtattaagtccacctgccga

SEQ ID NO: 201804 - DNA, 37 bp, Artificial Sequence
  Synthetic oligonucleotide
gcgaaagcaaggaaactaagcagggggagcagtgcga

SEQ ID NO: 201805 - DNA, 37 bp, Artificial Sequence
  Synthetic oligonucleotide
acaggggtcgggggcaaagtagcggagcaggcgcgga

SEQ ID NO: 201806 - DNA, 37 bp, Artificial Sequence
  Synthetic oligonucleotide
gcacagagaacagaaggggggcaagggacatctggga

SEQ ID NO: 201807 - DNA, 37 bp, Artificial Sequence
  Synthetic oligonucleotide
gaacggtcgacggtttttcgttactatctctcttgga

SEQ ID NO: 201808 - DNA, 38 bp, Artificial Sequence
  Synthetic oligonucleotide
ttgagcttgtttgccttatatacactcccattacgtga

SEQ ID NO: 201809 - DNA, 38 bp, Artificial Sequence
  Synthetic oligonucleotide
tgcgagccccgactcgtgcttttggttccctgctgtga

SEQ ID NO: 201810 - DNA, 36 bp, Artificial Sequence
  Synthetic oligonucleotide
gtttgcagtcaatgtcgggagggcggtggggcgtta

SEQ ID NO: 201811 - DNA, 35 bp, Artificial Sequence
  Synthetic oligonucleotide
acatacttgtcgacaggtcctttcaccgctgttcc

SEQ ID NO: 201812 - DNA, 35 bp, Artificial Sequence
  Synthetic oligonucleotide
tcctacgccgcagtgtcctgcaccctgtcctactc

SEQ ID NO: 201813 - DNA, 35 bp, Artificial Sequence
  Synthetic oligonucleotide
gccatcccccgctttttccggtgccctgtttactc

SEQ ID NO: 201814 - DNA, 35 bp, Artificial Sequence
  Synthetic oligonucleotide
aacaccatcggccggttcaagccagctacgcgctc

SEQ ID NO: 201815 - DNA, 35 bp, Artificial Sequence
  Synthetic oligonucleotide
acgcgacgtgcgtagtgcatagtcaccctctcgtc

SEQ ID NO: 201816 - DNA, 35 bp, Artificial Sequence
  Synthetic oligonucleotide
taggacctcacctgttgtcaccttgctctcttgtc

SEQ ID NO: 201817 - DNA, 35 bp, Artificial Sequence
  Synthetic oligonucleotide
gaagggaggggagggagggataggttctacgacag

SEQ ID NO: 201818 - DNA, 35 bp, Artificial Sequence
  Synthetic oligonucleotide
gctggcgcccacaatcgcgcattgttccaccttgg

SEQ ID NO: 201819 - DNA, 35 bp, Artificial Sequence
  Synthetic oligonucleotide
aactccccatccggcgtgtacgattccagttttgg

SEQ ID NO: 201820 - DNA, 35 bp, Artificial Sequence
  Synthetic oligonucleotide
gagctagctaccatgattgccacccgttacccttg

SEQ ID NO: 201821 - DNA, 35 bp, Artificial Sequence
  Synthetic oligonucleotide
acactcccgatgcgctactgtactccctctccttg

SEQ ID NO: 201822 - DNA, 35 bp, Artificial Sequence
  Synthetic oligonucleotide
tagcgaggtgggtgtcggcgtacggggcgggaaat

SEQ ID NO: 201823 - DNA, 35 bp, Artificial Sequence
  Synthetic oligonucleotide
gccaacgccacttggtccggcttagatcctttcct

SEQ ID NO: 201824 - DNA, 35 bp, Artificial Sequence
  Synthetic oligonucleotide
gtgccatccgcctgcatggtgccgtatatacctct

SEQ ID NO: 201825 - DNA, 35 bp, Artificial Sequence
  Synthetic oligonucleotide
atagcactgtcacagcatcgcgtccccctactcgt

SEQ ID NO: 201826 - DNA, 35 bp, Artificial Sequence
  Synthetic oligonucleotide
taactgccccgtcatccagttctttgccaacctgt

SEQ ID NO: 201827 - DNA, 35 bp, Artificial Sequence
  Synthetic oligonucleotide
gtggggcaatagggggggacgagagagttaaaatt

SEQ ID NO: 201828 - DNA, 36 bp, Artificial Sequence
  Synthetic oligonucleotide
gtccacggcggatggtggtgtcggacggtggagaaa

SEQ ID NO: 201829 - DNA, 35 bp, Artificial Sequence
  Synthetic oligonucleotide
tccccgaagaggagaaggaagggaggatcggtaca

SEQ ID NO: 201830 - DNA, 36 bp, Artificial Sequence
  Synthetic oligonucleotide
ggttggccctcgatgcacaattagcctccccttgca

SEQ ID NO: 201831 - DNA, 36 bp, Artificial Sequence
  Synthetic oligonucleotide
attccagcccgcaacatgtccttcctcatcgcttca

SEQ ID NO: 201832 - DNA, 37 bp, Artificial Sequence
  Synthetic oligonucleotide
gagtagtgacgaggttaagaggggaagaggtaaaaga

SEQ ID NO: 201833 - DNA, 37 bp, Artificial Sequence
  Synthetic oligonucleotide
tgggaaatacgggaagaggataaagcgggaaggtaga

SEQ ID NO: 201834 - DNA, 37 bp, Artificial Sequence
  Synthetic oligonucleotide
atcagctcaggatctctgcttgtccctccgccaccga

SEQ ID NO: 201835 - DNA, 34 bp, Artificial Sequence
  Synthetic oligonucleotide
gcctgggggcagggaggggacagtaaagggtcga

SEQ ID NO: 201836 - DNA, 37 bp, Artificial Sequence
  Synthetic oligonucleotide
atgtcaacccagcactacctattgacgtccctttcga

SEQ ID NO: 201837 - DNA, 37 bp, Artificial Sequence
  Synthetic oligonucleotide
gtcggaagggcgggatctggatggggggggctaagga

SEQ ID NO: 201838 - DNA, 37 bp, Artificial Sequence
  Synthetic oligonucleotide
tgtgcacctagatgcaaacgtgccgcccctctcctga

SEQ ID NO: 201839 - DNA, 38 bp, Artificial Sequence
  Synthetic oligonucleotide
gcctcccatcctgcttcccttcgtcctggtcactctga

SEQ ID NO: 201840 - DNA, 38 bp, Artificial Sequence
  Synthetic oligonucleotide
tgggggggccggaggaagggcgggggggagacgtgtga

SEQ ID NO: 201841 - DNA, 36 bp, Artificial Sequence
  Synthetic oligonucleotide
gacgcatctccgccgctgaaatcttccttggtctta

SEQ ID NO: 201842 - DNA, 36 bp, Artificial Sequence
  Synthetic oligonucleotide
atacttccccctccccggagctcgcctcagatgtta

SEQ ID NO: 201843 - DNA, 35 bp, Artificial Sequence
  Synthetic oligonucleotide
ggggagggccgagcagggttatgaaaggggcagac

SEQ ID NO: 201844 - DNA, 33 bp, Artificial Sequence
  Synthetic oligonucleotide
gacgcccacgagagctcgccctatacatcgccc

SEQ ID NO: 201845 - DNA, 35 bp, Artificial Sequence
  Synthetic oligonucleotide
gacacgtatgtctgcgcttttccaccgctttgccc

SEQ ID NO: 201846 - DNA, 35 bp, Artificial Sequence
  Synthetic oligonucleotide
tctgggtcacgccctctggtctctacgctcactcc

SEQ ID NO: 201847 - DNA, 35 bp, Artificial Sequence
  Synthetic oligonucleotide
agtgatacgtcccgaagtctctccattagctgtcc

SEQ ID NO: 201848 - DNA, 35 bp, Artificial Sequence
  Synthetic oligonucleotide
tccgggatggagggtgggacgaacaaaaggggctc

SEQ ID NO: 201849 - DNA, 35 bp, Artificial Sequence
  Synthetic oligonucleotide
ttcgctcgccccgccttgtcgcttcaacacttgtc

SEQ ID NO: 201850 - DNA, 35 bp, Artificial Sequence
  Synthetic oligonucleotide
gtgccatccgccttgaactctagagctcctctccg

SEQ ID NO: 201851 - DNA, 35 bp, Artificial Sequence
  Synthetic oligonucleotide
aaccttccgtacatactgccacattccaatattcg

SEQ ID NO: 201852 - DNA, 34 bp, Artificial Sequence
  Synthetic oligonucleotide
tacgaggtgaagggtaacgggagagcagatcagg

SEQ ID NO: 201853 - DNA, 35 bp, Artificial Sequence
  Synthetic oligonucleotide
agcggtaggggtagtatggggaggaggggcttcgg

SEQ ID NO: 201854 - DNA, 35 bp, Artificial Sequence
  Synthetic oligonucleotide
tacgtacacaccccggatcgcatagccgcacctgg

SEQ ID NO: 201855 - DNA, 35 bp, Artificial Sequence
  Synthetic oligonucleotide
gtgcacatcacgccgctgttaaatcctcgccctgg

SEQ ID NO: 201856 - DNA, 35 bp, Artificial Sequence
  Synthetic oligonucleotide
gatgcgcacgccgctatgtcctcgtccttggttgg

SEQ ID NO: 201857 - DNA, 35 bp, Artificial Sequence
  Synthetic oligonucleotide
gccccaccaccaattggtacccggacacagagaat

SEQ ID NO: 201858 - DNA, 35 bp, Artificial Sequence
  Synthetic oligonucleotide
tgcatccgcatttgacgctcagggcattcctccat

SEQ ID NO: 201859 - DNA, 35 bp, Artificial Sequence
  Synthetic oligonucleotide
gacacacgtcatagagtctgcgcctcactcctcat

SEQ ID NO: 201860 - DNA, 35 bp, Artificial Sequence
  Synthetic oligonucleotide
tccaccaatccttaaatgcatcaccagacagtcct

SEQ ID NO: 201861 - DNA, 35 bp, Artificial Sequence
  Synthetic oligonucleotide
gtagccagggggtatgagggggcagtaggagacgt

SEQ ID NO: 201862 - DNA, 36 bp, Artificial Sequence
  Synthetic oligonucleotide
acagtgtggtccactgcctaccatgcctgttatcaa

SEQ ID NO: 201863 - DNA, 35 bp, Artificial Sequence
  Synthetic oligonucleotide
tgtcatcagtcctggcgccctccttccgttaataa

SEQ ID NO: 201864 - DNA, 35 bp, Artificial Sequence
  Synthetic oligonucleotide
ttagggaccagctcacactcaatgcctcccgaaca

SEQ ID NO: 201865 - DNA, 35 bp, Artificial Sequence
  Synthetic oligonucleotide
tgtatcccagtcctggcaccacgaaactcgctaca

SEQ ID NO: 201866 - DNA, 36 bp, Artificial Sequence
  Synthetic oligonucleotide
tcacccgtcgcctatcagtttgtgcgtcaccctcca

SEQ ID NO: 201867 - DNA, 35 bp, Artificial Sequence
  Synthetic oligonucleotide
ttgcaccatcttgcggccagagatctcaccttgca

SEQ ID NO: 201868 - DNA, 37 bp, Artificial Sequence
  Synthetic oligonucleotide
actgggaggggaggcctggaggaaaaggttcggacga

SEQ ID NO: 201869 - DNA, 37 bp, Artificial Sequence
  Synthetic oligonucleotide
gcgaacgtgcaggccaactacatcgcaatcctcccga

SEQ ID NO: 201870 - DNA, 36 bp, Artificial Sequence
  Synthetic oligonucleotide
tagcgggagtgggataggtagagggtgacaaatcga

SEQ ID NO: 201871 - DNA, 37 bp, Artificial Sequence
  Synthetic oligonucleotide
atcaaacgaagggaagtataagagagggtggggtcga

SEQ ID NO: 201872 - DNA, 38 bp, Artificial Sequence
  Synthetic oligonucleotide
tgagggcggagggaggggggtggatttggacagtatga

SEQ ID NO: 201873 - DNA, 38 bp, Artificial Sequence
  Synthetic oligonucleotide
gtgtcagccgagtttgcatatgcctccgctccccgtga

SEQ ID NO: 201874 - DNA, 33 bp, Artificial Sequence
  Synthetic oligonucleotide
ttgaacccctctgtgcttcggtactgttcgcta

SEQ ID NO: 201875 - DNA, 35 bp, Artificial Sequence
  Synthetic oligonucleotide
gcaatggcgcacagaaaggggggaggaaaagggta

SEQ ID NO: 201876 - DNA, 35 bp, Artificial Sequence
  Synthetic oligonucleotide
attgatgccagtgggacggtgagggagggtattta

SEQ ID NO: 201877 - DNA, 35 bp, Artificial Sequence
  Synthetic oligonucleotide
gaaacgaggagagtgggaggggaagagattagagc

SEQ ID NO: 201878 - DNA, 34 bp, Artificial Sequence
  Synthetic oligonucleotide
agccaccgccacccgagccgtatgcccgtgcctc

SEQ ID NO: 201879 - DNA, 35 bp, Artificial Sequence
  Synthetic oligonucleotide
gcaccgctacgtatgccccggctcgggatcctctc

SEQ ID NO: 201880 - DNA, 35 bp, Artificial Sequence
  Synthetic oligonucleotide
tgctagggggaggggtaaagggggcatggcactag

SEQ ID NO: 201881 - DNA, 35 bp, Artificial Sequence
  Synthetic oligonucleotide
gacgagacagtcggttgttgggtgggaggcggacg

SEQ ID NO: 201882 - DNA, 35 bp, Artificial Sequence
  Synthetic oligonucleotide
tactggcgtccacagcacaatccaccgtttccccg

SEQ ID NO: 201883 - DNA, 34 bp, Artificial Sequence
  Synthetic oligonucleotide
gatgtgaacacagggaacaaataaagacgagagg

SEQ ID NO: 201884 - DNA, 35 bp, Artificial Sequence
  Synthetic oligonucleotide
gagggtaactctcagtggtggggacgataagcggg

SEQ ID NO: 201885 - DNA, 35 bp, Artificial Sequence
  Synthetic oligonucleotide
aatacatccgatagccttccgtccctgccgtgcct

SEQ ID NO: 201886 - DNA, 34 bp, Artificial Sequence
  Synthetic oligonucleotide
gtccacccccggttgagagctacttcaagccgct

SEQ ID NO: 201887 - DNA, 35 bp, Artificial Sequence
  Synthetic oligonucleotide
acaagagagaggggtatggggatacgcagaagagt

SEQ ID NO: 201888 - DNA, 35 bp, Artificial Sequence
  Synthetic oligonucleotide
ggaagggggagggcaaagggcatcgattcacaatt

SEQ ID NO: 201889 - DNA, 36 bp, Artificial Sequence
  Synthetic oligonucleotide
gacgaggttagagcggacgggggctgcaggggacaa

SEQ ID NO: 201890 - DNA, 36 bp, Artificial Sequence
  Synthetic oligonucleotide
aagcaagagtgggaggggaaatgaggcgccaggcaa

SEQ ID NO: 201891 - DNA, 36 bp, Artificial Sequence
  Synthetic oligonucleotide
tagcgaacggaggaaataggagatagggggcattaa

SEQ ID NO: 201892 - DNA, 36 bp, Artificial Sequence
  Synthetic oligonucleotide
gacgtccctctgaagtcttggaaagcccaccgtaca

SEQ ID NO: 201893 - DNA, 36 bp, Artificial Sequence
  Synthetic oligonucleotide
attcatgcgcccactccgttcaaggttccttcgtca

SEQ ID NO: 201894 - DNA, 37 bp, Artificial Sequence
  Synthetic oligonucleotide
tgtggggggagcatgaagagggattggtgggagatga

SEQ ID NO: 201895 - DNA, 38 bp, Artificial Sequence
  Synthetic oligonucleotide
aagtggtggatagaaggggggagagacattaggcgtga

SEQ ID NO: 201896 - DNA, 38 bp, Artificial Sequence
  Synthetic oligonucleotide
gctacgaggccaggaggaataaagggcagggggggtga

SEQ ID NO: 201897 - DNA, 37 bp, Artificial Sequence
  Synthetic oligonucleotide
atatgctgccttcacctgtgatcgttccatcttttga

SEQ ID NO: 201898 - DNA, 36 bp, Artificial Sequence
  Synthetic oligonucleotide
ttggagagcgggtgtgtgggtcgaacatgccaaata

SEQ ID NO: 201899 - DNA, 36 bp, Artificial Sequence
  Synthetic oligonucleotide
tccctgactccacctctgttacatgagtacgcgcta

SEQ ID NO: 201900 - DNA, 36 bp, Artificial Sequence
  Synthetic oligonucleotide
ttgtcactgccgcctatatcgcaccggttctctcta

SEQ ID NO: 201901 - DNA, 35 bp, Artificial Sequence
  Synthetic oligonucleotide
tcacagacctccactccttgacacttgacaggtta

SEQ ID NO: 201902 - DNA, 35 bp, Artificial Sequence
  Synthetic oligonucleotide
aatgtgctgcccactaccgtatcctcaccgtttac

SEQ ID NO: 201903 - DNA, 35 bp, Artificial Sequence
  Synthetic oligonucleotide
tgactacgcccatagttcaaagccccaccgaatcc

SEQ ID NO: 201904 - DNA, 35 bp, Artificial Sequence
  Synthetic oligonucleotide
tcagctcgtactgatgccatatcgcctgtccctcc

SEQ ID NO: 201905 - DNA, 35 bp, Artificial Sequence
  Synthetic oligonucleotide
ttgaccgggggaaggaagaagggagggcgtagagc

SEQ ID NO: 201906 - DNA, 35 bp, Artificial Sequence
  Synthetic oligonucleotide
atcaacgcccacctgctactcaggacctcctcccg

SEQ ID NO: 201907 - DNA, 35 bp, Artificial Sequence
  Synthetic oligonucleotide
ggttaagtgggaatagggtaggtagggggagggcg

SEQ ID NO: 201908 - DNA, 35 bp, Artificial Sequence
  Synthetic oligonucleotide
gccacccctcttttcgactgttccctcctggttcg

SEQ ID NO: 201909 - DNA, 35 bp, Artificial Sequence
  Synthetic oligonucleotide
tactgacgccacgagttctgatccaccacacattg

SEQ ID NO: 201910 - DNA, 35 bp, Artificial Sequence
  Synthetic oligonucleotide
gaccttgtaccgatatcccaccgcttttatagttg

SEQ ID NO: 201911 - DNA, 35 bp, Artificial Sequence
  Synthetic oligonucleotide
gacccacgccatagttgatttactgcctcctgaat

SEQ ID NO: 201912 - DNA, 35 bp, Artificial Sequence
  Synthetic oligonucleotide
ggaggagggaggaggcctgacaatcagacagaggt

SEQ ID NO: 201913 - DNA, 35 bp, Artificial Sequence
  Synthetic oligonucleotide
tgttgcacgctatgttctcgggtcgcattatcctt

SEQ ID NO: 201914 - DNA, 35 bp, Artificial Sequence
  Synthetic oligonucleotide
gtgcatgagagagggtgcaggggagatggggattt

SEQ ID NO: 201915 - DNA, 36 bp, Artificial Sequence
  Synthetic oligonucleotide
gtcgacctccctcgcgtctaggcctctgctcatttt

SEQ ID NO: 201916 - DNA, 35 bp, Artificial Sequence
  Synthetic oligonucleotide
tgaccgtcgctcgcagtcgtactggttccacccca

SEQ ID NO: 201917 - DNA, 36 bp, Artificial Sequence
  Synthetic oligonucleotide
gcggagctccaccttgcgtaatgcatctcgcctgca

SEQ ID NO: 201918 - DNA, 35 bp, Artificial Sequence
  Synthetic oligonucleotide
acgaccccgagtcagccttgttctttcctcgttca

SEQ ID NO: 201919 - DNA, 37 bp, Artificial Sequence
  Synthetic oligonucleotide
ttatcgcagggggaccagggaagggcggtaacggaga

SEQ ID NO: 201920 - DNA, 37 bp, Artificial Sequence
  Synthetic oligonucleotide
gttgagtcgggtggtgggaagggcaactggcggacga

SEQ ID NO: 201921 - DNA, 37 bp, Artificial Sequence
  Synthetic oligonucleotide
ttgacaggagggtgagggagcggtaaagacatgccga

SEQ ID NO: 201922 - DNA, 36 bp, Artificial Sequence
  Synthetic oligonucleotide
atgagcagaccgacactctcttttggaccatctcga

SEQ ID NO: 201923 - DNA, 36 bp, Artificial Sequence
  Synthetic oligonucleotide
gacggggaggacaaactgagggaaactgcggaggga

SEQ ID NO: 201924 - DNA, 37 bp, Artificial Sequence
  Synthetic oligonucleotide
aaagggggcggaggcacatagagcatgtgcggaggga

SEQ ID NO: 201925 - DNA, 35 bp, Artificial Sequence
  Synthetic oligonucleotide
gatgcggtcgctgacaggtacagggagcgggggga

SEQ ID NO: 201926 - DNA, 38 bp, Artificial Sequence
  Synthetic oligonucleotide
ggagaggggacgcgaacatgcgatagggcgaggatgga

SEQ ID NO: 201927 - DNA, 38 bp, Artificial Sequence
  Synthetic oligonucleotide
gatcagggggagaaggaatgggcgggcacacagtctga

SEQ ID NO: 201928 - DNA, 38 bp, Artificial Sequence
  Synthetic oligonucleotide
aaaaggacgggatgggagggagggttaagggtccgtga

SEQ ID NO: 201929 - DNA, 36 bp, Artificial Sequence
  Synthetic oligonucleotide
gatgtacgtccacgtggccaacacgtctccacctta

SEQ ID NO: 201930 - DNA, 35 bp, Artificial Sequence
  Synthetic oligonucleotide
gagaaggtcgaactgctccctgttacctatggtcc

SEQ ID NO: 201931 - DNA, 35 bp, Artificial Sequence
  Synthetic oligonucleotide
gccatgttgcgttgtgtcgccccatctgaactagc

SEQ ID NO: 201932 - DNA, 35 bp, Artificial Sequence
  Synthetic oligonucleotide
gcagtatctcacgtagtctaccgctgtcttcctgc

SEQ ID NO: 201933 - DNA, 35 bp, Artificial Sequence
  Synthetic oligonucleotide
taggatgggggaggcggagagactgcagatttgcg

SEQ ID NO: 201934 - DNA, 35 bp, Artificial Sequence
  Synthetic oligonucleotide
gccaaccgaatcaagtaggttaccatctcctctcg

SEQ ID NO: 201935 - DNA, 35 bp, Artificial Sequence
  Synthetic oligonucleotide
gatgtgtcacgccggttggcaactttcactattcg

SEQ ID NO: 201936 - DNA, 35 bp, Artificial Sequence
  Synthetic oligonucleotide
gaccgccaacactctcaccttcaccccctaccggg

SEQ ID NO: 201937 - DNA, 35 bp, Artificial Sequence
  Synthetic oligonucleotide
gtgcacatcccgcctctgttaaatcctcgccctgg

SEQ ID NO: 201938 - DNA, 35 bp, Artificial Sequence
  Synthetic oligonucleotide
ttcatcagcagtcagactctgcctctcatgtactt

SEQ ID NO: 201939 - DNA, 35 bp, Artificial Sequence
  Synthetic oligonucleotide
gacactccaggccaatgtcaagttccgtcaccttt

SEQ ID NO: 201940 - DNA, 36 bp, Artificial Sequence
  Synthetic oligonucleotide
atgccagtcgcacctgctgtcccttcgtcttcctaa

SEQ ID NO: 201941 - DNA, 35 bp, Artificial Sequence
  Synthetic oligonucleotide
gcgacgacctgatgtaagtctccttcacacctcca

SEQ ID NO: 201942 - DNA, 36 bp, Artificial Sequence
  Synthetic oligonucleotide
gataagggcggggaataacatagaagacaggacgca

SEQ ID NO: 201943 - DNA, 35 bp, Artificial Sequence
  Synthetic oligonucleotide
atgtccacgaacttcacttctcttcgcccttttca

SEQ ID NO: 201944 - DNA, 36 bp, Artificial Sequence
  Synthetic oligonucleotide
accgcacacatggggggaggagaatcgggggacaga

SEQ ID NO: 201945 - DNA, 36 bp, Artificial Sequence
  Synthetic oligonucleotide
taacgggctaggagggaaggtgaggggggtcggcga

SEQ ID NO: 201946 - DNA, 37 bp, Artificial Sequence
  Synthetic oligonucleotide
gcatgcgtccggacgttcagcccatccatcctctcga

SEQ ID NO: 201947 - DNA, 35 bp, Artificial Sequence
  Synthetic oligonucleotide
gctggcccatcccgatcgttcgcaccgtctttcga

SEQ ID NO: 201948 - DNA, 37 bp, Artificial Sequence
  Synthetic oligonucleotide
acgtgacgacacctgctcacaacaccacacctccgga

SEQ ID NO: 201949 - DNA, 37 bp, Artificial Sequence
  Synthetic oligonucleotide
agtggagagacgcgggaggggagaaaggacgtttgga

SEQ ID NO: 201950 - DNA, 36 bp, Artificial Sequence
  Synthetic oligonucleotide
ttgatcacggaaggagagaggggagctggccaatga

SEQ ID NO: 201951 - DNA, 37 bp, Artificial Sequence
  Synthetic oligonucleotide
acatgacatgggtcgggtgtgggcaaagggggactga

SEQ ID NO: 201952 - DNA, 38 bp, Artificial Sequence
  Synthetic oligonucleotide
ggagggacggagaggaaaaaagcgttcagttgcgttga

SEQ ID NO: 201953 - DNA, 35 bp, Artificial Sequence
  Synthetic oligonucleotide
ggatccgccgcctgtaactgcagattcgaacccta

SEQ ID NO: 201954 - DNA, 35 bp, Artificial Sequence
  Synthetic oligonucleotide
gaaggtgagtgggaatgcaggatgtgtggatggta

SEQ ID NO: 201955 - DNA, 35 bp, Artificial Sequence
  Synthetic oligonucleotide
gaccaggggggggggggggagggaaggacaagtta

SEQ ID NO: 201956 - DNA, 35 bp, Artificial Sequence
  Synthetic oligonucleotide
atacgcttacacacatgtcgcctcctcaccagtta

SEQ ID NO: 201957 - DNA, 35 bp, Artificial Sequence
  Synthetic oligonucleotide
tgaaggtcacgcctcccctgtgtaccctgtccctc

SEQ ID NO: 201958 - DNA, 35 bp, Artificial Sequence
  Synthetic oligonucleotide
tccaccactcgcgctgttcaggtctctctctcttc

SEQ ID NO: 201959 - DNA, 35 bp, Artificial Sequence
  Synthetic oligonucleotide
gtttcgtccttcccggtctgctacactaccctacg

SEQ ID NO: 201960 - DNA, 35 bp, Artificial Sequence
  Synthetic oligonucleotide
tatgcgtacacagtaaccgaaccatcttcctatcg

SEQ ID NO: 201961 - DNA, 34 bp, Artificial Sequence
  Synthetic oligonucleotide
gatgcgttggtgggaggatccggaggtagtgggg

SEQ ID NO: 201962 - DNA, 35 bp, Artificial Sequence
  Synthetic oligonucleotide
gatgggcatcgctctcaccttcttaactacgcctg

SEQ ID NO: 201963 - DNA, 29 bp, Artificial Sequence
  Synthetic oligonucleotide
atacgtgcgaaagccgacatccctctctg

SEQ ID NO: 201964 - DNA, 35 bp, Artificial Sequence
  Synthetic oligonucleotide
tgagaggctcacaagtggggagaagggtaagggtg

SEQ ID NO: 201965 - DNA, 35 bp, Artificial Sequence
  Synthetic oligonucleotide
aggggggggaggggggggtacgaggcagggggcat

SEQ ID NO: 201966 - DNA, 35 bp, Artificial Sequence
  Synthetic oligonucleotide
gactacggtcaaacggtcttgagcacctgccctat

SEQ ID NO: 201967 - DNA, 35 bp, Artificial Sequence
  Synthetic oligonucleotide
gcatggctcaattctgtcttagcaacactcctgct

SEQ ID NO: 201968 - DNA, 36 bp, Artificial Sequence
  Synthetic oligonucleotide
gctagagttcggcccgtcacgcccccctgttcgaaa

SEQ ID NO: 201969 - DNA, 35 bp, Artificial Sequence
  Synthetic oligonucleotide
gagacacgccaagacgtcctttgctctacacttaa

SEQ ID NO: 201970 - DNA, 36 bp, Artificial Sequence
  Synthetic oligonucleotide
tggaactgcccgatcgtgttcccttcccgctgccca

SEQ ID NO: 201971 - DNA, 36 bp, Artificial Sequence
  Synthetic oligonucleotide
gagccgcctccttcccggacttctggccactgctca

SEQ ID NO: 201972 - DNA, 35 bp, Artificial Sequence
  Synthetic oligonucleotide
gtgaggcctccgctgcctgtttgatttatttgtca

SEQ ID NO: 201973 - DNA, 38 bp, Artificial Sequence
  Synthetic oligonucleotide
tcaacagtcgacacacgtcctctgtccactttacctga

SEQ ID NO: 201974 - DNA, 36 bp, Artificial Sequence
  Synthetic oligonucleotide
gttctccatcaccgccgtaccgtgtacacgctaata

SEQ ID NO: 201975 - DNA, 35 bp, Artificial Sequence
  Synthetic oligonucleotide
gcatgcacagagaggggggagggcagatgtaggta

SEQ ID NO: 201976 - DNA, 35 bp, Artificial Sequence
  Synthetic oligonucleotide
gtgactgccgccacccgtaattatggtcctcggta

SEQ ID NO: 201977 - DNA, 36 bp, Artificial Sequence
  Synthetic oligonucleotide
taggatgggcgaaggaaaaggcacaagggggatgta

SEQ ID NO: 201978 - DNA, 35 bp, Artificial Sequence
  Synthetic oligonucleotide
aacgacgttccctggcgcagactgcctatttccac

SEQ ID NO: 201979 - DNA, 35 bp, Artificial Sequence
  Synthetic oligonucleotide
gaggagataggtaaggggtgaaagagcgttcccag

SEQ ID NO: 201980 - DNA, 35 bp, Artificial Sequence
  Synthetic oligonucleotide
ggggggaaggggtggtagtagcgccacgaaggtag

SEQ ID NO: 201981 - DNA, 35 bp, Artificial Sequence
  Synthetic oligonucleotide
tccccccgccccatctttgcatatgccctgccacg

SEQ ID NO: 201982 - DNA, 35 bp, Artificial Sequence
  Synthetic oligonucleotide
ttgtgcccagtagctgaatcttcatccacctccgg

SEQ ID NO: 201983 - DNA, 35 bp, Artificial Sequence
  Synthetic oligonucleotide
tcagtgtcaagggacaaacgaggcgagggagtggg

SEQ ID NO: 201984 - DNA, 35 bp, Artificial Sequence
  Synthetic oligonucleotide
gggacagggagggagtagagttaatcgaccgtggg

SEQ ID NO: 201985 - DNA, 35 bp, Artificial Sequence
  Synthetic oligonucleotide
gactgacactcagtcggtacacctgacgtattcct

SEQ ID NO: 201986 - DNA, 35 bp, Artificial Sequence
  Synthetic oligonucleotide
accatctcctatcgccacttacgcgacagctacgt

SEQ ID NO: 201987 - DNA, 35 bp, Artificial Sequence
  Synthetic oligonucleotide
accagacatcatggtagtccaactgcacctccctt

SEQ ID NO: 201988 - DNA, 35 bp, Artificial Sequence
  Synthetic oligonucleotide
gaatgtagggtgctcggtgggggggaacaaaataa

SEQ ID NO: 201989 - DNA, 35 bp, Artificial Sequence
  Synthetic oligonucleotide
gatcaccgtacggtatgactcttccccttagtaca

SEQ ID NO: 201990 - DNA, 36 bp, Artificial Sequence
  Synthetic oligonucleotide
attgcacctcgcccatgtcatcctggtccctcacca

SEQ ID NO: 201991 - DNA, 36 bp, Artificial Sequence
  Synthetic oligonucleotide
ggacctgtcccgatcccttcctcttcgccgttacca

SEQ ID NO: 201992 - DNA, 36 bp, Artificial Sequence
  Synthetic oligonucleotide
actcgccccctccaaatgtgttaccgttaggtatca

SEQ ID NO: 201993 - DNA, 36 bp, Artificial Sequence
  Synthetic oligonucleotide
gcccgtcgcacgtacgctctttgccggttgaattca

SEQ ID NO: 201994 - DNA, 36 bp, Artificial Sequence
  Synthetic oligonucleotide
ttgggggcgaagaaggaagggggtgttagggcggga

SEQ ID NO: 201995 - DNA, 38 bp, Artificial Sequence
  Synthetic oligonucleotide
ggggatgagggagtgtgcagagatggacggggggatga

SEQ ID NO: 201996 - DNA, 38 bp, Artificial Sequence
  Synthetic oligonucleotide
gtcgggacgggtggggtatgaagaagcacggggactga

SEQ ID NO: 201997 - DNA, 35 bp, Artificial Sequence
  Synthetic oligonucleotide
gacagggaggaggggacaggagattggaaaggtga

SEQ ID NO: 201998 - DNA, 38 bp, Artificial Sequence
  Synthetic oligonucleotide
tagacgcggtcagggagggcgattgaaggggatgttga

SEQ ID NO: 201999 - DNA, 36 bp, Artificial Sequence
  Synthetic oligonucleotide
ttggagagcgggtgggtggttcgaacatgccaaata

SEQ ID NO: 202000 - DNA, 25 bp, Artificial Sequence
  Synthetic oligonucleotide
accccccctgccgtttacgcaacta

SEQ ID NO: 202001 - DNA, 36 bp, Artificial Sequence
  Synthetic oligonucleotide
ggggagggtccatggggaagaggtatggggctccta

SEQ ID NO: 202002 - DNA, 35 bp, Artificial Sequence
  Synthetic oligonucleotide
gaacccccatatgcggtttttgttcctggtgccac

SEQ ID NO: 202003 - DNA, 35 bp, Artificial Sequence
  Synthetic oligonucleotide
tacaccgccattgttgtaacgcaccgaacacctgc

SEQ ID NO: 202004 - DNA, 35 bp, Artificial Sequence
  Synthetic oligonucleotide
ttggctcccccgtgcgtatttagctccaccttatc

SEQ ID NO: 202005 - DNA, 35 bp, Artificial Sequence
  Synthetic oligonucleotide
gctgatggttcacactgtggtaacatcctccactc

SEQ ID NO: 202006 - DNA, 35 bp, Artificial Sequence
  Synthetic oligonucleotide
tacacgcgtccggatttattggtgcccctgccctc

SEQ ID NO: 202007 - DNA, 34 bp, Artificial Sequence
  Synthetic oligonucleotide
gttcagcacagatgtccgttcttcattccctccg

SEQ ID NO: 202008 - DNA, 35 bp, Artificial Sequence
  Synthetic oligonucleotide
ttgtgcgatgacggaagagggagtatgaagcatcg

SEQ ID NO: 202009 - DNA, 35 bp, Artificial Sequence
  Synthetic oligonucleotide
tcgaaccgacaggcatgtagtggggggcggagagg

SEQ ID NO: 202010 - DNA, 35 bp, Artificial Sequence
  Synthetic oligonucleotide
gaagacgcgatgcaccacccaataccacgcctttg

SEQ ID NO: 202011 - DNA, 35 bp, Artificial Sequence
  Synthetic oligonucleotide
gtggagagccgaggggaggtcaaagggcggtccat

SEQ ID NO: 202012 - DNA, 35 bp, Artificial Sequence
  Synthetic oligonucleotide
gccagagagagcaagatggaggtggagctacagat

SEQ ID NO: 202013 - DNA, 35 bp, Artificial Sequence
  Synthetic oligonucleotide
gaagaggcgcaacggggagcaatggagatatgggt

SEQ ID NO: 202014 - DNA, 35 bp, Artificial Sequence
  Synthetic oligonucleotide
atgttacgctatctggttaatgctcccctgtttgt

SEQ ID NO: 202015 - DNA, 35 bp, Artificial Sequence
  Synthetic oligonucleotide
agaccgcagtttggagcgggctactctaccctttt

SEQ ID NO: 202016 - DNA, 36 bp, Artificial Sequence
  Synthetic oligonucleotide
acatccaccttccaatctgttagctttgcgggcaaa

SEQ ID NO: 202017 - DNA, 36 bp, Artificial Sequence
  Synthetic oligonucleotide
aaagaggggggagggtcggggacggggttagagaaa

SEQ ID NO: 202018 - DNA, 35 bp, Artificial Sequence
  Synthetic oligonucleotide
gcaggtcccgactccaagctcacaccaccgcccca

SEQ ID NO: 202019 - DNA, 35 bp, Artificial Sequence
  Synthetic oligonucleotide
agccgtgcctcctcgtttgcgtattctgatcgcca

SEQ ID NO: 202020 - DNA, 35 bp, Artificial Sequence
  Synthetic oligonucleotide
tattgacgcaactgtttagcaccattccttttgca

SEQ ID NO: 202021 - DNA, 36 bp, Artificial Sequence
  Synthetic oligonucleotide
tccgaatagacgacataaagggagggggcagataga

SEQ ID NO: 202022 - DNA, 36 bp, Artificial Sequence
  Synthetic oligonucleotide
aacctctctcaccgtgcagtccgaacgggccttcga

SEQ ID NO: 202023 - DNA, 37 bp, Artificial Sequence
  Synthetic oligonucleotide
gttgcctcccaccgtattctgcaccgacgagtttcga

SEQ ID NO: 202024 - DNA, 36 bp, Artificial Sequence
  Synthetic oligonucleotide
tccatgcccttacgcttactttgcagtactttagga

SEQ ID NO: 202025 - DNA, 38 bp, Artificial Sequence
  Synthetic oligonucleotide
agtgccagagacaggtagtgggcaacggaggggattga

SEQ ID NO: 202026 - DNA, 35 bp, Artificial Sequence
  Synthetic oligonucleotide
aaccacgccctccccttcctattagtgacgcgata

SEQ ID NO: 202027 - DNA, 35 bp, Artificial Sequence
  Synthetic oligonucleotide
tgcccagctgccacctctgcaaaacagcgcttccc

SEQ ID NO: 202028 - DNA, 35 bp, Artificial Sequence
  Synthetic oligonucleotide
tgtgtgcctcgcctgattatccctgaggcccttcc

SEQ ID NO: 202029 - DNA, 35 bp, Artificial Sequence
  Synthetic oligonucleotide
gccacaacgccgattagctgcagctggtcctccgc

SEQ ID NO: 202030 - DNA, 35 bp, Artificial Sequence
  Synthetic oligonucleotide
actcactcgtagctgctggtaggccctcccctcgc

SEQ ID NO: 202031 - DNA, 35 bp, Artificial Sequence
  Synthetic oligonucleotide
aacgagcgtgggaggagggtacaatcgggctaggc

SEQ ID NO: 202032 - DNA, 35 bp, Artificial Sequence
  Synthetic oligonucleotide
aggtacaggcgcatctgggccatcactctgccttc

SEQ ID NO: 202033 - DNA, 35 bp, Artificial Sequence
  Synthetic oligonucleotide
agccaaggctagggtgtggatggggtggggaatcg

SEQ ID NO: 202034 - DNA, 35 bp, Artificial Sequence
  Synthetic oligonucleotide
tcactacgcagtttggatcacggtcccatttcctg

SEQ ID NO: 202035 - DNA, 35 bp, Artificial Sequence
  Synthetic oligonucleotide
atgcgacgccgatgattacccttttgcccgtatct

SEQ ID NO: 202036 - DNA, 35 bp, Artificial Sequence
  Synthetic oligonucleotide
tctgcaccgaaggatctccaacctcacgctgctct

SEQ ID NO: 202037 - DNA, 35 bp, Artificial Sequence
  Synthetic oligonucleotide
gccatcgcccgcccgcctgaacatcgcatgatttt

SEQ ID NO: 202038 - DNA, 36 bp, Artificial Sequence
  Synthetic oligonucleotide
gccccccgcccgtcacaatacggcctcctcgccaca

SEQ ID NO: 202039 - DNA, 36 bp, Artificial Sequence
  Synthetic oligonucleotide
gttgacgggggaaacgaaggggatagagctgccaca

SEQ ID NO: 202040 - DNA, 35 bp, Artificial Sequence
  Synthetic oligonucleotide
acaccacttcggcctgttacgtgattactgcacca

SEQ ID NO: 202041 - DNA, 36 bp, Artificial Sequence
  Synthetic oligonucleotide
gaccacgggggagatgcgaagagggcaaggaggcga

SEQ ID NO: 202042 - DNA, 37 bp, Artificial Sequence
  Synthetic oligonucleotide
gctgggggggacgaggcttatagagacgaagggagga

SEQ ID NO: 202043 - DNA, 36 bp, Artificial Sequence
  Synthetic oligonucleotide
gactccctccacccccatgcgcttcaagcagtagga

SEQ ID NO: 202044 - DNA, 37 bp, Artificial Sequence
  Synthetic oligonucleotide
tcaacccctctgtttggttacctcatcccgttcggga

SEQ ID NO: 202045 - DNA, 35 bp, Artificial Sequence
  Synthetic oligonucleotide
agtggcggccttcacctttactatcgatctgttga

SEQ ID NO: 202046 - DNA, 35 bp, Artificial Sequence
  Synthetic oligonucleotide
ttggggggcgggcgtgtagcacgagttggggccac

SEQ ID NO: 202047 - DNA, 34 bp, Artificial Sequence
  Synthetic oligonucleotide
tcaacgcagatcaacctttgttatctgcaccacc

SEQ ID NO: 202048 - DNA, 35 bp, Artificial Sequence
  Synthetic oligonucleotide
gccatgccgtcgtgctgcatactaccactcgctgc

SEQ ID NO: 202049 - DNA, 35 bp, Artificial Sequence
  Synthetic oligonucleotide
aaacacgccgttgccgcaatgtacatccaccttgc

SEQ ID NO: 202050 - DNA, 35 bp, Artificial Sequence
  Synthetic oligonucleotide
tacccctctccgaacgggcctataaggacttttgc

SEQ ID NO: 202051 - DNA, 35 bp, Artificial Sequence
  Synthetic oligonucleotide
gttgcttcaccacatgcgcgtaaaggccacacttc

SEQ ID NO: 202052 - DNA, 35 bp, Artificial Sequence
  Synthetic oligonucleotide
tagacgtggaggagggtttcggggacgagattgag

SEQ ID NO: 202053 - DNA, 35 bp, Artificial Sequence
  Synthetic oligonucleotide
ttgcacgctgtcttgtcgtcccctctcctccgtcg

SEQ ID NO: 202054 - DNA, 35 bp, Artificial Sequence
  Synthetic oligonucleotide
ggaatgacgggggagtggggagtgggctaaaagat

SEQ ID NO: 202055 - DNA, 35 bp, Artificial Sequence
  Synthetic oligonucleotide
gggggggtgggtcaggggatcatagtgcggaaact

SEQ ID NO: 202056 - DNA, 35 bp, Artificial Sequence
  Synthetic oligonucleotide
tgttgccctaccctgtcacctgcctgcctttcatt

SEQ ID NO: 202057 - DNA, 35 bp, Artificial Sequence
  Synthetic oligonucleotide
gaatccctccccccattgtgtctcagactccgaaa

SEQ ID NO: 202058 - DNA, 36 bp, Artificial Sequence
  Synthetic oligonucleotide
tcatgccctcgctctctgtcgttcttgtgcttcgaa

SEQ ID NO: 202059 - DNA, 37 bp, Artificial Sequence
  Synthetic oligonucleotide
attggtgcaggagggagtaaagggcaaaaatacgaga

SEQ ID NO: 202060 - DNA, 36 bp, Artificial Sequence
  Synthetic oligonucleotide
ataggtggagtgggagggcctagagcagaaagagga

SEQ ID NO: 202061 - DNA, 37 bp, Artificial Sequence
  Synthetic oligonucleotide
tgaagcctcggagggggggtaaaggtggcctggtgga

SEQ ID NO: 202062 - DNA, 38 bp, Artificial Sequence
  Synthetic oligonucleotide
gaccgcagaaccggtatgcctccactctcacttcatga

SEQ ID NO: 202063 - DNA, 38 bp, Artificial Sequence
  Synthetic oligonucleotide
tgtgcacgtcataaatgcttcgtgcctaccacctctga

SEQ ID NO: 202064 - DNA, 36 bp, Artificial Sequence
  Synthetic oligonucleotide
ggtgccacgcggcggtgggaagggacgggagggtta

SEQ ID NO: 202065 - DNA, 35 bp, Artificial Sequence
  Synthetic oligonucleotide
aacttcatgtccgtagccctaacaccccgttcgac

SEQ ID NO: 202066 - DNA, 35 bp, Artificial Sequence
  Synthetic oligonucleotide
atcagcccgactctaatgcgtgatttcctgcctac

SEQ ID NO: 202067 - DNA, 35 bp, Artificial Sequence
  Synthetic oligonucleotide
tccgccacgaagcgttactgtacttgccctcgtcc

SEQ ID NO: 202068 - DNA, 35 bp, Artificial Sequence
  Synthetic oligonucleotide
tagtgccgagggaatggggggcaatgagggagagc

SEQ ID NO: 202069 - DNA, 35 bp, Artificial Sequence
  Synthetic oligonucleotide
tcatgtcaggattctactcgcccgtactacaacgc

SEQ ID NO: 202070 - DNA, 35 bp, Artificial Sequence
  Synthetic oligonucleotide
gttgctcccgaacgttaccttgcctttccgcgctc

SEQ ID NO: 202071 - DNA, 35 bp, Artificial Sequence
  Synthetic oligonucleotide
gccggtcgagcacgctcctccatcatcccttgttc

SEQ ID NO: 202072 - DNA, 35 bp, Artificial Sequence
  Synthetic oligonucleotide
gggagggggcgggaaggttagatatctgcacgtag

SEQ ID NO: 202073 - DNA, 37 bp, Artificial Sequence
  Synthetic oligonucleotide
acaatgaacggagaggaggagggagttcggcccagtg

SEQ ID NO: 202074 - DNA, 35 bp, Artificial Sequence
  Synthetic oligonucleotide
gtgtcggggaggaagtaaatgggatacaatgtgtg

SEQ ID NO: 202075 - DNA, 35 bp, Artificial Sequence
  Synthetic oligonucleotide
atgacagatcggggtgggtgtcgggaacgggattg

SEQ ID NO: 202076 - DNA, 35 bp, Artificial Sequence
  Synthetic oligonucleotide
gcaagccctagctggtatgcgttccatcatcccat

SEQ ID NO: 202077 - DNA, 35 bp, Artificial Sequence
  Synthetic oligonucleotide
ggtgtctgccgtctaatccgtcgcgtacccgttct

SEQ ID NO: 202078 - DNA, 35 bp, Artificial Sequence
  Synthetic oligonucleotide
gacatgcctcatctctgctttacaacacctttcgt

SEQ ID NO: 202079 - DNA, 35 bp, Artificial Sequence
  Synthetic oligonucleotide
atgtgtgccccccgatctaatttagccccactgtt

SEQ ID NO: 202080 - DNA, 35 bp, Artificial Sequence
  Synthetic oligonucleotide
gacgccaacctttagctggtgcttccattccttaa

SEQ ID NO: 202081 - DNA, 36 bp, Artificial Sequence
  Synthetic oligonucleotide
gatcgcgccgtagggattcattgtcgccctcttcca

SEQ ID NO: 202082 - DNA, 35 bp, Artificial Sequence
  Synthetic oligonucleotide
gtgtccctcgtcatccattattacgctctgttcca

SEQ ID NO: 202083 - DNA, 35 bp, Artificial Sequence
  Synthetic oligonucleotide
acatgcacaagggggagcgaggaaaaagaaacaga

SEQ ID NO: 202084 - DNA, 37 bp, Artificial Sequence
  Synthetic oligonucleotide
gttgccgtccccatctggcctcccgctaatccgccga

SEQ ID NO: 202085 - DNA, 37 bp, Artificial Sequence
  Synthetic oligonucleotide
gatgtcggacgggattagggcagggcgggccatccga

SEQ ID NO: 202086 - DNA, 37 bp, Artificial Sequence
  Synthetic oligonucleotide
tagcaaaaatggggggacggacggtggacgcgggcga

SEQ ID NO: 202087 - DNA, 36 bp, Artificial Sequence
  Synthetic oligonucleotide
ggtgtgggcgcatgccataatatagtgaaagaggga

SEQ ID NO: 202088 - DNA, 38 bp, Artificial Sequence
  Synthetic oligonucleotide
ttgccacgcatgtagttgtatcttcgcccacccgctga

SEQ ID NO: 202089 - DNA, 36 bp, Artificial Sequence
  Synthetic oligonucleotide
tgatgcactattctataggctccacttacattcgta

SEQ ID NO: 202090 - DNA, 36 bp, Artificial Sequence
  Synthetic oligonucleotide
aacaccgtcctaccagtcttcggccccatgttgctc

SEQ ID NO: 202091 - DNA, 35 bp, Artificial Sequence
  Synthetic oligonucleotide
gatacgtcacaggtcgatcaccccctcatccagag

SEQ ID NO: 202092 - DNA, 33 bp, Artificial Sequence
  Synthetic oligonucleotide
gacaagccgcccgtctttctggtccctcttacg

SEQ ID NO: 202093 - DNA, 34 bp, Artificial Sequence
  Synthetic oligonucleotide
attgctacttgccccatactgtatgcctgtttcg

SEQ ID NO: 202094 - DNA, 36 bp, Artificial Sequence
  Synthetic oligonucleotide
aagggatgggacagaggggtggctacgtcggacagg

SEQ ID NO: 202095 - DNA, 35 bp, Artificial Sequence
  Synthetic oligonucleotide
tgccgggtgagagggggcaaagcagagagtgcggg

SEQ ID NO: 202096 - DNA, 35 bp, Artificial Sequence
  Synthetic oligonucleotide
acgatgtggagggagggctaaggggcggatgatgg

SEQ ID NO: 202097 - DNA, 35 bp, Artificial Sequence
  Synthetic oligonucleotide
ttgtcatgcagtcacgttcccgtaccaccctgatg

SEQ ID NO: 202098 - DNA, 35 bp, Artificial Sequence
  Synthetic oligonucleotide
acttgcatgtagagccgcttgagccacccttacct

SEQ ID NO: 202099 - DNA, 35 bp, Artificial Sequence
  Synthetic oligonucleotide
tgttcgacatgtgcttattctcgacctacacccct

SEQ ID NO: 202100 - DNA, 36 bp, Artificial Sequence
  Synthetic oligonucleotide
tgagaggggggacatgtgggggacgatacgcttcaa

SEQ ID NO: 202101 - DNA, 36 bp, Artificial Sequence
  Synthetic oligonucleotide
gacgctcgacggggcgggagaggggaggggatcgaa

SEQ ID NO: 202102 - DNA, 36 bp, Artificial Sequence
  Synthetic oligonucleotide
ttccaccagactgccgtgcgcattaactgtcctcca

SEQ ID NO: 202103 - DNA, 37 bp, Artificial Sequence
  Synthetic oligonucleotide
gagccaaaagggggcgtgggaggagcggacgcgaaga

SEQ ID NO: 202104 - DNA, 35 bp, Artificial Sequence
  Synthetic oligonucleotide
gcctcgatccgcttttgtaccctctccgctgaaga

SEQ ID NO: 202105 - DNA, 37 bp, Artificial Sequence
  Synthetic oligonucleotide
atgtccctcctgtgcactaacccttgttcgctcgcga

SEQ ID NO: 202106 - DNA, 38 bp, Artificial Sequence
  Synthetic oligonucleotide
acaaccgccctctcgtgtcccccggtgttttaacctga

SEQ ID NO: 202107 - DNA, 38 bp, Artificial Sequence
  Synthetic oligonucleotide
aagggaggccaagggagcagagtaagggcgaggtctga

SEQ ID NO: 202108 - DNA, 38 bp, Artificial Sequence
  Synthetic oligonucleotide
tgtaaagcacggggacaaggggatggacggtacggtga

SEQ ID NO: 202109 - DNA, 38 bp, Artificial Sequence
  Synthetic oligonucleotide
gtactcccacttggactcccccccctccgccccggtga

SEQ ID NO: 202110 - DNA, 38 bp, Artificial Sequence
  Synthetic oligonucleotide
tgactgtgtcagccctccatcccgcctgcatgcattga

SEQ ID NO: 202111 - DNA, 35 bp, Artificial Sequence
  Synthetic oligonucleotide
gccacgacctgctcgacaccaatccccggtttcac

SEQ ID NO: 202112 - DNA, 35 bp, Artificial Sequence
  Synthetic oligonucleotide
atccatgccctcgagccaccttaagatcactagac

SEQ ID NO: 202113 - DNA, 35 bp, Artificial Sequence
  Synthetic oligonucleotide
tgtcccccgaccagttcttgcctttgttaccttcc

SEQ ID NO: 202114 - DNA, 35 bp, Artificial Sequence
  Synthetic oligonucleotide
gacactgcagatccggtttccgtgccacttcctgc

SEQ ID NO: 202115 - DNA, 35 bp, Artificial Sequence
  Synthetic oligonucleotide
gtcaccgctagtcgggttgacttactcgtgccctc

SEQ ID NO: 202116 - DNA, 35 bp, Artificial Sequence
  Synthetic oligonucleotide
gctggtggtcggtctttataatgcgtcacaccttc

SEQ ID NO: 202117 - DNA, 35 bp, Artificial Sequence
  Synthetic oligonucleotide
agaggggaggcggtagtacgtggcgctgaggtttc

SEQ ID NO: 202118 - DNA, 35 bp, Artificial Sequence
  Synthetic oligonucleotide
gtgagggtgcgagactgaaagggagggtagtgaag

SEQ ID NO: 202119 - DNA, 35 bp, Artificial Sequence
  Synthetic oligonucleotide
gacgggggcgagagtatgatggggcgggagaatag

SEQ ID NO: 202120 - DNA, 35 bp, Artificial Sequence
  Synthetic oligonucleotide
atggtgaagcgggggggcgtggtaaaaattggacg

SEQ ID NO: 202121 - DNA, 35 bp, Artificial Sequence
  Synthetic oligonucleotide
acgcgaggacagtgggggaacaaggctagaggtgg

SEQ ID NO: 202122 - DNA, 35 bp, Artificial Sequence
  Synthetic oligonucleotide
tcaccagtctcaacgcgtttgcactccctactctg

SEQ ID NO: 202123 - DNA, 35 bp, Artificial Sequence
  Synthetic oligonucleotide
gatcgcaaaggcggaccaaggaagggctgatggtg

SEQ ID NO: 202124 - DNA, 35 bp, Artificial Sequence
  Synthetic oligonucleotide
tcattcatgtgcccttgtccttcaaccttggcttg

SEQ ID NO: 202125 - DNA, 35 bp, Artificial Sequence
  Synthetic oligonucleotide
atccccctgctggctgcgcgaattgccccccaaat

SEQ ID NO: 202126 - DNA, 35 bp, Artificial Sequence
  Synthetic oligonucleotide
aaacacgcgaggagggacggggagagctgattcat

SEQ ID NO: 202127 - DNA, 35 bp, Artificial Sequence
  Synthetic oligonucleotide
tacttggccagtggtacccgtccgcccagttttat

SEQ ID NO: 202128 - DNA, 35 bp, Artificial Sequence
  Synthetic oligonucleotide
tagtccaccactgtcagtcccgtcttctgcctact

SEQ ID NO: 202129 - DNA, 35 bp, Artificial Sequence
  Synthetic oligonucleotide
acatcattcgcattccgttgggatcatcatccatt

SEQ ID NO: 202130 - DNA, 36 bp, Artificial Sequence
  Synthetic oligonucleotide
tcagggggggaatcagcaacgggatacgggacgaca

SEQ ID NO: 202131 - DNA, 36 bp, Artificial Sequence
  Synthetic oligonucleotide
tgttacgcccgacggtatcttggcccccgttcctca

SEQ ID NO: 202132 - DNA, 37 bp, Artificial Sequence
  Synthetic oligonucleotide
acaaacgacgaggggaggagaagggtgtgatccacga

SEQ ID NO: 202133 - DNA, 36 bp, Artificial Sequence
  Synthetic oligonucleotide
ggagacggggaaaggaatgagacgcggagaggacga

SEQ ID NO: 202134 - DNA, 35 bp, Artificial Sequence
  Synthetic oligonucleotide
gctcagcccggcacctcttacgacacactctgcga

SEQ ID NO: 202135 - DNA, 37 bp, Artificial Sequence
  Synthetic oligonucleotide
gagcgggcggaaagggaaggggatccaagaggtagga

SEQ ID NO: 202136 - DNA, 36 bp, Artificial Sequence
  Synthetic oligonucleotide
tcccagcgcagatccattttgcctcttctcttagga

SEQ ID NO: 202137 - DNA, 37 bp, Artificial Sequence
  Synthetic oligonucleotide
tcgggtgttggaggaacgggcggatacggggctggga

SEQ ID NO: 202138 - DNA, 38 bp, Artificial Sequence
  Synthetic oligonucleotide
acacaggtgcaaaggggaaagggaatgagggggcatga

SEQ ID NO: 202139 - DNA, 38 bp, Artificial Sequence
  Synthetic oligonucleotide
gagcggagcagggaaatgggagcaatggttgaaagtga

SEQ ID NO: 202140 - DNA, 37 bp, Artificial Sequence
  Synthetic oligonucleotide
ggacaccaaagacggggggacgagatgtagggagtga

SEQ ID NO: 202141 - DNA, 38 bp, Artificial Sequence
  Synthetic oligonucleotide
gcacatcctgcctaattagccaccccacacccgcttga

SEQ ID NO: 202142 - DNA, 35 bp, Artificial Sequence
  Synthetic oligonucleotide
tactccgcccgctgaaacatgccacacttacggta

SEQ ID NO: 202143 - DNA, 35 bp, Artificial Sequence
  Synthetic oligonucleotide
tgcaacacctcgacgtccaccgtgcacactttgta

SEQ ID NO: 202144 - DNA, 35 bp, Artificial Sequence
  Synthetic oligonucleotide
gaacgcggaggtgggaaggagagaaagtaagacac

SEQ ID NO: 202145 - DNA, 35 bp, Artificial Sequence
  Synthetic oligonucleotide
ttgacgggtctgcccttctttggtaaccggtaccc

SEQ ID NO: 202146 - DNA, 35 bp, Artificial Sequence
  Synthetic oligonucleotide
ttgcgtgtcgagtgatgttcgtcccaaccacctcc

SEQ ID NO: 202147 - DNA, 35 bp, Artificial Sequence
  Synthetic oligonucleotide
tacacgcctcctgaacttacctagccggatctagc

SEQ ID NO: 202148 - DNA, 35 bp, Artificial Sequence
  Synthetic oligonucleotide
accagtccctgcagccgccctacattactatgtgc

SEQ ID NO: 202149 - DNA, 35 bp, Artificial Sequence
  Synthetic oligonucleotide
gcaacagacactggcataccgcgttccatcacatc

SEQ ID NO: 202150 - DNA, 35 bp, Artificial Sequence
  Synthetic oligonucleotide
gtccggactccggctacttctccatgacgcacttc

SEQ ID NO: 202151 - DNA, 35 bp, Artificial Sequence
  Synthetic oligonucleotide
acgtactcacctagatcagccatgagctcccgttc

SEQ ID NO: 202152 - DNA, 35 bp, Artificial Sequence
  Synthetic oligonucleotide
gatgggtggggggagagggcatccggaccgtcaag

SEQ ID NO: 202153 - DNA, 35 bp, Artificial Sequence
  Synthetic oligonucleotide
gacacgggagagacgttcggggaaaaggagtgtag

SEQ ID NO: 202154 - DNA, 35 bp, Artificial Sequence
  Synthetic oligonucleotide
agactacatccgttcccctgtcccgcccagccttg

SEQ ID NO: 202155 - DNA, 35 bp, Artificial Sequence
  Synthetic oligonucleotide
actgctcgccgcaactttgcctgctgtctcttcat

SEQ ID NO: 202156 - DNA, 35 bp, Artificial Sequence
  Synthetic oligonucleotide
gaacatcggcacctggtcctacatctccacttgat

SEQ ID NO: 202157 - DNA, 35 bp, Artificial Sequence
  Synthetic oligonucleotide
tacgtagcccgccattccacaagtccacatcccgt

SEQ ID NO: 202158 - DNA, 35 bp, Artificial Sequence
  Synthetic oligonucleotide
tcccgtgggaacccgatgccctgcccctcctcctt

SEQ ID NO: 202159 - DNA, 36 bp, Artificial Sequence
  Synthetic oligonucleotide
tgatgcgggggagtatcacaggagggtgggggacaa

SEQ ID NO: 202160 - DNA, 35 bp, Artificial Sequence
  Synthetic oligonucleotide
acacgccacagggcgtaatagctcgcccactccaa

SEQ ID NO: 202161 - DNA, 36 bp, Artificial Sequence
  Synthetic oligonucleotide
ggacccgtcaaacgtcgccattattgcacttcacca

SEQ ID NO: 202162 - DNA, 35 bp, Artificial Sequence
  Synthetic oligonucleotide
tcaaacaccgtccgagtttacgttctcactgccca

SEQ ID NO: 202163 - DNA, 35 bp, Artificial Sequence
  Synthetic oligonucleotide
tgattgcacgtcggaattacactacaccacctgca

SEQ ID NO: 202164 - DNA, 36 bp, Artificial Sequence
  Synthetic oligonucleotide
gcgcacgatcacgtgtcttggccttcctactattca

SEQ ID NO: 202165 - DNA, 37 bp, Artificial Sequence
  Synthetic oligonucleotide
ggtgggagcaaggagcgtggtagaagtttcgcgcaga

SEQ ID NO: 202166 - DNA, 37 bp, Artificial Sequence
  Synthetic oligonucleotide
agtgacggggggagattggggctcgtagatagtgcga

SEQ ID NO: 202167 - DNA, 28 bp, Artificial Sequence
  Synthetic oligonucleotide
atccacgcccatcccccattcgccctga

SEQ ID NO: 202168 - DNA, 37 bp, Artificial Sequence
  Synthetic oligonucleotide
aacgggccaacagaggggcggtgggagtgaggcttga

SEQ ID NO: 202169 - DNA, 35 bp, Artificial Sequence
  Synthetic oligonucleotide
gtatgctgacaggtgggggggaggataggtaatta

SEQ ID NO: 202170 - DNA, 35 bp, Artificial Sequence
  Synthetic oligonucleotide
tagttcgccccatccgcccttagcccgctttgtta

SEQ ID NO: 202171 - DNA, 35 bp, Artificial Sequence
  Synthetic oligonucleotide
atcaatgcatgcccattcgttatccatgattcacc

SEQ ID NO: 202172 - DNA, 35 bp, Artificial Sequence
  Synthetic oligonucleotide
gggggggaggggggggtaagcacagacaagttcag

SEQ ID NO: 202173 - DNA, 35 bp, Artificial Sequence
  Synthetic oligonucleotide
agtgcacccgttcgatccagatgctaccttccacg

SEQ ID NO: 202174 - DNA, 35 bp, Artificial Sequence
  Synthetic oligonucleotide
tcaccaactgcggttactatatgtactccttccat

SEQ ID NO: 202175 - DNA, 35 bp, Artificial Sequence
  Synthetic oligonucleotide
gtgcgattcctcggcgtatctaggccatccgccct

SEQ ID NO: 202176 - DNA, 35 bp, Artificial Sequence
  Synthetic oligonucleotide
atcagggggggggtgggttgggacatagagagcgt

SEQ ID NO: 202177 - DNA, 36 bp, Artificial Sequence
  Synthetic oligonucleotide
ttgggtgggcaggagagggagaaggttgtcggtaaa

SEQ ID NO: 202178 - DNA, 34 bp, Artificial Sequence
  Synthetic oligonucleotide
gtccccacagtgatgttcctgcccgtcttctcaa

SEQ ID NO: 202179 - DNA, 36 bp, Artificial Sequence
  Synthetic oligonucleotide
gtgggcctcagctctatctcattgttccggctttaa

SEQ ID NO: 202180 - DNA, 36 bp, Artificial Sequence
  Synthetic oligonucleotide
ggactagcccccgcggccactttcctttcctcgcca

SEQ ID NO: 202181 - DNA, 36 bp, Artificial Sequence
  Synthetic oligonucleotide
actgtgcaccgcctcccggtaatatttgcactttca

SEQ ID NO: 202182 - DNA, 35 bp, Artificial Sequence
  Synthetic oligonucleotide
taagggtgggggggcgaagggtatagaatctttca

SEQ ID NO: 202183 - DNA, 37 bp, Artificial Sequence
  Synthetic oligonucleotide
actggtagtcccaaggggaggagggcaagggaggaga

SEQ ID NO: 202184 - DNA, 37 bp, Artificial Sequence
  Synthetic oligonucleotide
gcaccgctgcccgtgtttgaggccacacccctctcga

SEQ ID NO: 202185 - DNA, 37 bp, Artificial Sequence
  Synthetic oligonucleotide
agtcacctctcctctgctccctttgacatctggtcga

SEQ ID NO: 202186 - DNA, 37 bp, Artificial Sequence
  Synthetic oligonucleotide
tcatcagacctacatgtttcatccatttccctacgga

SEQ ID NO: 202187 - DNA, 37 bp, Artificial Sequence
  Synthetic oligonucleotide
aagagccaagcggagaggtagtagataggggtgcgga

SEQ ID NO: 202188 - DNA, 35 bp, Artificial Sequence
  Synthetic oligonucleotide
gccatctatcacctccctatgtacgtgcatcctga

SEQ ID NO: 202189 - DNA, 36 bp, Artificial Sequence
  Synthetic oligonucleotide
ttggagagcgggtggttgggtcgaacatgccaaata

SEQ ID NO: 202190 - DNA, 35 bp, Artificial Sequence
  Synthetic oligonucleotide
gacacctccactggcgaaagaaaggactacctccc

SEQ ID NO: 202191 - DNA, 35 bp, Artificial Sequence
  Synthetic oligonucleotide
tgacatgcctaccctgttcagttcacggcattccc

SEQ ID NO: 202192 - DNA, 35 bp, Artificial Sequence
  Synthetic oligonucleotide
actagccaccccgctccgtacaggacgctacctgc

SEQ ID NO: 202193 - DNA, 35 bp, Artificial Sequence
  Synthetic oligonucleotide
gttcaacgcccatgtatcgtttttccgctccgttc

SEQ ID NO: 202194 - DNA, 35 bp, Artificial Sequence
  Synthetic oligonucleotide
tgctggagcaaagaaaagggagcagggggtaacgt

SEQ ID NO: 202195 - DNA, 35 bp, Artificial Sequence
  Synthetic oligonucleotide
ggtcgccctcaatccgtctctatgtcctagcgtgt

SEQ ID NO: 202196 - DNA, 36 bp, Artificial Sequence
  Synthetic oligonucleotide
accaccgaaggtagggaaaacggaggagcggggaca

SEQ ID NO: 202197 - DNA, 35 bp, Artificial Sequence
  Synthetic oligonucleotide
taatccgccatctgctgccacaacctcttgcacca

SEQ ID NO: 202198 - DNA, 31 bp, Artificial Sequence
  Synthetic oligonucleotide
acaggatccgccgccctttatacttgcctca

SEQ ID NO: 202199 - DNA, 37 bp, Artificial Sequence
  Synthetic oligonucleotide
gttccaccacatccgcatattctagcccgttcggaga

SEQ ID NO: 202200 - DNA, 37 bp, Artificial Sequence
  Synthetic oligonucleotide
aagggccgggtgggtcacgtaaaaatggggtcgtaga

SEQ ID NO: 202201 - DNA, 36 bp, Artificial Sequence
  Synthetic oligonucleotide
tacgcacctcagttcctccgcctatctgttccacga

SEQ ID NO: 202202 - DNA, 35 bp, Artificial Sequence
  Synthetic oligonucleotide
tgcacaggtggagaagtgagaggaaaaagggcgga

SEQ ID NO: 202203 - DNA, 37 bp, Artificial Sequence
  Synthetic oligonucleotide
gtgaggggtagagggtggagtaactgtgatacaggga

SEQ ID NO: 202204 - DNA, 36 bp, Artificial Sequence
  Synthetic oligonucleotide
ggtcaaaggaggaggcaagaaagagtgacagagtga

SEQ ID NO: 202205 - DNA, 38 bp, Artificial Sequence
  Synthetic oligonucleotide
attgggagggcggtcgattcgtgagtatgggagggtga

SEQ ID NO: 202206 - DNA, 38 bp, Artificial Sequence
  Synthetic oligonucleotide
ggggcggggacagctggtgttcaaggtacagggggtga

SEQ ID NO: 202207 - DNA, 35 bp, Artificial Sequence
  Synthetic oligonucleotide
gttgcacttcacactatgcctaacgacttcccata

SEQ ID NO: 202208 - DNA, 36 bp, Artificial Sequence
  Synthetic oligonucleotide
gcgtgctcgctatatgtccacgctccactcgcctta

SEQ ID NO: 202209 - DNA, 35 bp, Artificial Sequence
  Synthetic oligonucleotide
acacacccggcgatggtccccccaccccaatctta

SEQ ID NO: 202210 - DNA, 35 bp, Artificial Sequence
  Synthetic oligonucleotide
gagggagcaactagcggagggggttaggacggtac

SEQ ID NO: 202211 - DNA, 35 bp, Artificial Sequence
  Synthetic oligonucleotide
tcccacgccacagcctcgaaagaagccctggtacc

SEQ ID NO: 202212 - DNA, 35 bp, Artificial Sequence
  Synthetic oligonucleotide
aactcccgctccatgcgtctcccagcacctctgcc

SEQ ID NO: 202213 - DNA, 35 bp, Artificial Sequence
  Synthetic oligonucleotide
gactccctccttaagtatgttcacttgctccgtgc

SEQ ID NO: 202214 - DNA, 35 bp, Artificial Sequence
  Synthetic oligonucleotide
tactccagccctcctcctgcaaatgcaatcgtacg

SEQ ID NO: 202215 - DNA, 34 bp, Artificial Sequence
  Synthetic oligonucleotide
tgcgcagggagggcggggacgttgggtggtaccg

SEQ ID NO: 202216 - DNA, 35 bp, Artificial Sequence
  Synthetic oligonucleotide
gccatccagccgtccattccgacataatgctgtcg

SEQ ID NO: 202217 - DNA, 35 bp, Artificial Sequence
  Synthetic oligonucleotide
tcaagggggtcaagaaaagggggggagaattgcgg

SEQ ID NO: 202218 - DNA, 35 bp, Artificial Sequence
  Synthetic oligonucleotide
gacctccaacactcgcaccttcaccccctaccggg

SEQ ID NO: 202219 - DNA, 35 bp, Artificial Sequence
  Synthetic oligonucleotide
tctggagccctcgatcacccacgcccataccgatg

SEQ ID NO: 202220 - DNA, 35 bp, Artificial Sequence
  Synthetic oligonucleotide
gtggacgatgagcaagggagtgagggggcccgaat

SEQ ID NO: 202221 - DNA, 35 bp, Artificial Sequence
  Synthetic oligonucleotide
ggtgcaacgcaatcataaatgcatctgtactccct

SEQ ID NO: 202222 - DNA, 35 bp, Artificial Sequence
  Synthetic oligonucleotide
attgcaccaggccatcgcttgcattatacctccct

SEQ ID NO: 202223 - DNA, 35 bp, Artificial Sequence
  Synthetic oligonucleotide
agacgggggcacatgagacgggcaagagggggggt

SEQ ID NO: 202224 - DNA, 35 bp, Artificial Sequence
  Synthetic oligonucleotide
aacgccgcgcaaattgcatctcgcacgcctttctt

SEQ ID NO: 202225 - DNA, 35 bp, Artificial Sequence
  Synthetic oligonucleotide
acgccacaccaatgctccagttaacccgcactttt

SEQ ID NO: 202226 - DNA, 35 bp, Artificial Sequence
  Synthetic oligonucleotide
tagcgaaagccctcgccgttattccttccctgaaa

SEQ ID NO: 202227 - DNA, 36 bp, Artificial Sequence
  Synthetic oligonucleotide
tagggagggccaaagcgttagaagggggctgaggaa

SEQ ID NO: 202228 - DNA, 36 bp, Artificial Sequence
  Synthetic oligonucleotide
aacaaaggcgggaggaggacacaagagaaggagtaa

SEQ ID NO: 202229 - DNA, 36 bp, Artificial Sequence
  Synthetic oligonucleotide
attgcacctcctgtcggttataccaagctcactaca

SEQ ID NO: 202230 - DNA, 36 bp, Artificial Sequence
  Synthetic oligonucleotide
ccgcatgtcccaccaccatatgtgactgaaatccca

SEQ ID NO: 202231 - DNA, 36 bp, Artificial Sequence
  Synthetic oligonucleotide
ttcgtagcgcactattcccatctctggcgacgatca

SEQ ID NO: 202232 - DNA, 36 bp, Artificial Sequence
  Synthetic oligonucleotide
ggatgggaggatgacaaggagggacgtgctgaacga

SEQ ID NO: 202233 - DNA, 37 bp, Artificial Sequence
  Synthetic oligonucleotide
gaccacacgttacctgacgtttatgttctcccttcga

SEQ ID NO: 202234 - DNA, 36 bp, Artificial Sequence
  Synthetic oligonucleotide
gtacgaggaggagagcggcttgagagaatgatcgga

SEQ ID NO: 202235 - DNA, 37 bp, Artificial Sequence
  Synthetic oligonucleotide
ggggacagtcaggaggacggaggcagaataacgtgga

SEQ ID NO: 202236 - DNA, 37 bp, Artificial Sequence
  Synthetic oligonucleotide
gcgagagcacgtcgggaggtagggggggggacgtgga

SEQ ID NO: 202237 - DNA, 38 bp, Artificial Sequence
  Synthetic oligonucleotide
gaaaacgaacgagtaaggggaggcagagctacatatga

SEQ ID NO: 202238 - DNA, 37 bp, Artificial Sequence
  Synthetic oligonucleotide
aaagccgggtgggatcgggtgaagggagccgggctga

SEQ ID NO: 202239 - DNA, 38 bp, Artificial Sequence
  Synthetic oligonucleotide
gagtgattgggaagtcggggagatggaggtgcacgtga

SEQ ID NO: 202240 - DNA, 36 bp, Artificial Sequence
  Synthetic oligonucleotide
tggggagggcaaggaaggtaaggggcagacctgtga

SEQ ID NO: 202241 - DNA, 37 bp, Artificial Sequence
  Synthetic oligonucleotide
gtctgcaccatccgtccccaagttgcctgtgcattga

SEQ ID NO: 202242 - DNA, 38 bp, Artificial Sequence
  Synthetic oligonucleotide
gaactgcgcacacgtttttctattcgtccccacgttga

SEQ ID NO: 202243 - DNA, 35 bp, Artificial Sequence
  Synthetic oligonucleotide
gacgggagggaacggaggggggtgttaagtaacta

SEQ ID NO: 202244 - DNA, 35 bp, Artificial Sequence
  Synthetic oligonucleotide
gaaggggggttcaaaatctgggggcggggttcaac

SEQ ID NO: 202245 - DNA, 35 bp, Artificial Sequence
  Synthetic oligonucleotide
tacagacaggacatggaaggcaggagatagacacg

SEQ ID NO: 202246 - DNA, 35 bp, Artificial Sequence
  Synthetic oligonucleotide
tgctaccgtgggggagggaggaatggagacttgcg

SEQ ID NO: 202247 - DNA, 35 bp, Artificial Sequence
  Synthetic oligonucleotide
tcaacaatgctgatttctccctacccccctcctcg

SEQ ID NO: 202248 - DNA, 35 bp, Artificial Sequence
  Synthetic oligonucleotide
accgccctacaatgtaaagtatcccgccctggtcg

SEQ ID NO: 202249 - DNA, 32 bp, Artificial Sequence
  Synthetic oligonucleotide
acacgcacgagggaaagctgggtcaaggggtg

SEQ ID NO: 202250 - DNA, 35 bp, Artificial Sequence
  Synthetic oligonucleotide
ttgtccccacagatgtttcattcgtctgccacaat

SEQ ID NO: 202251 - DNA, 35 bp, Artificial Sequence
  Synthetic oligonucleotide
gcacagtcgcgggatgtcgtgggtggagagggcat

SEQ ID NO: 202252 - DNA, 35 bp, Artificial Sequence
  Synthetic oligonucleotide
tatccatgcggtccatgcgactggcgcactctcct

SEQ ID NO: 202253 - DNA, 35 bp, Artificial Sequence
  Synthetic oligonucleotide
atcacgtccaccctttgtctaataccccactacgt

SEQ ID NO: 202254 - DNA, 35 bp, Artificial Sequence
  Synthetic oligonucleotide
gttctcccagcatcgttcctggtccgcttcctgtt

SEQ ID NO: 202255 - DNA, 35 bp, Artificial Sequence
  Synthetic oligonucleotide
agtacgcacatccgtccttcaccctttcctcataa

SEQ ID NO: 202256 - DNA, 36 bp, Artificial Sequence
  Synthetic oligonucleotide
ggaaccaaccacatgtcacatccttcctcccgataa

SEQ ID NO: 202257 - DNA, 35 bp, Artificial Sequence
  Synthetic oligonucleotide
tacacagtgggaggacgggtaaaacggggcgttaa

SEQ ID NO: 202258 - DNA, 35 bp, Artificial Sequence
  Synthetic oligonucleotide
acccacccagatatgcccctgccaggtgctcagca

SEQ ID NO: 202259 - DNA, 36 bp, Artificial Sequence
  Synthetic oligonucleotide
gcatcgatgagggaggaaagggatggaaagcagcga

SEQ ID NO: 202260 - DNA, 38 bp, Artificial Sequence
  Synthetic oligonucleotide
ggggagggcaaacagtttgaggggagggagcaccgcga

SEQ ID NO: 202261 - DNA, 37 bp, Artificial Sequence
  Synthetic oligonucleotide
gacgggaagcggttgagttgcaaagggcagggcggga

SEQ ID NO: 202262 - DNA, 38 bp, Artificial Sequence
  Synthetic oligonucleotide
ggacgggagtaggggtgcagataacggcatcggaatga

SEQ ID NO: 202263 - DNA, 38 bp, Artificial Sequence
  Synthetic oligonucleotide
cccggaggggcgtacgaaaagagggagggaatgaatga

SEQ ID NO: 202264 - DNA, 38 bp, Artificial Sequence
  Synthetic oligonucleotide
ggtcaagcctccactgtgtcctatggcccccgtactga

SEQ ID NO: 202265 - DNA, 38 bp, Artificial Sequence
  Synthetic oligonucleotide
gtgagcaggaggacaggggggagttggataagatttga

SEQ ID NO: 202266 - DNA, 36 bp, Artificial Sequence
  Synthetic oligonucleotide
gaggaaaggggaggggtggcatgacatagtatgata

SEQ ID NO: 202267 - DNA, 36 bp, Artificial Sequence
  Synthetic oligonucleotide
gcgaagagagagaaggtaggagcgatggggtaagta

SEQ ID NO: 202268 - DNA, 34 bp, Artificial Sequence
  Synthetic oligonucleotide
tccaccctctatgccccggacggcttctcgaagc

SEQ ID NO: 202269 - DNA, 29 bp, Artificial Sequence
  Synthetic oligonucleotide
ttgccctcccggtaattcctgtctttcgc

SEQ ID NO: 202270 - DNA, 35 bp, Artificial Sequence
  Synthetic oligonucleotide
ttgcccgccccccattccgtagttgttttgaccct

SEQ ID NO: 202271 - DNA, 35 bp, Artificial Sequence
  Synthetic oligonucleotide
tgactcaccctccgctctggacgtgactgtcccct

SEQ ID NO: 202272 - DNA, 35 bp, Artificial Sequence
  Synthetic oligonucleotide
gtggtccaactgtacacttcgttcttaagtttcct

SEQ ID NO: 202273 - DNA, 35 bp, Artificial Sequence
  Synthetic oligonucleotide
gcctctcacacgtactatctccccctcttttaggt

SEQ ID NO: 202274 - DNA, 35 bp, Artificial Sequence
  Synthetic oligonucleotide
gcatctacgctgggtgggttcgggaaaagttgggt

SEQ ID NO: 202275 - DNA, 36 bp, Artificial Sequence
  Synthetic oligonucleotide
gcgattccacccgctctcgatcctatattgtacgaa

SEQ ID NO: 202276 - DNA, 35 bp, Artificial Sequence
  Synthetic oligonucleotide
agtacgccgttgcctccttccgacacactcttcca

SEQ ID NO: 202277 - DNA, 35 bp, Artificial Sequence
  Synthetic oligonucleotide
gaaacggaggggggggaatacgaaattaaatagca

SEQ ID NO: 202278 - DNA, 35 bp, Artificial Sequence
  Synthetic oligonucleotide
gcagaagcagtggccaaaggggggagtaagaatca

SEQ ID NO: 202279 - DNA, 35 bp, Artificial Sequence
  Synthetic oligonucleotide
gagagcgggggacgaatggaggaacaaggcgtaga

SEQ ID NO: 202280 - DNA, 36 bp, Artificial Sequence
  Synthetic oligonucleotide
tcagtccatcactcaccccgtcgcgcccaccattga

SEQ ID NO: 202281 - DNA, 37 bp, Artificial Sequence
  Synthetic oligonucleotide
gtccgggccgtgccgcctgccttaactaacctcttga

SEQ ID NO: 202282 - DNA, 35 bp, Artificial Sequence
  Synthetic oligonucleotide
gacaacgcaaatgcatacatggagggagggggata

SEQ ID NO: 202283 - DNA, 35 bp, Artificial Sequence
  Synthetic oligonucleotide
tacgggagggaacggaggggggggttaagtaacta

SEQ ID NO: 202284 - DNA, 35 bp, Artificial Sequence
  Synthetic oligonucleotide
acaccttgcgcctcatttttgacagtctgctccac

SEQ ID NO: 202285 - DNA, 35 bp, Artificial Sequence
  Synthetic oligonucleotide
ttcgcgcgacatcgatcgcggcatatttactcccc

SEQ ID NO: 202286 - DNA, 35 bp, Artificial Sequence
  Synthetic oligonucleotide
gctcagcgggtgtgcatgggcgggtgggcctgtcg

SEQ ID NO: 202287 - DNA, 35 bp, Artificial Sequence
  Synthetic oligonucleotide
tgtgcccctgccattgctccactcatctacgcttg

SEQ ID NO: 202288 - DNA, 35 bp, Artificial Sequence
  Synthetic oligonucleotide
actgactgcctccagacgctccccctttgttcttg

SEQ ID NO: 202289 - DNA, 35 bp, Artificial Sequence
  Synthetic oligonucleotide
ttgcctagcatgcttacctacggagtcttcgccat

SEQ ID NO: 202290 - DNA, 35 bp, Artificial Sequence
  Synthetic oligonucleotide
atgcaagaaggccagaggaaaaatgaggggcgcat

SEQ ID NO: 202291 - DNA, 35 bp, Artificial Sequence
  Synthetic oligonucleotide
atcaccacgcaccaccgctaacgagagcctggact

SEQ ID NO: 202292 - DNA, 35 bp, Artificial Sequence
  Synthetic oligonucleotide
ttacgcgccgttatgtgcttattcacccactcgct

SEQ ID NO: 202293 - DNA, 35 bp, Artificial Sequence
  Synthetic oligonucleotide
gtgcacgtacttgctctcacagtcggcgtttctct

SEQ ID NO: 202294 - DNA, 36 bp, Artificial Sequence
  Synthetic oligonucleotide
acacgccggtagacggtaggggtggaagggagacaa

SEQ ID NO: 202295 - DNA, 35 bp, Artificial Sequence
  Synthetic oligonucleotide
atcccagcaatcagacccccgtgccccctccccaa

SEQ ID NO: 202296 - DNA, 35 bp, Artificial Sequence
  Synthetic oligonucleotide
atggtggagggggagggagggacaggctagagaca

SEQ ID NO: 202297 - DNA, 35 bp, Artificial Sequence
  Synthetic oligonucleotide
gcgcaactgtcatcattcatccgccgcccgagcca

SEQ ID NO: 202298 - DNA, 37 bp, Artificial Sequence
  Synthetic oligonucleotide
gggggggtgggtaggggggacaagatacaggtccaga

SEQ ID NO: 202299 - DNA, 37 bp, Artificial Sequence
  Synthetic oligonucleotide
tcgaaggcgggaggggaggtagcacatgaatcgacga

SEQ ID NO: 202300 - DNA, 37 bp, Artificial Sequence
  Synthetic oligonucleotide
atgtagcgcagaggagggcggggagaaatggggggga

SEQ ID NO: 202301 - DNA, 35 bp, Artificial Sequence
  Synthetic oligonucleotide
gtgcaccccccacatttagcaagcactccgttgga

SEQ ID NO: 202302 - DNA, 36 bp, Artificial Sequence
  Synthetic oligonucleotide
tccaccgctgctcgccccctcatgccaagacccgta

SEQ ID NO: 202303 - DNA, 35 bp, Artificial Sequence
  Synthetic oligonucleotide
gatgccagaagggagaaatgagggggcgggactta

SEQ ID NO: 202304 - DNA, 35 bp, Artificial Sequence
  Synthetic oligonucleotide
tataccaccgaagtggcgcaatactacagttcccc

SEQ ID NO: 202305 - DNA, 35 bp, Artificial Sequence
  Synthetic oligonucleotide
gtacacccggttctgtattgctgtaattatcgccc

SEQ ID NO: 202306 - DNA, 35 bp, Artificial Sequence
  Synthetic oligonucleotide
gtgtgccacaactcggttcgagacaccacttgccc

SEQ ID NO: 202307 - DNA, 35 bp, Artificial Sequence
  Synthetic oligonucleotide
tgtatcgtcaacgcgtgcaacccctactcgctccc

SEQ ID NO: 202308 - DNA, 29 bp, Artificial Sequence
  Synthetic oligonucleotide
atgtgacatctcagccggttccttgctcc

SEQ ID NO: 202309 - DNA, 35 bp, Artificial Sequence
  Synthetic oligonucleotide
ttgatccacttgtctgactttctgcttagttcctc

SEQ ID NO: 202310 - DNA, 35 bp, Artificial Sequence
  Synthetic oligonucleotide
gccgggagggtgggtagagctattgagcggcttag

SEQ ID NO: 202311 - DNA, 35 bp, Artificial Sequence
  Synthetic oligonucleotide
taaatgcagggggaaggacaagttgaacggggacg

SEQ ID NO: 202312 - DNA, 35 bp, Artificial Sequence
  Synthetic oligonucleotide
gctcacagttaaagtaggggacgcgtggagggggg

SEQ ID NO: 202313 - DNA, 35 bp, Artificial Sequence
  Synthetic oligonucleotide
actcgccgcctttcacccaaggtctgtcattccat

SEQ ID NO: 202314 - DNA, 35 bp, Artificial Sequence
  Synthetic oligonucleotide
tgtacgcctccgagcggagattcgtacgtttccat

SEQ ID NO: 202315 - DNA, 35 bp, Artificial Sequence
  Synthetic oligonucleotide
aatgccaccatacattgtgatattgcgctccacct

SEQ ID NO: 202316 - DNA, 35 bp, Artificial Sequence
  Synthetic oligonucleotide
attgccgccaccttacctcctgctgaattcatttt

SEQ ID NO: 202317 - DNA, 35 bp, Artificial Sequence
  Synthetic oligonucleotide
acccgctccaacttatgccttgtaagtcgttacaa

SEQ ID NO: 202318 - DNA, 35 bp, Artificial Sequence
  Synthetic oligonucleotide
taggcgagacactgagggggggggatagtgggcaa

SEQ ID NO: 202319 - DNA, 37 bp, Artificial Sequence
  Synthetic oligonucleotide
taccggccggggggggggtaaaatgctggggagggaa

SEQ ID NO: 202320 - DNA, 36 bp, Artificial Sequence
  Synthetic oligonucleotide
gttcccctgccgcctctcatttcaaccactgccgca

SEQ ID NO: 202321 - DNA, 37 bp, Artificial Sequence
  Synthetic oligonucleotide
actcgggggccccacatttctcgctcgtctcatccga

SEQ ID NO: 202322 - DNA, 37 bp, Artificial Sequence
  Synthetic oligonucleotide
acagacagagcggaggagatcttactgaaaaggggga

SEQ ID NO: 202323 - DNA, 35 bp, Artificial Sequence
  Synthetic oligonucleotide
tcgatccgagccccccctgcatcatgtaccagtcc

SEQ ID NO: 202324 - DNA, 35 bp, Artificial Sequence
  Synthetic oligonucleotide
gaccgccatcctctcgcccaagagactaatgcatc

SEQ ID NO: 202325 - DNA, 35 bp, Artificial Sequence
  Synthetic oligonucleotide
acctgcccattccttctgtacgtgaacgcctaacg

SEQ ID NO: 202326 - DNA, 35 bp, Artificial Sequence
  Synthetic oligonucleotide
gcatcaacgtactgctgcaacctactccaactttg

SEQ ID NO: 202327 - DNA, 35 bp, Artificial Sequence
  Synthetic oligonucleotide
actcatccgccaactgttccatctgccacattact

SEQ ID NO: 202328 - DNA, 35 bp, Artificial Sequence
  Synthetic oligonucleotide
atgactcgcacgcttggtcccaatgacacgtccct

SEQ ID NO: 202329 - DNA, 35 bp, Artificial Sequence
  Synthetic oligonucleotide
acaccggcacatgatcgttatggcgccttcccgtt

SEQ ID NO: 202330 - DNA, 35 bp, Artificial Sequence
  Synthetic oligonucleotide
ggagggccagggggggaagaacgctgatatcgcaa

SEQ ID NO: 202331 - DNA, 36 bp, Artificial Sequence
  Synthetic oligonucleotide
gcagacgcagggggctagaggggacgcgcgggagaa

SEQ ID NO: 202332 - DNA, 35 bp, Artificial Sequence
  Synthetic oligonucleotide
gatgggggaaggcaggagaggggaaggtggaggca

SEQ ID NO: 202333 - DNA, 35 bp, Artificial Sequence
  Synthetic oligonucleotide
gcagtgcaaacgaagacggggaaaggcgggatgca

SEQ ID NO: 202334 - DNA, 35 bp, Artificial Sequence
  Synthetic oligonucleotide
gccattcgcactgtagaccattcccattgtaatca

SEQ ID NO: 202335 - DNA, 35 bp, Artificial Sequence
  Synthetic oligonucleotide
gccaagcgccgttttcggtatcgcgttcctactca

SEQ ID NO: 202336 - DNA, 37 bp, Artificial Sequence
  Synthetic oligonucleotide
agacggggtgggagaactggggaagcgcgcgagacga

SEQ ID NO: 202337 - DNA, 36 bp, Artificial Sequence
  Synthetic oligonucleotide
tgttacgcgcatcactcatctcggcctggcttacga

SEQ ID NO: 202338 - DNA, 37 bp, Artificial Sequence
  Synthetic oligonucleotide
gcacggtcgtaggggaggaagcggaggttcgcacgga

SEQ ID NO: 202339 - DNA, 35 bp, Artificial Sequence
  Synthetic oligonucleotide
tgtgaagaacggctgggataaaggaaggacgggga

SEQ ID NO: 202340 - DNA, 37 bp, Artificial Sequence
  Synthetic oligonucleotide
gtctgcctgccgtgtttaccatcaccctcaccctgga

SEQ ID NO: 202341 - DNA, 35 bp, Artificial Sequence
  Synthetic oligonucleotide
gtggtggaggagggggctgaaggccaggatctgga

SEQ ID NO: 202342 - DNA, 35 bp, Artificial Sequence
  Synthetic oligonucleotide
tgcaacaaccggaatcccccactgtaccctgctga

SEQ ID NO: 202343 - DNA, 38 bp, Artificial Sequence
  Synthetic oligonucleotide
gcaacgaagggaggggaaagaaggggctacatggttga

SEQ ID NO: 202344 - DNA, 35 bp, Artificial Sequence
  Synthetic oligonucleotide
gagttgcaggcgtacctgatctgctctctgttacc

SEQ ID NO: 202345 - DNA, 35 bp, Artificial Sequence
  Synthetic oligonucleotide
gatggtcacatgcgtacggccttatgtacacctcc

SEQ ID NO: 202346 - DNA, 35 bp, Artificial Sequence
  Synthetic oligonucleotide
aacacttcaccatgcctcacgcaaggcctcgttcc

SEQ ID NO: 202347 - DNA, 35 bp, Artificial Sequence
  Synthetic oligonucleotide
tatcgtcaccgccctaccgtagtgtaaaccgctgc

SEQ ID NO: 202348 - DNA, 35 bp, Artificial Sequence
  Synthetic oligonucleotide
aacgacgcacacatggcctccaagacactccgctc

SEQ ID NO: 202349 - DNA, 35 bp, Artificial Sequence
  Synthetic oligonucleotide
gcgggatgggacggggggggagtgaggcataaaag

SEQ ID NO: 202350 - DNA, 35 bp, Artificial Sequence
  Synthetic oligonucleotide
ggagggagtgaaccggcgaaaaagagggggagtcg

SEQ ID NO: 202351 - DNA, 35 bp, Artificial Sequence
  Synthetic oligonucleotide
tacagaaaggcggggggcaaaagcagctatatggg

SEQ ID NO: 202352 - DNA, 35 bp, Artificial Sequence
  Synthetic oligonucleotide
agacctgctttgaccgttatctacctgcccttgct

SEQ ID NO: 202353 - DNA, 35 bp, Artificial Sequence
  Synthetic oligonucleotide
tgcacaaccctccggctctgtattcgctcaacggt

SEQ ID NO: 202354 - DNA, 36 bp, Artificial Sequence
  Synthetic oligonucleotide
gcatgcaaggggggggagagcatccaggcgataaaa

SEQ ID NO: 202355 - DNA, 36 bp, Artificial Sequence
  Synthetic oligonucleotide
aatgacgggtcgggtgggcgaggctcggcacggtaa

SEQ ID NO: 202356 - DNA, 37 bp, Artificial Sequence
  Synthetic oligonucleotide
atgtcagtgcatcttgtccgcgttcattgctccacga

SEQ ID NO: 202357 - DNA, 37 bp, Artificial Sequence
  Synthetic oligonucleotide
tcgccgcccgcccgaccatctttctcactgtgaccga

SEQ ID NO: 202358 - DNA, 37 bp, Artificial Sequence
  Synthetic oligonucleotide
tgagcacagtgaagggagtagaggggttgtacatgga

SEQ ID NO: 202359 - DNA, 35 bp, Artificial Sequence
  Synthetic oligonucleotide
gactccaccgctctgccctggcgtattttgctatc

SEQ ID NO: 202360 - DNA, 34 bp, Artificial Sequence
  Synthetic oligonucleotide
gcaccgccgtatctgacgcgaatcactcagcctc

SEQ ID NO: 202361 - DNA, 35 bp, Artificial Sequence
  Synthetic oligonucleotide
acgcacgcccaaacgatcacaaacgtctcgctccg

SEQ ID NO: 202362 - DNA, 35 bp, Artificial Sequence
  Synthetic oligonucleotide
ttgtagggcagggagctacaagccaagggggggcg

SEQ ID NO: 202363 - DNA, 35 bp, Artificial Sequence
  Synthetic oligonucleotide
tgcactagacggagaggggaatgaaggggggggcg

SEQ ID NO: 202364 - DNA, 35 bp, Artificial Sequence
  Synthetic oligonucleotide
acgcaccacctaacatgttcgccgttccgctcttg

SEQ ID NO: 202365 - DNA, 35 bp, Artificial Sequence
  Synthetic oligonucleotide
aagcggggtacggaaggtgtgtgggttgcgtacat

SEQ ID NO: 202366 - DNA, 36 bp, Artificial Sequence
  Synthetic oligonucleotide
gctgcatatcagcttactcacccccgtactcccgaa

SEQ ID NO: 202367 - DNA, 35 bp, Artificial Sequence
  Synthetic oligonucleotide
tagtcacgcggattgttctcacttgccccttccca

SEQ ID NO: 202368 - DNA, 36 bp, Artificial Sequence
  Synthetic oligonucleotide
ttcccgacaatgtagctcgtcatccctccttcgcca

SEQ ID NO: 202369 - DNA, 37 bp, Artificial Sequence
  Synthetic oligonucleotide
gtggggaggggatcgtgatgtggagggtagggcgaga

SEQ ID NO: 202370 - DNA, 36 bp, Artificial Sequence
  Synthetic oligonucleotide
gcgcaatgcctgcctttcattcttcgcctagtacga

SEQ ID NO: 202371 - DNA, 35 bp, Artificial Sequence
  Synthetic oligonucleotide
gacgggagggaacggagggggtggttaagtaacta

SEQ ID NO: 202372 - DNA, 35 bp, Artificial Sequence
  Synthetic oligonucleotide
gcctctcgtcaggctgtctacactctcggttccac

SEQ ID NO: 202373 - DNA, 35 bp, Artificial Sequence
  Synthetic oligonucleotide
tacgccgactggtatcacccgcttgctcactcgac

SEQ ID NO: 202374 - DNA, 35 bp, Artificial Sequence
  Synthetic oligonucleotide
tcactcctcgcctaaggtcgaatgacggtttcacc

SEQ ID NO: 202375 - DNA, 35 bp, Artificial Sequence
  Synthetic oligonucleotide
gatggaaggagggggaaaagaccggagttccgacc

SEQ ID NO: 202376 - DNA, 35 bp, Artificial Sequence
  Synthetic oligonucleotide
tcacgccttacgcgaggcttccttttttccggttc

SEQ ID NO: 202377 - DNA, 35 bp, Artificial Sequence
  Synthetic oligonucleotide
tgccacccacctctattgtcagacccatctacccg

SEQ ID NO: 202378 - DNA, 35 bp, Artificial Sequence
  Synthetic oligonucleotide
acacatctccgccagcttgtttcgatccatttcca

SEQ ID NO: 202379 - DNA, 35 bp, Artificial Sequence
  Synthetic oligonucleotide
acacagtcgccgtaggtcccgcgcattccgacgca

SEQ ID NO: 202380 - DNA, 37 bp, Artificial Sequence
  Synthetic oligonucleotide
gtgggaagtcgtccgggcgggtactgggatagaaaga

SEQ ID NO: 202381 - DNA, 37 bp, Artificial Sequence
  Synthetic oligonucleotide
gtgtccgagctggaatgggagtggtgaggcgggacga

SEQ ID NO: 202382 - DNA, 37 bp, Artificial Sequence
  Synthetic oligonucleotide
gaccaccttcattgtcccagaccacgctatttctcga

SEQ ID NO: 202383 - DNA, 37 bp, Artificial Sequence
  Synthetic oligonucleotide
atcaatgtgagggggggagaagacagtgtggtgggga

SEQ ID NO: 202384 - DNA, 37 bp, Artificial Sequence
  Synthetic oligonucleotide
gagggggggcggtcgtgtagaagaggttggtgtggga

SEQ ID NO: 202385 - DNA, 38 bp, Artificial Sequence
  Synthetic oligonucleotide
gtcgagggtctggtgtgcgggagggaaccacgagctga

SEQ ID NO: 202386 - DNA, 38 bp, Artificial Sequence
  Synthetic oligonucleotide
gacggaggaacgggtggggacataatgggatgatctga

SEQ ID NO: 202387 - DNA, 37 bp, Artificial Sequence
  Synthetic oligonucleotide
tagaccagcgcgtttgttcctcctctcgtcctagtga

SEQ ID NO: 202388 - DNA, 35 bp, Artificial Sequence
  Synthetic oligonucleotide
gatgcgctgcatggttggtcgctcttctatctgta

SEQ ID NO: 202389 - DNA, 36 bp, Artificial Sequence
  Synthetic oligonucleotide
ttggagggcggttgaaggcgcgtggacgggacatta

SEQ ID NO: 202390 - DNA, 36 bp, Artificial Sequence
  Synthetic oligonucleotide
tgcgcactcacactgggtcccggccctccatactta

SEQ ID NO: 202391 - DNA, 36 bp, Artificial Sequence
  Synthetic oligonucleotide
tgcgggtggagcgggtgggtgaatgaggccgcctta

SEQ ID NO: 202392 - DNA, 35 bp, Artificial Sequence
  Synthetic oligonucleotide
atgttcaccgcactgtacaacgtttgggctcatac

SEQ ID NO: 202393 - DNA, 35 bp, Artificial Sequence
  Synthetic oligonucleotide
gatacgaccgttggtcattgtccgcctgtcccgcc

SEQ ID NO: 202394 - DNA, 35 bp, Artificial Sequence
  Synthetic oligonucleotide
acccgccgcctggtcgttcacgccttttatgggcg

SEQ ID NO: 202395 - DNA, 35 bp, Artificial Sequence
  Synthetic oligonucleotide
ttcacctccccatgcactcgatctgatccaggcat

SEQ ID NO: 202396 - DNA, 35 bp, Artificial Sequence
  Synthetic oligonucleotide
gatacatccgatagccttccgtccctgtcgtgcct

SEQ ID NO: 202397 - DNA, 35 bp, Artificial Sequence
  Synthetic oligonucleotide
tcacgctgtcgcccctgttctgctctggtctactt

SEQ ID NO: 202398 - DNA, 36 bp, Artificial Sequence
  Synthetic oligonucleotide
ttgacagggaagggcgaggggagggcgggcgcgtaa

SEQ ID NO: 202399 - DNA, 37 bp, Artificial Sequence
  Synthetic oligonucleotide
acgaggacgcaggggaggcaacgaagggagataaaga

SEQ ID NO: 202400 - DNA, 37 bp, Artificial Sequence
  Synthetic oligonucleotide
tctgacgacgtcagcctgcccatagttcctccatcga

SEQ ID NO: 202401 - DNA, 35 bp, Artificial Sequence
  Synthetic oligonucleotide
taaagcggaggtaggggatagggcaatgcgatcga

SEQ ID NO: 202402 - DNA, 36 bp, Artificial Sequence
  Synthetic oligonucleotide
accaccgcacccgtgtcggccacttcgactattcga

SEQ ID NO: 202403 - DNA, 35 bp, Artificial Sequence
  Synthetic oligonucleotide
tatgcctatcctcccccgtgtccccctgtgccgga

SEQ ID NO: 202404 - DNA, 36 bp, Artificial Sequence
  Synthetic oligonucleotide
gactacgccgtggtgcccctcttcagatcacttgga

SEQ ID NO: 202405 - DNA, 38 bp, Artificial Sequence
  Synthetic oligonucleotide
aaaggaggcggatgggacgtggtgtgggcggatcttga

SEQ ID NO: 202406 - DNA, 38 bp, Artificial Sequence
  Synthetic oligonucleotide
actgtaaacgggatgggagtggggggtaggagttttga

SEQ ID NO: 202407 - DNA, 35 bp, Artificial Sequence
  Synthetic oligonucleotide
gacgcctgtccggtcgcgttatatccccggctttc

SEQ ID NO: 202408 - DNA, 35 bp, Artificial Sequence
  Synthetic oligonucleotide
aaacagcgcaggacgggggttaggggcgagtgaag

SEQ ID NO: 202409 - DNA, 35 bp, Artificial Sequence
  Synthetic oligonucleotide
gtcgacccatccctgcattatgctttaagcccacg

SEQ ID NO: 202410 - DNA, 33 bp, Artificial Sequence
  Synthetic oligonucleotide
acacgccgtccccatccgtgatccacttctctg

SEQ ID NO: 202411 - DNA, 35 bp, Artificial Sequence
  Synthetic oligonucleotide
acactcccgatgcgctacgttactccctctccttg

SEQ ID NO: 202412 - DNA, 35 bp, Artificial Sequence
  Synthetic oligonucleotide
tcagccactatatcgccggttcagtcccagtttat

SEQ ID NO: 202413 - DNA, 35 bp, Artificial Sequence
  Synthetic oligonucleotide
acaccaggctcaaattgttaacctcatcacgtcct

SEQ ID NO: 202414 - DNA, 35 bp, Artificial Sequence
  Synthetic oligonucleotide
gctgtcgcgcagaccgagttgtttcggcaccctct

SEQ ID NO: 202415 - DNA, 35 bp, Artificial Sequence
  Synthetic oligonucleotide
aacatagtaggaaaacggggtatacgggatagggt

SEQ ID NO: 202416 - DNA, 35 bp, Artificial Sequence
  Synthetic oligonucleotide
tcactcatcaccgtctgtttttctctcgcccatgt

SEQ ID NO: 202417 - DNA, 35 bp, Artificial Sequence
  Synthetic oligonucleotide
gtccccgcagacccccaaagctatatcgctatatt

SEQ ID NO: 202418 - DNA, 36 bp, Artificial Sequence
  Synthetic oligonucleotide
gtagagggaggtaaaggaccggggtagggaagcgaa

SEQ ID NO: 202419 - DNA, 35 bp, Artificial Sequence
  Synthetic oligonucleotide
gattcactgtccgacttcctgctcattccagatca

SEQ ID NO: 202420 - DNA, 37 bp, Artificial Sequence
  Synthetic oligonucleotide
ggtcgagggaaggccatataagggagcggtagacaga

SEQ ID NO: 202421 - DNA, 37 bp, Artificial Sequence
  Synthetic oligonucleotide
gtagcagagggagagaaatagcacggggaggggacga

SEQ ID NO: 202422 - DNA, 37 bp, Artificial Sequence
  Synthetic oligonucleotide
ggtggtggagggggagtagaaccgtgataagctccga

SEQ ID NO: 202423 - DNA, 37 bp, Artificial Sequence
  Synthetic oligonucleotide
tgttgcccccctcattttcatgcacgtgtcctgctga

SEQ ID NO: 202424 - DNA, 38 bp, Artificial Sequence
  Synthetic oligonucleotide
tgaaggcaaatgtcaaagggaggtggacgggggagtga

SEQ ID NO: 202425 - DNA, 38 bp, Artificial Sequence
  Synthetic oligonucleotide
gaagagcggagggcggtttgagggagtttgagcggtga

SEQ ID NO: 202426 - DNA, 35 bp, Artificial Sequence
  Synthetic oligonucleotide
gcataagtccacttgtaccttgtgaacacctccta

SEQ ID NO: 202427 - DNA, 36 bp, Artificial Sequence
  Synthetic oligonucleotide
aacgcgatcctacggtttgtcgagtcttccttctta

SEQ ID NO: 202428 - DNA, 35 bp, Artificial Sequence
  Synthetic oligonucleotide
aacgcatgtacggactgcagggaatagggctacac

SEQ ID NO: 202429 - DNA, 35 bp, Artificial Sequence
  Synthetic oligonucleotide
ggacctcccgtcatactttccagtctctaccctcg

SEQ ID NO: 202430 - DNA, 35 bp, Artificial Sequence
  Synthetic oligonucleotide
atgccccgcccattttataccgacctccctaacgg

SEQ ID NO: 202431 - DNA, 35 bp, Artificial Sequence
  Synthetic oligonucleotide
tccatggacaccccgttacgtatccgcccgccgat

SEQ ID NO: 202432 - DNA, 35 bp, Artificial Sequence
  Synthetic oligonucleotide
tatgcccaacgctgcagcatttgtccacgccttct

SEQ ID NO: 202433 - DNA, 35 bp, Artificial Sequence
  Synthetic oligonucleotide
tcaccccacacctctgctagcatcccatcgccctt

SEQ ID NO: 202434 - DNA, 36 bp, Artificial Sequence
  Synthetic oligonucleotide
gaagacagggtagggtagcaaagagagtgtcagcaa

SEQ ID NO: 202435 - DNA, 36 bp, Artificial Sequence
  Synthetic oligonucleotide
atgggcgggaacggaggggaaaaggaaggatgagaa

SEQ ID NO: 202436 - DNA, 37 bp, Artificial Sequence
  Synthetic oligonucleotide
gaggagggccaagggtgatgtaaggagatagtagaga

SEQ ID NO: 202437 - DNA, 37 bp, Artificial Sequence
  Synthetic oligonucleotide
gaggagcgagggagcggggcggaagagtacagttaga

SEQ ID NO: 202438 - DNA, 38 bp, Artificial Sequence
  Synthetic oligonucleotide
gatgagcaaggtgaagtaggaggcggtgatgtatgtga

SEQ ID NO: 202439 - DNA, 37 bp, Artificial Sequence
  Synthetic oligonucleotide
gccacagtcgccccatggtgactttgcctctttttga

SEQ ID NO: 202440 - DNA, 35 bp, Artificial Sequence
  Synthetic oligonucleotide
tagaacagtcggcatatcggcgcgccttactttcc

SEQ ID NO: 202441 - DNA, 35 bp, Artificial Sequence
  Synthetic oligonucleotide
gacacgtcaactaccgcgcctgtggacttctttcc

SEQ ID NO: 202442 - DNA, 35 bp, Artificial Sequence
  Synthetic oligonucleotide
aaaggcacaacgtggggaaggatgagggggggagc

SEQ ID NO: 202443 - DNA, 35 bp, Artificial Sequence
  Synthetic oligonucleotide
tgccacactcctcctgtttgctttgccccgcatgc

SEQ ID NO: 202444 - DNA, 35 bp, Artificial Sequence
  Synthetic oligonucleotide
tccgtccctcaaatgtgtctcgcctgtgtatgctc

SEQ ID NO: 202445 - DNA, 35 bp, Artificial Sequence
  Synthetic oligonucleotide
aaatgccccgtccaccatctttcagcgatttcgcg

SEQ ID NO: 202446 - DNA, 35 bp, Artificial Sequence
  Synthetic oligonucleotide
gatgtgcgtgaacagcaaatagaagggggcaaagg

SEQ ID NO: 202447 - DNA, 35 bp, Artificial Sequence
  Synthetic oligonucleotide
atgtcacgccgagttcctagtatggtgcctcccct

SEQ ID NO: 202448 - DNA, 35 bp, Artificial Sequence
  Synthetic oligonucleotide
tgtatcgcaggccaccgcaccttgttccgccaatt

SEQ ID NO: 202449 - DNA, 36 bp, Artificial Sequence
  Synthetic oligonucleotide
acccccaccatcccgtatcactgctgtctcgatgaa

SEQ ID NO: 202450 - DNA, 36 bp, Artificial Sequence
  Synthetic oligonucleotide
gtggtgacagggttgaaggaacggcgggagtgctaa

SEQ ID NO: 202451 - DNA, 36 bp, Artificial Sequence
  Synthetic oligonucleotide
gctgatcggccgtcaccttacaccctggctttgtaa

SEQ ID NO: 202452 - DNA, 37 bp, Artificial Sequence
  Synthetic oligonucleotide
gaaattgggccgaaaggggggtggggttggggaacga

SEQ ID NO: 202453 - DNA, 35 bp, Artificial Sequence
  Synthetic oligonucleotide
gtggagcgaatgcgcgtccttttgttcctgttcga

SEQ ID NO: 202454 - DNA, 37 bp, Artificial Sequence
  Synthetic oligonucleotide
agcccgcgggcatggggagggagagtcgtacgggtga

SEQ ID NO: 202455 - DNA, 38 bp, Artificial Sequence
  Synthetic oligonucleotide
ttgaccatctcacctgcttatatgtcacggttttgtga

SEQ ID NO: 202456 - DNA, 37 bp, Artificial Sequence
  Synthetic oligonucleotide
taggggaggaggtcgtgaaggagggcgggcgggttga

SEQ ID NO: 202457 - DNA, 36 bp, Artificial Sequence
  Synthetic oligonucleotide
tcatgggtaaaagaagggggttaggcgggtagggta

SEQ ID NO: 202458 - DNA, 35 bp, Artificial Sequence
  Synthetic oligonucleotide
tagtccgtccccatcactttaacagatgtgtctcc

SEQ ID NO: 202459 - DNA, 35 bp, Artificial Sequence
  Synthetic oligonucleotide
gacaacgtgcgtatcgtatgggcctcatttcttcc

SEQ ID NO: 202460 - DNA, 35 bp, Artificial Sequence
  Synthetic oligonucleotide
aatgtgggtaacagggcgggaaagggagggtgaag

SEQ ID NO: 202461 - DNA, 35 bp, Artificial Sequence
  Synthetic oligonucleotide
acagaccggagacgcatggaggaacgtagggatgt

SEQ ID NO: 202462 - DNA, 36 bp, Artificial Sequence
  Synthetic oligonucleotide
gtgcactccgacacacctgccaacacactgctcaaa

SEQ ID NO: 202463 - DNA, 35 bp, Artificial Sequence
  Synthetic oligonucleotide
gttgcgggggagtgtaggacggggcggagaagaaa

SEQ ID NO: 202464 - DNA, 36 bp, Artificial Sequence
  Synthetic oligonucleotide
tagcgacgggcagagcgggggggtgaacatgcggaa

SEQ ID NO: 202465 - DNA, 36 bp, Artificial Sequence
  Synthetic oligonucleotide
tcgatcggcgcacatggcaccttccccattccttca

SEQ ID NO: 202466 - DNA, 37 bp, Artificial Sequence
  Synthetic oligonucleotide
gtcccgccgccctgcataagagcctctatgccgccga

SEQ ID NO: 202467 - DNA, 35 bp, Artificial Sequence
  Synthetic oligonucleotide
atcggagggcggagaatgtggaagggggggctgga

SEQ ID NO: 202468 - DNA, 35 bp, Artificial Sequence
  Synthetic oligonucleotide
tcacgcaccgactgccttccgccatatccagtgga

SEQ ID NO: 202469 - DNA, 36 bp, Artificial Sequence
  Synthetic oligonucleotide
gatgtacagggcggaaggaaaagggggtcacggtga

SEQ ID NO: 202470 - DNA, 38 bp, Artificial Sequence
  Synthetic oligonucleotide
gggaggggagtaagcaggacggatagtgaagagattga

SEQ ID NO: 202471 - DNA, 35 bp, Artificial Sequence
  Synthetic oligonucleotide
gtccccggtgcaccctgtttcgtcccctgctttga

SEQ ID NO: 202472 - DNA, 36 bp, Artificial Sequence
  Synthetic oligonucleotide
gtcggggccgccatgcaattgactccctgttcctta

SEQ ID NO: 202473 - DNA, 35 bp, Artificial Sequence
  Synthetic oligonucleotide
tatagcccaggtgtacctgttccgtgtccgttaac

SEQ ID NO: 202474 - DNA, 35 bp, Artificial Sequence
  Synthetic oligonucleotide
gtgcaaagctgcccccctcgagatcgccacggtac

SEQ ID NO: 202475 - DNA, 35 bp, Artificial Sequence
  Synthetic oligonucleotide
aaacacaactgcgttccaggtaccaccccgctgcc

SEQ ID NO: 202476 - DNA, 35 bp, Artificial Sequence
  Synthetic oligonucleotide
atgactgtgccgcttgcactgagacatcccttctc

SEQ ID NO: 202477 - DNA, 35 bp, Artificial Sequence
  Synthetic oligonucleotide
aacacgcgcgtcgattctacgtaatcgtcaccttc

SEQ ID NO: 202478 - DNA, 35 bp, Artificial Sequence
  Synthetic oligonucleotide
taagcggtcgactcacctgagctttctgccactct

SEQ ID NO: 202479 - DNA, 35 bp, Artificial Sequence
  Synthetic oligonucleotide
ggaggagcaagaaggacatggcagataagagaggt

SEQ ID NO: 202480 - DNA, 35 bp, Artificial Sequence
  Synthetic oligonucleotide
tactgaggaacggaaagggaacaactggttgagaa

SEQ ID NO: 202481 - DNA, 36 bp, Artificial Sequence
  Synthetic oligonucleotide
tgcatcccacatcggtaattgttctctgtatgctca

SEQ ID NO: 202482 - DNA, 36 bp, Artificial Sequence
  Synthetic oligonucleotide
ggtcggaggaggagcgtactgcagcgatcggggaga

SEQ ID NO: 202483 - DNA, 36 bp, Artificial Sequence
  Synthetic oligonucleotide
gtggacggtagaaggggcttgggaggcgtgagacga

SEQ ID NO: 202484 - DNA, 37 bp, Artificial Sequence
  Synthetic oligonucleotide
tagcctccgcagcggatatcacagcctctcctttcga

SEQ ID NO: 202485 - DNA, 37 bp, Artificial Sequence
  Synthetic oligonucleotide
tacgcgcgtagggggaaaggggggagaacaatacgga

SEQ ID NO: 202486 - DNA, 37 bp, Artificial Sequence
  Synthetic oligonucleotide
atgcaagaagaggaggagaagcagtgtcaacgcgtga

SEQ ID NO: 202487 - DNA, 38 bp, Artificial Sequence
  Synthetic oligonucleotide
gagctgagcacgaggagggaatagggggggtcgattga

SEQ ID NO: 202488 - DNA, 35 bp, Artificial Sequence
  Synthetic oligonucleotide
agtccatagcgtagtgctgcttaatttaacccctc

SEQ ID NO: 202489 - DNA, 35 bp, Artificial Sequence
  Synthetic oligonucleotide
ttgtacagggaaggatgaacgtgtgggaaggggag

SEQ ID NO: 202490 - DNA, 35 bp, Artificial Sequence
  Synthetic oligonucleotide
tgacgcctagcgaatgttctcacgacttccttccg

SEQ ID NO: 202491 - DNA, 35 bp, Artificial Sequence
  Synthetic oligonucleotide
gcaacagggggaagtggagggttctggcggggggg

SEQ ID NO: 202492 - DNA, 35 bp, Artificial Sequence
  Synthetic oligonucleotide
tacatacaggggtcagttatgtgagggagggtggg

SEQ ID NO: 202493 - DNA, 35 bp, Artificial Sequence
  Synthetic oligonucleotide
tcacaccacctaacatgttcgccgttccgctcttg

SEQ ID NO: 202494 - DNA, 35 bp, Artificial Sequence
  Synthetic oligonucleotide
acactcgggcaatatgtgggaggggaatagggact

SEQ ID NO: 202495 - DNA, 35 bp, Artificial Sequence
  Synthetic oligonucleotide
atgctcatcacatctcgtacgatcaagccttctaa

SEQ ID NO: 202496 - DNA, 37 bp, Artificial Sequence
  Synthetic oligonucleotide
gtgacgggtaaggggtgtatggagctgatggtagaga

SEQ ID NO: 202497 - DNA, 35 bp, Artificial Sequence
  Synthetic oligonucleotide
gggagggtcgggtcggggatagatagaccacacga

SEQ ID NO: 202498 - DNA, 36 bp, Artificial Sequence
  Synthetic oligonucleotide
aatccacctcgtgcctcctcgttcatttgccttcga

SEQ ID NO: 202499 - DNA, 37 bp, Artificial Sequence
  Synthetic oligonucleotide
tgtccgcggggagggaatgggagggcgagaagcggga

SEQ ID NO: 202500 - DNA, 37 bp, Artificial Sequence
  Synthetic oligonucleotide
gactggggtagacgtcggttaggggcggggtgatgga

SEQ ID NO: 202501 - DNA, 36 bp, Artificial Sequence
  Synthetic oligonucleotide
tagcgaacgacagggcattagggaaggtggtttgga

SEQ ID NO: 202502 - DNA, 38 bp, Artificial Sequence
  Synthetic oligonucleotide
tgcctgtcttagcccacttcgctcctgtatctgattga

SEQ ID NO: 202503 - DNA, 38 bp, Artificial Sequence
  Synthetic oligonucleotide
gacacctacgtgagattgtatccctccacctctcttga

SEQ ID NO: 202504 - DNA, 35 bp, Artificial Sequence
  Synthetic oligonucleotide
gtacccgccgggatattactgacccattttccgac

SEQ ID NO: 202505 - DNA, 35 bp, Artificial Sequence
  Synthetic oligonucleotide
gccgcctggcaccgaactgcgaggtcacctattgc

SEQ ID NO: 202506 - DNA, 35 bp, Artificial Sequence
  Synthetic oligonucleotide
gttgtgctcggcgtgcgattctttggcctgctgtc

SEQ ID NO: 202507 - DNA, 35 bp, Artificial Sequence
  Synthetic oligonucleotide
taacaggggaacaggcgaaggaaaggcatcagtcg

SEQ ID NO: 202508 - DNA, 35 bp, Artificial Sequence
  Synthetic oligonucleotide
gacgcgagagagcggaatggtgcgagggatcgggg

SEQ ID NO: 202509 - DNA, 35 bp, Artificial Sequence
  Synthetic oligonucleotide
acacctccgagccttgagacctctagaactgcctg

SEQ ID NO: 202510 - DNA, 35 bp, Artificial Sequence
  Synthetic oligonucleotide
ttggatcaccgtctcgtccgtccacatgtatcatt

SEQ ID NO: 202511 - DNA, 37 bp, Artificial Sequence
  Synthetic oligonucleotide
tcagcacatccgttgtccctcttgcactgtctcgaga

SEQ ID NO: 202512 - DNA, 37 bp, Artificial Sequence
  Synthetic oligonucleotide
gacaacaggcggaggggatgatggatggggagtgcga

SEQ ID NO: 202513 - DNA, 37 bp, Artificial Sequence
  Synthetic oligonucleotide
atggatggtcatacggagggaggagggacaaagggga

SEQ ID NO: 202514 - DNA, 36 bp, Artificial Sequence
  Synthetic oligonucleotide
atacagcgacgggagggggagattatggagggtgga

SEQ ID NO: 202515 - DNA, 38 bp, Artificial Sequence
  Synthetic oligonucleotide
gtcatactctcgcaatgtgcttcccactaccttcctga

SEQ ID NO: 202516 - DNA, 35 bp, Artificial Sequence
  Synthetic oligonucleotide
tccagccccatttctatagacactgtcccgtcacc

SEQ ID NO: 202517 - DNA, 35 bp, Artificial Sequence
  Synthetic oligonucleotide
gtccgccccatctcctgttaccgaagcgcatttgc

SEQ ID NO: 202518 - DNA, 35 bp, Artificial Sequence
  Synthetic oligonucleotide
taccacctcttccgtccgtttgacacggcttggtc

SEQ ID NO: 202519 - DNA, 35 bp, Artificial Sequence
  Synthetic oligonucleotide
gaggaatcaagcgggagaagggtgcggcagtctag

SEQ ID NO: 202520 - DNA, 35 bp, Artificial Sequence
  Synthetic oligonucleotide
tactgacacgcgttcccgtttattccattcctccg

SEQ ID NO: 202521 - DNA, 35 bp, Artificial Sequence
  Synthetic oligonucleotide
tcatcacccgcccggatgagctgttcaggctcaaa

SEQ ID NO: 202522 - DNA, 35 bp, Artificial Sequence
  Synthetic oligonucleotide
gtggcggaggctgggggtggatggagggcaatcaa

SEQ ID NO: 202523 - DNA, 38 bp, Artificial Sequence
  Synthetic oligonucleotide
ggagtagtcgcagatgtcttccctgctccccttcctga

SEQ ID NO: 202524 - DNA, 38 bp, Artificial Sequence
  Synthetic oligonucleotide
atgggctaggaagagagtacggggcaggcgggaagtga

SEQ ID NO: 202525 - DNA, 36 bp, Artificial Sequence
  Synthetic oligonucleotide
acacgtgcctgtccattctgtctactgttgccacta

SEQ ID NO: 202526 - DNA, 35 bp, Artificial Sequence
  Synthetic oligonucleotide
gcaaacgtccgtagtattccgtcaccgcgtcctcc

SEQ ID NO: 202527 - DNA, 35 bp, Artificial Sequence
  Synthetic oligonucleotide
tcagccctccctctagccgttggtactcgcccctc

SEQ ID NO: 202528 - DNA, 35 bp, Artificial Sequence
  Synthetic oligonucleotide
accgaccgccgtagttaaatcgtcatcctttcaag

SEQ ID NO: 202529 - DNA, 35 bp, Artificial Sequence
  Synthetic oligonucleotide
tgaccacagacgtattactcggcaatcccgccccg

SEQ ID NO: 202530 - DNA, 35 bp, Artificial Sequence
  Synthetic oligonucleotide
ggtggagcgccgcatctattattgtcacttttccg

SEQ ID NO: 202531 - DNA, 35 bp, Artificial Sequence
  Synthetic oligonucleotide
tatgcccagattgtgttctcgctccccccttcttg

SEQ ID NO: 202532 - DNA, 27 bp, Artificial Sequence
  Synthetic oligonucleotide
tagtgatctccacctgcccgcacccat

SEQ ID NO: 202533 - DNA, 35 bp, Artificial Sequence
  Synthetic oligonucleotide
gaaaggatcagtgcggggaggatagggtggaagct

SEQ ID NO: 202534 - DNA, 35 bp, Artificial Sequence
  Synthetic oligonucleotide
gaggacacgagagggtgggtagaccgtgggaaagt

SEQ ID NO: 202535 - DNA, 36 bp, Artificial Sequence
  Synthetic oligonucleotide
gccggaagggggaatggatccaagggggggagggaa

SEQ ID NO: 202536 - DNA, 35 bp, Artificial Sequence
  Synthetic oligonucleotide
acccccgccatagcctttgacgtctgtggagcaga

SEQ ID NO: 202537 - DNA, 37 bp, Artificial Sequence
  Synthetic oligonucleotide
gtaaacgacggggtggataaactgaaggggggggaga

SEQ ID NO: 202538 - DNA, 36 bp, Artificial Sequence
  Synthetic oligonucleotide
tcaagcgcacagaatgggacggtacggtgggtggga

SEQ ID NO: 202539 - DNA, 35 bp, Artificial Sequence
  Synthetic oligonucleotide
tccgatctcggatgcgtccaccgaccgtctcaccc

SEQ ID NO: 202540 - DNA, 35 bp, Artificial Sequence
  Synthetic oligonucleotide
tatgtgccacagttgagtcatgattacgccctccg

SEQ ID NO: 202541 - DNA, 35 bp, Artificial Sequence
  Synthetic oligonucleotide
tgagcaggaggaagtggtggaggagagtgaacggg

SEQ ID NO: 202542 - DNA, 35 bp, Artificial Sequence
  Synthetic oligonucleotide
gacgacgttctctttgctacatttacacctccggt

SEQ ID NO: 202543 - DNA, 35 bp, Artificial Sequence
  Synthetic oligonucleotide
gaatcgaggaggggggggagatcgccagctggaaa

SEQ ID NO: 202544 - DNA, 35 bp, Artificial Sequence
  Synthetic oligonucleotide
accgcgctgttcctgctgattgatctcgttccgca

SEQ ID NO: 202545 - DNA, 37 bp, Artificial Sequence
  Synthetic oligonucleotide
gagtgcctcgggatgggactgggacgggaaccataga

SEQ ID NO: 202546 - DNA, 38 bp, Artificial Sequence
  Synthetic oligonucleotide
gaagagggtgggaaggcgtaaaggtgccagagaggtga

SEQ ID NO: 202547 - DNA, 37 bp, Artificial Sequence
  Synthetic oligonucleotide
tgacgaagacagaacggagtatggcgggggttattga

SEQ ID NO: 202548 - DNA, 36 bp, Artificial Sequence
  Synthetic oligonucleotide
gacggagtaaggcgggagtggggtattagtcagata

SEQ ID NO: 202549 - DNA, 35 bp, Artificial Sequence
  Synthetic oligonucleotide
gaccccactatgatccttccattcggacggtgtta

SEQ ID NO: 202550 - DNA, 34 bp, Artificial Sequence
  Synthetic oligonucleotide
gatccaccacctagattgtcacgcataggctatc

SEQ ID NO: 202551 - DNA, 35 bp, Artificial Sequence
  Synthetic oligonucleotide
acaactgggacagaggtaaaagtgggagggatcag

SEQ ID NO: 202552 - DNA, 35 bp, Artificial Sequence
  Synthetic oligonucleotide
gtatcgatcacgtgtgcctccctcgactactgccg

SEQ ID NO: 202553 - DNA, 35 bp, Artificial Sequence
  Synthetic oligonucleotide
gcaacagccaattcttccctctatacgcgtgtaat

SEQ ID NO: 202554 - DNA, 35 bp, Artificial Sequence
  Synthetic oligonucleotide
gatacatacgatagccttccgtccctgccgtgcct

SEQ ID NO: 202555 - DNA, 35 bp, Artificial Sequence
  Synthetic oligonucleotide
gaacgggcgttggctgtgggtggggatgggactgt

SEQ ID NO: 202556 - DNA, 36 bp, Artificial Sequence
  Synthetic oligonucleotide
tagtacatggtccgccgcctattcgagtgcactgca

SEQ ID NO: 202557 - DNA, 36 bp, Artificial Sequence
  Synthetic oligonucleotide
gtccacccgtttcagtcgcgcccagccactactcga

SEQ ID NO: 202558 - DNA, 37 bp, Artificial Sequence
  Synthetic oligonucleotide
gaattgcgccatggtgggaaggatggggacgggagga

SEQ ID NO: 202559 - DNA, 36 bp, Artificial Sequence
  Synthetic oligonucleotide
gcaatctatgcagggggcggtaggcaggagagggga

SEQ ID NO: 202560 - DNA, 37 bp, Artificial Sequence
  Synthetic oligonucleotide
atccaccaccgagtgcttggatgtgttcatttctgga

SEQ ID NO: 202561 - DNA, 36 bp, Artificial Sequence
  Synthetic oligonucleotide
atgcctacctcacgccaccactgactccgctcgtga

SEQ ID NO: 202562 - DNA, 34 bp, Artificial Sequence
  Synthetic oligonucleotide
gccatgtcgtccaagatacctgaactaccgctcc

SEQ ID NO: 202563 - DNA, 35 bp, Artificial Sequence
  Synthetic oligonucleotide
tcacacgacgaccgaattacgactcggcatcttcc

SEQ ID NO: 202564 - DNA, 35 bp, Artificial Sequence
  Synthetic oligonucleotide
gcacacgcattgcgacggagttcgcctccccactg

SEQ ID NO: 202565 - DNA, 35 bp, Artificial Sequence
  Synthetic oligonucleotide
actatccaccccctagtgagtgaacattgcgaact

SEQ ID NO: 202566 - DNA, 36 bp, Artificial Sequence
  Synthetic oligonucleotide
tccgccgaactacagcagccccccgtactccgccga

SEQ ID NO: 202567 - DNA, 36 bp, Artificial Sequence
  Synthetic oligonucleotide
tcgactcatccatcccccacctaccgcctcaccgga

SEQ ID NO: 202568 - DNA, 29 bp, Artificial Sequence
  Synthetic oligonucleotide
atgtgacatctccgccggttccttgatcc

SEQ ID NO: 202569 - DNA, 35 bp, Artificial Sequence
  Synthetic oligonucleotide
gtagcctcgctgggtactctatgcactatcgctcc

SEQ ID NO: 202570 - DNA, 35 bp, Artificial Sequence
  Synthetic oligonucleotide
ttgcgagccccaatccgctcagttaccatgctcgc

SEQ ID NO: 202571 - DNA, 35 bp, Artificial Sequence
  Synthetic oligonucleotide
aacgacgcctgacgcgtgaaactcgacctcttcgc

SEQ ID NO: 202572 - DNA, 35 bp, Artificial Sequence
  Synthetic oligonucleotide
tagtacctctgctgcgtaccgctccctgtctctgc

SEQ ID NO: 202573 - DNA, 35 bp, Artificial Sequence
  Synthetic oligonucleotide
ttaggcccacctcccacatgtctgtaccgctctct

SEQ ID NO: 202574 - DNA, 34 bp, Artificial Sequence
  Synthetic oligonucleotide
gtcatgcaggccgtccgtcttcgctccagatcaa

SEQ ID NO: 202575 - DNA, 35 bp, Artificial Sequence
  Synthetic oligonucleotide
gcagaaggggagccgaggactgggaaacggtgtaa

SEQ ID NO: 202576 - DNA, 35 bp, Artificial Sequence
  Synthetic oligonucleotide
actcatagctcccctccacccgcgcgcactggaca

SEQ ID NO: 202577 - DNA, 36 bp, Artificial Sequence
  Synthetic oligonucleotide
tcccaccacctctccattgcgggtacgcttaggcca

SEQ ID NO: 202578 - DNA, 36 bp, Artificial Sequence
  Synthetic oligonucleotide
tagaggaagaacggccaaggaggagggctagatgca

SEQ ID NO: 202579 - DNA, 35 bp, Artificial Sequence
  Synthetic oligonucleotide
atcggaggtcaaggtggggcggaggacggatgtca

SEQ ID NO: 202580 - DNA, 37 bp, Artificial Sequence
  Synthetic oligonucleotide
ggtaacgtacggagggaagaaagtacgcaggggaaga

SEQ ID NO: 202581 - DNA, 37 bp, Artificial Sequence
  Synthetic oligonucleotide
gtgggacggcgggaagggaagagtgaccaatgttgga

SEQ ID NO: 202582 - DNA, 38 bp, Artificial Sequence
  Synthetic oligonucleotide
gaagagagggctgggtggaataatacgcgagggaatga

SEQ ID NO: 202583 - DNA, 35 bp, Artificial Sequence
  Synthetic oligonucleotide
actgactcgcctccacccgtttacagaccacgtta

SEQ ID NO: 202584 - DNA, 35 bp, Artificial Sequence
  Synthetic oligonucleotide
gtcgcacgtacattccctatagtgctcgacctccc

SEQ ID NO: 202585 - DNA, 35 bp, Artificial Sequence
  Synthetic oligonucleotide
atgccaacgggatggcctcgcattatgtttccgcc

SEQ ID NO: 202586 - DNA, 35 bp, Artificial Sequence
  Synthetic oligonucleotide
tccgcacagtttggtctcaattgccatccgctccg

SEQ ID NO: 202587 - DNA, 35 bp, Artificial Sequence
  Synthetic oligonucleotide
atgggggggaggggggggtacgaggcagggggcat

SEQ ID NO: 202588 - DNA, 35 bp, Artificial Sequence
  Synthetic oligonucleotide
aaacatatctccgccgtcttggttcgtcctcctgt

SEQ ID NO: 202589 - DNA, 35 bp, Artificial Sequence
  Synthetic oligonucleotide
gacagggtggggtggggtgaggacactttaatgaa

SEQ ID NO: 202590 - DNA, 36 bp, Artificial Sequence
  Synthetic oligonucleotide
gagccccccactcgccggtttcagtcccagcgccca

SEQ ID NO: 202591 - DNA, 38 bp, Artificial Sequence
  Synthetic oligonucleotide
gaccaccgcacctagcgccattccgtttctcctcttga

SEQ ID NO: 202592 - DNA, 36 bp, Artificial Sequence
  Synthetic oligonucleotide
gacgaggggggggagacgtggagtgagggagggata

SEQ ID NO: 202593 - DNA, 35 bp, Artificial Sequence
  Synthetic oligonucleotide
tacatcccacgagtagtgccccatccgcctcttgc

SEQ ID NO: 202594 - DNA, 35 bp, Artificial Sequence
  Synthetic oligonucleotide
ggaggtgagggcgggtaggtgaagtagtacggatt

SEQ ID NO: 202595 - DNA, 35 bp, Artificial Sequence
  Synthetic oligonucleotide
atggccacctccctctcctttgtaccgctgccgaa

SEQ ID NO: 202596 - DNA, 35 bp, Artificial Sequence
  Synthetic oligonucleotide
atccatccgttgttgcctctggcgttttccctgga

SEQ ID NO: 202597 - DNA, 36 bp, Artificial Sequence
  Synthetic oligonucleotide
tgtcccaccctgtgtcgttgccggttccattctcta

SEQ ID NO: 202598 - DNA, 36 bp, Artificial Sequence
  Synthetic oligonucleotide
gcacactcacttccctcagcccgtaggttaattcta

SEQ ID NO: 202599 - DNA, 36 bp, Artificial Sequence
  Synthetic oligonucleotide
gaaacgccgccgttatacctgcacacatctcttcta

SEQ ID NO: 202600 - DNA, 36 bp, Artificial Sequence
  Synthetic oligonucleotide
tctacaacgccccttatcccgcgagtcagacattta

SEQ ID NO: 202601 - DNA, 35 bp, Artificial Sequence
  Synthetic oligonucleotide
tgttaagcccagcgtgtccgcattccagctcttac

SEQ ID NO: 202602 - DNA, 35 bp, Artificial Sequence
  Synthetic oligonucleotide
tagtaccgctgctgcgtacctctccctgtctctgc

SEQ ID NO: 202603 - DNA, 37 bp, Artificial Sequence
  Synthetic oligonucleotide
gcccacccgtaccagcctttggaccctcatttgccga

SEQ ID NO: 202604 - DNA, 37 bp, Artificial Sequence
  Synthetic oligonucleotide
agccacgggcaacgtctacttgggagagggggggcga

SEQ ID NO: 202605 - DNA, 36 bp, Artificial Sequence
  Synthetic oligonucleotide
ttgacagtaggggtagagcatagagagggcgaagta

SEQ ID NO: 202606 - DNA, 35 bp, Artificial Sequence
  Synthetic oligonucleotide
agctagtgtgcggaagtataagcaagggggggagg

SEQ ID NO: 202607 - DNA, 35 bp, Artificial Sequence
  Synthetic oligonucleotide
acacaccacctaacctgttcgccgttccgctcttg

SEQ ID NO: 202608 - DNA, 35 bp, Artificial Sequence
  Synthetic oligonucleotide
actgcagggctgtcatctggcttcacattggtcct

SEQ ID NO: 202609 - DNA, 36 bp, Artificial Sequence
  Synthetic oligonucleotide
gtgtgaggtgggaatgactagggagaacagcgggga

SEQ ID NO: 202610 - DNA, 35 bp, Artificial Sequence
  Synthetic oligonucleotide
gtatccctgtctcatctgccacttgcgacccctta

SEQ ID NO: 202611 - DNA, 35 bp, Artificial Sequence
  Synthetic oligonucleotide
acctgacccaccacattatacttcgctgtccacgc

SEQ ID NO: 202612 - DNA, 35 bp, Artificial Sequence
  Synthetic oligonucleotide
ggtgtgcctcacaccgttctccttaggattatatc

SEQ ID NO: 202613 - DNA, 35 bp, Artificial Sequence
  Synthetic oligonucleotide
aagacaaaacgagccaggacgggtggagggatacg

SEQ ID NO: 202614 - DNA, 35 bp, Artificial Sequence
  Synthetic oligonucleotide
gacgcccctcatttatgtcctgcccgccctgtacg

SEQ ID NO: 202615 - DNA, 35 bp, Artificial Sequence
  Synthetic oligonucleotide
gactccaccgctcctccttccccaatcgccttctg

SEQ ID NO: 202616 - DNA, 35 bp, Artificial Sequence
  Synthetic oligonucleotide
gcccaagcttagattcgttccggtctctctgctgt

SEQ ID NO: 202617 - DNA, 35 bp, Artificial Sequence
  Synthetic oligonucleotide
gacaccgctcgaaagtgtacgctgccttttccatt

SEQ ID NO: 202618 - DNA, 36 bp, Artificial Sequence
  Synthetic oligonucleotide
tgtgtcccacgtgcatcctcccgtttctatcttgta

SEQ ID NO: 202619 - DNA, 35 bp, Artificial Sequence
  Synthetic oligonucleotide
tgagcacctcaaggcccgtagcacgccctccttac

SEQ ID NO: 202620 - DNA, 35 bp, Artificial Sequence
  Synthetic oligonucleotide
tcaacactaccgatgatcggaatccgcctcttttg

SEQ ID NO: 202621 - DNA, 36 bp, Artificial Sequence
  Synthetic oligonucleotide
tgtgagcgccacgccactttggcacacagtctctct

SEQ ID NO: 202622 - DNA, 36 bp, Artificial Sequence
  Synthetic oligonucleotide
ggacaagctccggctttgattggccttcctcctgaa

SEQ ID NO: 202623 - DNA, 36 bp, Artificial Sequence
  Synthetic oligonucleotide
ggagacggcttgttgagggggagtagggctggaaga

SEQ ID NO: 202624 - DNA, 35 bp, Artificial Sequence
  Synthetic oligonucleotide
tcagcaccatcaacatatcgcgccaccggtcacac

SEQ ID NO: 202625 - DNA, 35 bp, Artificial Sequence
  Synthetic oligonucleotide
gacggaacctctctggactcattacagcttactac

SEQ ID NO: 202626 - DNA, 35 bp, Artificial Sequence
  Synthetic oligonucleotide
gcattccacccgcgcgtctattattatttccatgg

SEQ ID NO: 202627 - DNA, 35 bp, Artificial Sequence
  Synthetic oligonucleotide
tacgggtgtgtacagatggatcgggcggggggggt

SEQ ID NO: 202628 - DNA, 36 bp, Artificial Sequence
  Synthetic oligonucleotide
tgctgcacctcccactgcacctcatgacatcccgca

SEQ ID NO: 202629 - DNA, 36 bp, Artificial Sequence
  Synthetic oligonucleotide
accctccccagatctcgcctgacgtccctaacatca

SEQ ID NO: 202630 - DNA, 33 bp, Artificial Sequence
  Synthetic oligonucleotide
aaacgggggggggcgagtgctacagggtcatca

SEQ ID NO: 202631 - DNA, 37 bp, Artificial Sequence
  Synthetic oligonucleotide
tatgacacgttcgtcctgcgcccgcttctcgtaccga

SEQ ID NO: 202632 - DNA, 37 bp, Artificial Sequence
  Synthetic oligonucleotide
gagccatggtgggagtaggcgattggagaagggtgga

SEQ ID NO: 202633 - DNA, 36 bp, Artificial Sequence
  Synthetic oligonucleotide
tcccctcccgggtaggtcttttcgttgctccttgta

SEQ ID NO: 202634 - DNA, 35 bp, Artificial Sequence
  Synthetic oligonucleotide
tgcacagtcctgatctgcagcttcccacacttctc

SEQ ID NO: 202635 - DNA, 35 bp, Artificial Sequence
  Synthetic oligonucleotide
atgcttacccgtccctgtcttgcacataccacccg

SEQ ID NO: 202636 - DNA, 35 bp, Artificial Sequence
  Synthetic oligonucleotide
ggatgacggaggtgaaggatagtagcagtaaggcg

SEQ ID NO: 202637 - DNA, 35 bp, Artificial Sequence
  Synthetic oligonucleotide
ttcactacccctctcgactttgccccgcatcaatg

SEQ ID NO: 202638 - DNA, 35 bp, Artificial Sequence
  Synthetic oligonucleotide
tgacagccacacactcgtgtgattcaccctcccaa

SEQ ID NO: 202639 - DNA, 35 bp, Artificial Sequence
  Synthetic oligonucleotide
ttcacccgcctgccctttgtatatcctcttagtaa

SEQ ID NO: 202640 - DNA, 35 bp, Artificial Sequence
  Synthetic oligonucleotide
gtgcggagggcgaggggctgggacgaatcttaaca

SEQ ID NO: 202641 - DNA, 35 bp, Artificial Sequence
  Synthetic oligonucleotide
aacgagggcattcgggcaaggggcgggttatatca

SEQ ID NO: 202642 - DNA, 35 bp, Artificial Sequence
  Synthetic oligonucleotide
tgatggagaggcggatgggtagggagggtagtgtc

SEQ ID NO: 202643 - DNA, 35 bp, Artificial Sequence
  Synthetic oligonucleotide
aacttgcccgccactcagaccttcgctcccttgtc

SEQ ID NO: 202644 - DNA, 35 bp, Artificial Sequence
  Synthetic oligonucleotide
gatcccgctgaaatccatcgccgactactgtttag

SEQ ID NO: 202645 - DNA, 35 bp, Artificial Sequence
  Synthetic oligonucleotide
aggggaggggggggcgggtacgaggcagggggcat

SEQ ID NO: 202646 - DNA, 35 bp, Artificial Sequence
  Synthetic oligonucleotide
tgtacgcgccatgtcctcttttggtcctgcttact

SEQ ID NO: 202647 - DNA, 36 bp, Artificial Sequence
  Synthetic oligonucleotide
gtgtcaagggcgggtgtatgggtactgtcataggga

SEQ ID NO: 202648 - DNA, 37 bp, Artificial Sequence
  Synthetic oligonucleotide
gagacgagctggtgaggaaaggggagtgtgagctgga

SEQ ID NO: 202649 - DNA, 35 bp, Artificial Sequence
  Synthetic oligonucleotide
gttcgcctcccattgccttttggagtcattaatga

SEQ ID NO: 202650 - DNA, 36 bp, Artificial Sequence
  Synthetic oligonucleotide
aacacaaccgctgtacgctccttttcgttcctctga

SEQ ID NO: 202651 - DNA, 36 bp, Artificial Sequence
  Synthetic oligonucleotide
atttacgtggcctggtaccatctccctgtttagata

SEQ ID NO: 202652 - DNA, 35 bp, Artificial Sequence
  Synthetic oligonucleotide
taaagacggaggaagacgagagggaagggtgagcg

SEQ ID NO: 202653 - DNA, 35 bp, Artificial Sequence
  Synthetic oligonucleotide
gtgcgggcctcacccagtctatcgcattgtcgcca

SEQ ID NO: 202654 - DNA, 35 bp, Artificial Sequence
  Synthetic oligonucleotide
gcgcaacacagagtcttcatctccacactggctca

SEQ ID NO: 202655 - DNA, 37 bp, Artificial Sequence
  Synthetic oligonucleotide
acagtcgacctttgcgaaagccatcatactacctcga

SEQ ID NO: 202656 - DNA, 35 bp, Artificial Sequence
  Synthetic oligonucleotide
acaggaggagacagctggaggcgagaggaacggta

SEQ ID NO: 202657 - DNA, 35 bp, Artificial Sequence
  Synthetic oligonucleotide
gagaggccaaagtgtacgatctttcctggtaatcc

SEQ ID NO: 202658 - DNA, 35 bp, Artificial Sequence
  Synthetic oligonucleotide
ttgcaccacagagctggctcatgtcgccctccttc

SEQ ID NO: 202659 - DNA, 35 bp, Artificial Sequence
  Synthetic oligonucleotide
atcgccgccccaccatgccgtttgtggttttccct

SEQ ID NO: 202660 - DNA, 36 bp, Artificial Sequence
  Synthetic oligonucleotide
aaaagccagaagaacacgagaagaggcggggtggaa

SEQ ID NO: 202661 - DNA, 35 bp, Artificial Sequence
  Synthetic oligonucleotide
tatttcacagccaactcatgcacctctcagagcca

SEQ ID NO: 202662 - DNA, 35 bp, Artificial Sequence
  Synthetic oligonucleotide
gatgggagggggagttagatgagcgcctattatca

SEQ ID NO: 202663 - DNA, 37 bp, Artificial Sequence
  Synthetic oligonucleotide
gtcccatccctcagtctatcagctacacaccccagga

SEQ ID NO: 202664 - DNA, 37 bp, Artificial Sequence
  Synthetic oligonucleotide
accggggacggaagaggaggggagacgcggggtttga

SEQ ID NO: 202665 - DNA, 35 bp, Artificial Sequence
  Synthetic oligonucleotide
tgtcgctccagcccctacgatatcatgccctgcta

SEQ ID NO: 202666 - DNA, 36 bp, Artificial Sequence
  Synthetic oligonucleotide
gatgcgccacttcctctatttcgcggttattttgta

SEQ ID NO: 202667 - DNA, 35 bp, Artificial Sequence
  Synthetic oligonucleotide
tgcgataggctcctgctgatgtgctccccgtctta

SEQ ID NO: 202668 - DNA, 38 bp, Artificial Sequence
  Synthetic oligonucleotide
ttggagggggccggggtatggaggcggactttctttta

SEQ ID NO: 202669 - DNA, 35 bp, Artificial Sequence
  Synthetic oligonucleotide
gaaggggggatcaaaatctgggggcggggttcaac

SEQ ID NO: 202670 - DNA, 35 bp, Artificial Sequence
  Synthetic oligonucleotide
gacccccgccgtgctgcccatacgcttgcgctacc

SEQ ID NO: 202671 - DNA, 35 bp, Artificial Sequence
  Synthetic oligonucleotide
acccacccgcagtgtgtcttccgccagtacttgcc

SEQ ID NO: 202672 - DNA, 35 bp, Artificial Sequence
  Synthetic oligonucleotide
gtgcacatccagccgctgttaaatcctcgccctgg

SEQ ID NO: 202673 - DNA, 35 bp, Artificial Sequence
  Synthetic oligonucleotide
aaacgagggggggatgagacatgacgggctaaatg

SEQ ID NO: 202674 - DNA, 35 bp, Artificial Sequence
  Synthetic oligonucleotide
tctcccgacgatgctatgcgcaccctctttctctt

SEQ ID NO: 202675 - DNA, 37 bp, Artificial Sequence
  Synthetic oligonucleotide
gacgaggggtgggtaagacatcgcctttagggcggga

SEQ ID NO: 202676 - DNA, 37 bp, Artificial Sequence
  Synthetic oligonucleotide
gcaagggggggagatacacagcacggacctggtggga

SEQ ID NO: 202677 - DNA, 35 bp, Artificial Sequence
  Synthetic oligonucleotide
gaccacgcccacatgtgctgcgctctgcccgccgc

SEQ ID NO: 202678 - DNA, 35 bp, Artificial Sequence
  Synthetic oligonucleotide
acctccagttaccctctgtacaagccactccttcg

SEQ ID NO: 202679 - DNA, 35 bp, Artificial Sequence
  Synthetic oligonucleotide
gaaccaccgcctttcaacctcgatcccctggaaat

SEQ ID NO: 202680 - DNA, 36 bp, Artificial Sequence
  Synthetic oligonucleotide
tcagagcgggcgaagaagataacggtggggggagaa

SEQ ID NO: 202681 - DNA, 37 bp, Artificial Sequence
  Synthetic oligonucleotide
aatacaccacacctttgcctctccgtctcgaccggga

SEQ ID NO: 202682 - DNA, 35 bp, Artificial Sequence
  Synthetic oligonucleotide
acatccattgtctccatccctagccgcgttctacg

SEQ ID NO: 202683 - DNA, 35 bp, Artificial Sequence
  Synthetic oligonucleotide
acactcccgatgagctacggtactccctctccttg

SEQ ID NO: 202684 - DNA, 35 bp, Artificial Sequence
  Synthetic oligonucleotide
gcaaacgcggggaaggaacgggaggaggggaagct

SEQ ID NO: 202685 - DNA, 35 bp, Artificial Sequence
  Synthetic oligonucleotide
tgagacagtcaggagggggggcgtgttggggggca

SEQ ID NO: 202686 - DNA, 36 bp, Artificial Sequence
  Synthetic oligonucleotide
tgcgatcagctcagcgcaactccccccctgccatga

SEQ ID NO: 202687 - DNA, 36 bp, Artificial Sequence
  Synthetic oligonucleotide
tctgacgtgcccccttcaataataccagtctcctga

SEQ ID NO: 202688 - DNA, 35 bp, Artificial Sequence
  Synthetic oligonucleotide
aatgactcttcgcccggaataccgcctcatgcata

SEQ ID NO: 202689 - DNA, 36 bp, Artificial Sequence
  Synthetic oligonucleotide
tctacacgaccgctggttcctcttctgtctcacgta

SEQ ID NO: 202690 - DNA, 35 bp, Artificial Sequence
  Synthetic oligonucleotide
ttccccgaccctatttgtaccctcttggcagtaac

SEQ ID NO: 202691 - DNA, 30 bp, Artificial Sequence
  Synthetic oligonucleotide
tttgccacccctaagtgtcctttgtcaccc

SEQ ID NO: 202692 - DNA, 35 bp, Artificial Sequence
  Synthetic oligonucleotide
acgacacggctcagttccatctccagtgcaccccc

SEQ ID NO: 202693 - DNA, 35 bp, Artificial Sequence
  Synthetic oligonucleotide
tcaacactgagatctcacccacgcttcctctttcg

SEQ ID NO: 202694 - DNA, 35 bp, Artificial Sequence
  Synthetic oligonucleotide
aacgggtgagaacgaagggcaaggggacaggcatg

SEQ ID NO: 202695 - DNA, 35 bp, Artificial Sequence
  Synthetic oligonucleotide
gtgcttcaccccagcatgtttaactactccgccct

SEQ ID NO: 202696 - DNA, 35 bp, Artificial Sequence
  Synthetic oligonucleotide
gtactgcccgtcgattggtcttgcctgccatcttt

SEQ ID NO: 202697 - DNA, 36 bp, Artificial Sequence
  Synthetic oligonucleotide
aatgacaagccaggctgtggaaaagcggggggagaa

SEQ ID NO: 202698 - DNA, 35 bp, Artificial Sequence
  Synthetic oligonucleotide
gacaccgtaaggatggaacgtacggactttgtagt

SEQ ID NO: 202699 - DNA, 35 bp, Artificial Sequence
  Synthetic oligonucleotide
aacgccagtcctgttcccgccggcccatctcgttt

SEQ ID NO: 202700 - DNA, 36 bp, Artificial Sequence
  Synthetic oligonucleotide
tctggaggcggagggagaaggtaggagggcatacaa

SEQ ID NO: 202701 - DNA, 36 bp, Artificial Sequence
  Synthetic oligonucleotide
gacaccatcctaaggagcatgggctctacctccaca

SEQ ID NO: 202702 - DNA, 37 bp, Artificial Sequence
  Synthetic oligonucleotide
tgcaccccctccgaaatactctctgtgcacatcccga

SEQ ID NO: 202703 - DNA, 37 bp, Artificial Sequence
  Synthetic oligonucleotide
gagatgtaaagcagggtccggggcgaaggggggggga

SEQ ID NO: 202704 - DNA, 38 bp, Artificial Sequence
  Synthetic oligonucleotide
gtccacccacagacctgcataatcgctccagccgatga

SEQ ID NO: 202705 - DNA, 35 bp, Artificial Sequence
  Synthetic oligonucleotide
agaatgagggggagggggggctggataggtggaac

SEQ ID NO: 202706 - DNA, 35 bp, Artificial Sequence
  Synthetic oligonucleotide
gagcacgcgctaagggtggtggggagggaggcgat

SEQ ID NO: 202707 - DNA, 35 bp, Artificial Sequence
  Synthetic oligonucleotide
gacgggaatggcgtaagagggggtggtaagggaga

SEQ ID NO: 202708 - DNA, 37 bp, Artificial Sequence
  Synthetic oligonucleotide
gcgaagcacgacagaacgttacgagggttggggcgga

SEQ ID NO: 202709 - DNA, 36 bp, Artificial Sequence
  Synthetic oligonucleotide
actggacaagtacggaggaacgaggggagctactga

SEQ ID NO: 202710 - DNA, 36 bp, Artificial Sequence
  Synthetic oligonucleotide
actcacctaccgtacctcctgccacgatcccattga

SEQ ID NO: 202711 - DNA, 35 bp, Artificial Sequence
  Synthetic oligonucleotide
atgctacttcacccttgtccactgtaatgctccac

SEQ ID NO: 202712 - DNA, 35 bp, Artificial Sequence
  Synthetic oligonucleotide
tacgatagcctccctcgctagtgatctctagtccc

SEQ ID NO: 202713 - DNA, 35 bp, Artificial Sequence
  Synthetic oligonucleotide
aatacgctatcactgctttcccgctcaatatgatg

SEQ ID NO: 202714 - DNA, 35 bp, Artificial Sequence
  Synthetic oligonucleotide
attcagcagttcttgccccgattgcctcacccgtt

SEQ ID NO: 202715 - DNA, 35 bp, Artificial Sequence
  Synthetic oligonucleotide
atacctcccgccgacgccttctttgtgcgacccca

SEQ ID NO: 202716 - DNA, 35 bp, Artificial Sequence
  Synthetic oligonucleotide
tgactgagaagcaggggaggtagcagggagtagca

SEQ ID NO: 202717 - DNA, 36 bp, Artificial Sequence
  Synthetic oligonucleotide
gatgatcgtccttcgcctcctacgcacgcccattga

SEQ ID NO: 202718 - DNA, 36 bp, Artificial Sequence
  Synthetic oligonucleotide
gcccatcatgtcgcactacttctatcgctcccgcta

SEQ ID NO: 202719 - DNA, 37 bp, Artificial Sequence
  Synthetic oligonucleotide
gcgccgcaccgcgtaagttcgtactcccacacttcta

SEQ ID NO: 202720 - DNA, 35 bp, Artificial Sequence
  Synthetic oligonucleotide
tcctaccacagccttcattcgtcccctttgtctgg

SEQ ID NO: 202721 - DNA, 35 bp, Artificial Sequence
  Synthetic oligonucleotide
gagaagggggggcagggtagggggttcatcaccca

SEQ ID NO: 202722 - DNA, 35 bp, Artificial Sequence
  Synthetic oligonucleotide
ttggaaaggggagaaatgggggggggagatgggca

SEQ ID NO: 202723 - DNA, 37 bp, Artificial Sequence
  Synthetic oligonucleotide
gagggggggtgggtgtgagcacagcgattcgacggga

SEQ ID NO: 202724 - DNA, 38 bp, Artificial Sequence
  Synthetic oligonucleotide
atcaccgacggaggcttgcgtacacctgcgatccttga

SEQ ID NO: 202725 - DNA, 35 bp, Artificial Sequence
  Synthetic oligonucleotide
gtacgcacacccgccttggaccgttcctaattata

SEQ ID NO: 202726 - DNA, 37 bp, Artificial Sequence
  Synthetic oligonucleotide
tgacaaggggcgggtgtactttctatgggaacaggga

SEQ ID NO: 202727 - DNA, 38 bp, Artificial Sequence
  Synthetic oligonucleotide
tatgggcgtgggctgggtgggcgtgaccagaggcgtga

SEQ ID NO: 202728 - DNA, 35 bp, Artificial Sequence
  Synthetic oligonucleotide
atgcgcacgctatttgtcttttccttgcattcctc

SEQ ID NO: 202729 - DNA, 35 bp, Artificial Sequence
  Synthetic oligonucleotide
ttatccaccacgccccatccagcacaccttcggat

SEQ ID NO: 202730 - DNA, 35 bp, Artificial Sequence
  Synthetic oligonucleotide
tcacgtcacacgttatacaccgcctctcgtcctaa

SEQ ID NO: 202731 - DNA, 36 bp, Artificial Sequence
  Synthetic oligonucleotide
gtgctgtcccttatatcgcccgctgtctcaatgcca

SEQ ID NO: 202732 - DNA, 35 bp, Artificial Sequence
  Synthetic oligonucleotide
gcagaacccgatctgtctcagtcccttgtgctcca

SEQ ID NO: 202733 - DNA, 36 bp, Artificial Sequence
  Synthetic oligonucleotide
atcgactgaccgcatcctcctctgttcccttcggta

SEQ ID NO: 202734 - DNA, 35 bp, Artificial Sequence
  Synthetic oligonucleotide
ggaggagcacagaaaagatgtaggggtggcgggaa

SEQ ID NO: 202735 - DNA, 36 bp, Artificial Sequence
  Synthetic oligonucleotide
tagtcagtccggagaggggaggaggtaaaagccaga

SEQ ID NO: 202736 - DNA, 35 bp, Artificial Sequence
  Synthetic oligonucleotide
ggtgaagggggaggggatgcactaaggaccgcgga

SEQ ID NO: 202737 - DNA, 37 bp, Artificial Sequence
  Synthetic oligonucleotide
tgacgaacgtagtaggagggataggggaaaggtctga

SEQ ID NO: 202738 - DNA, 35 bp, Artificial Sequence
  Synthetic oligonucleotide
gtcacggggggggtgttaatgtcaatgcaggtcac

SEQ ID NO: 202739 - DNA, 35 bp, Artificial Sequence
  Synthetic oligonucleotide
gcgaacgccactaatctgttgtctcatccatctcg

SEQ ID NO: 202740 - DNA, 36 bp, Artificial Sequence
  Synthetic oligonucleotide
tatgcatgtcagtggaatggaaagggaaggaggaaa

SEQ ID NO: 202741 - DNA, 36 bp, Artificial Sequence
  Synthetic oligonucleotide
atgtcccggtagatgtggcatcccgttccacctcaa

SEQ ID NO: 202742 - DNA, 36 bp, Artificial Sequence
  Synthetic oligonucleotide
gcaagtgtcggcacccggcccactatgtacctttca

SEQ ID NO: 202743 - DNA, 35 bp, Artificial Sequence
  Synthetic oligonucleotide
tgacaaatcccggcccttctgcattgttccttgta

SEQ ID NO: 202744 - DNA, 35 bp, Artificial Sequence
  Synthetic oligonucleotide
atgggagggaggggcgggtacgaggcagtgggcat

SEQ ID NO: 202745 - DNA, 35 bp, Artificial Sequence
  Synthetic oligonucleotide
acacatcgggtagggtagagagtagggttgggcct

SEQ ID NO: 202746 - DNA, 35 bp, Artificial Sequence
  Synthetic oligonucleotide
gtggtgacggaggaatggaggagagcgatgactca

SEQ ID NO: 202747 - DNA, 37 bp, Artificial Sequence
  Synthetic oligonucleotide
atgcaacggagggggggtataaggcgtaacgagggga

SEQ ID NO: 202748 - DNA, 35 bp, Artificial Sequence
  Synthetic oligonucleotide
gccacccacgacctcctccgctgtgcgagctatcg

SEQ ID NO: 202749 - DNA, 38 bp, Artificial Sequence
  Synthetic oligonucleotide
actgcaattgagggagggctaaggagcgtgggttttga

SEQ ID NO: 202750 - DNA, 31 bp, Artificial Sequence
  Synthetic oligonucleotide
gatcagcaggagggcggggacgggttgaaag

SEQ ID NO: 202751 - DNA, 35 bp, Artificial Sequence
  Synthetic oligonucleotide
tacctcgcccccacatctaccgaaccgagactcgt

SEQ ID NO: 202752 - DNA, 35 bp, Artificial Sequence
  Synthetic oligonucleotide
aggaccctgctcctggtacattctactgcttttca

SEQ ID NO: 202753 - DNA, 37 bp, Artificial Sequence
  Synthetic oligonucleotide
attgacaggggagaagggcgcggtgtgacagtggcga

SEQ ID NO: 202754 - DNA, 36 bp, Artificial Sequence
  Synthetic oligonucleotide
atatcgcgcccccttagtagcccactccgctaagga

SEQ ID NO: 202755 - DNA, 35 bp, Artificial Sequence
  Synthetic oligonucleotide
atggacagggacaagcaggaaagaggggtaacgga

SEQ ID NO: 202756 - DNA, 37 bp, Artificial Sequence
  Synthetic oligonucleotide
tcacggaactggagggtgggtaacgggagggaactga

SEQ ID NO: 202757 - DNA, 35 bp, Artificial Sequence
  Synthetic oligonucleotide
gggacacgagatggtgagggagggcgatgtaattg

SEQ ID NO: 202758 - DNA, 35 bp, Artificial Sequence
  Synthetic oligonucleotide
agggggggggggggggggtacgaggcagggggcat

SEQ ID NO: 202759 - DNA, 35 bp, Artificial Sequence
  Synthetic oligonucleotide
tacgttccctcagacgtgcgtcccccctcgcgcct

SEQ ID NO: 202760 - DNA, 36 bp, Artificial Sequence
  Synthetic oligonucleotide
tccatcctccctctacctcagtcgacgactccgcca

SEQ ID NO: 202761 - DNA, 36 bp, Artificial Sequence
  Synthetic oligonucleotide
atgcaaaggaaggtgggatgggcgcagcatgtttca

SEQ ID NO: 202762 - DNA, 36 bp, Artificial Sequence
  Synthetic oligonucleotide
aaccaccgtatgcgcgccttcgcctttgttttttca

SEQ ID NO: 202763 - DNA, 35 bp, Artificial Sequence
  Synthetic oligonucleotide
gagtgcaaggggggaggggggacgggggggtagag

SEQ ID NO: 202764 - DNA, 35 bp, Artificial Sequence
  Synthetic oligonucleotide
gtgggagagagaagagtgcgtgatgaatgcggggg

SEQ ID NO: 202765 - DNA, 36 bp, Artificial Sequence
  Synthetic oligonucleotide
aatagggggggagatgaaacacgtggggggactggg

SEQ ID NO: 202766 - DNA, 35 bp, Artificial Sequence
  Synthetic oligonucleotide
atcgccgggccctcgcactttcacgttcctttgtg

SEQ ID NO: 202767 - DNA, 35 bp, Artificial Sequence
  Synthetic oligonucleotide
aactcgcgccacacggtaaatcacttctcttagtt

SEQ ID NO: 202768 - DNA, 37 bp, Artificial Sequence
  Synthetic oligonucleotide
gtgacacggacggaaggggacaacgacggaatacgga

SEQ ID NO: 202769 - DNA, 35 bp, Artificial Sequence
  Synthetic oligonucleotide
gggtgcaaggggggagtggggacgggggggtagag

SEQ ID NO: 202770 - DNA, 35 bp, Artificial Sequence
  Synthetic oligonucleotide
aactcgtccgccctatctatgccctacccacctag

SEQ ID NO: 202771 - DNA, 35 bp, Artificial Sequence
  Synthetic oligonucleotide
aaacgggggggggggcgagtgctacagggtcatca

SEQ ID NO: 202772 - DNA, 36 bp, Artificial Sequence
  Synthetic oligonucleotide
gtgggggtaggagagaccataaggggggcatgtgga

SEQ ID NO: 202773 - DNA, 38 bp, Artificial Sequence
  Synthetic oligonucleotide
acaggaggcggatgggacgttgtgtgggcggatcttga

SEQ ID NO: 202774 - DNA, 36 bp, Artificial Sequence
  Synthetic oligonucleotide
tccccgcccggttaggtcttttcgttgctccttgta

SEQ ID NO: 202775 - DNA, 35 bp, Artificial Sequence
  Synthetic oligonucleotide
tgacgacacgtaggtgtttccagtctcgttcctcc

SEQ ID NO: 202776 - DNA, 35 bp, Artificial Sequence
  Synthetic oligonucleotide
gtatcgccacccgtcttgccatttcctgtccccgt

SEQ ID NO: 202777 - DNA, 36 bp, Artificial Sequence
  Synthetic oligonucleotide
tttccacgcacccaacttactgcatcatcctccgaa

SEQ ID NO: 202778 - DNA, 37 bp, Artificial Sequence
  Synthetic oligonucleotide
gtgacacgcatccatggattagcctccgctccctaga

SEQ ID NO: 202779 - DNA, 36 bp, Artificial Sequence
  Synthetic oligonucleotide
gacaccatccttttcctgccctgcccagactcgcga

SEQ ID NO: 202780 - DNA, 35 bp, Artificial Sequence
  Synthetic oligonucleotide
attctcccgcaccctcctgcccgttgggcctcgga

SEQ ID NO: 202781 - DNA, 36 bp, Artificial Sequence
  Synthetic oligonucleotide
gagggacgcgagagaggggcactggaataacgggta

SEQ ID NO: 202782 - DNA, 35 bp, Artificial Sequence
  Synthetic oligonucleotide
tcatcgcacccattccgtttgcctttgactaatac

SEQ ID NO: 202783 - DNA, 35 bp, Artificial Sequence
  Synthetic oligonucleotide
agcctcagccgccgccccttgcttcgttacgaacg

SEQ ID NO: 202784 - DNA, 35 bp, Artificial Sequence
  Synthetic oligonucleotide
gtttacgacctcctcctcccaagtcccgccgtttg

SEQ ID NO: 202785 - DNA, 35 bp, Artificial Sequence
  Synthetic oligonucleotide
atccgcgagaagggttgggaggcaatgtgggcatt

SEQ ID NO: 202786 - DNA, 30 bp, Artificial Sequence
  Synthetic oligonucleotide
accacgtcgccgttaacacgattactccta

SEQ ID NO: 202787 - DNA, 35 bp, Artificial Sequence
  Synthetic oligonucleotide
gtattcagggaagggggcacaaggggctgtaaatg

SEQ ID NO: 202788 - DNA, 35 bp, Artificial Sequence
  Synthetic oligonucleotide
ttgggagggaggggcgggtacgaggcagggggcat

SEQ ID NO: 202789 - DNA, 35 bp, Artificial Sequence
  Synthetic oligonucleotide
tcctcatccgcataacccctcctgtcgtccgccaa

SEQ ID NO: 202790 - DNA, 37 bp, Artificial Sequence
  Synthetic oligonucleotide
tcagatcgcgggtggagtctagggaaggagagcgcga

SEQ ID NO: 202791 - DNA, 35 bp, Artificial Sequence
  Synthetic oligonucleotide
gttgggggcaaagagggataattggagatgcgacg

SEQ ID NO: 202792 - DNA, 35 bp, Artificial Sequence
  Synthetic oligonucleotide
gcctcccgcccctcatagtcgtaacgtacccactg

SEQ ID NO: 202793 - DNA, 36 bp, Artificial Sequence
  Synthetic oligonucleotide
tagcaagggtcggacagggacaggaaggcggaggaa

SEQ ID NO: 202794 - DNA, 35 bp, Artificial Sequence
  Synthetic oligonucleotide
tgtgagccaccacgcgtgtctttgtaccctatcta

SEQ ID NO: 202795 - DNA, 35 bp, Artificial Sequence
  Synthetic oligonucleotide
tcagagcccagtggaagagagtggtggtgaagggg

SEQ ID NO: 202796 - DNA, 38 bp, Artificial Sequence
  Synthetic oligonucleotide
aatccagcctcccaaaaccacgccctcgcttcacatga

SEQ ID NO: 202797 - DNA, 36 bp, Artificial Sequence
  Synthetic oligonucleotide
attccctgggcggggaaggcaaggggttttggggta

SEQ ID NO: 202798 - DNA, 35 bp, Artificial Sequence
  Synthetic oligonucleotide
gtacctcgcacctccagcgttacgcgcgccctcca

SEQ ID NO: 202799 - DNA, 35 bp, Artificial Sequence
  Synthetic oligonucleotide
gcctgttgccagcacgtgaaccccccgtgtcctac

SEQ ID NO: 202800 - DNA, 35 bp, Artificial Sequence
  Synthetic oligonucleotide
gtgcacatcagcatgtaagctcttagtcgcctccc

SEQ ID NO: 202801 - DNA, 35 bp, Artificial Sequence
  Synthetic oligonucleotide
acacaccacctaacatgttcgccgtgccgctcttg

SEQ ID NO: 202802 - DNA, 35 bp, Artificial Sequence
  Synthetic oligonucleotide
accgacaccgctgctgctctcatgtttctccacct

SEQ ID NO: 202803 - DNA, 29 bp, Artificial Sequence
  Synthetic oligonucleotide
ttgcgccctcaccatgtcgcccttactca

SEQ ID NO: 202804 - DNA, 37 bp, Artificial Sequence
  Synthetic oligonucleotide
tggaaaatgggtatgcggggggcgggatctacaggga

SEQ ID NO: 202805 - DNA, 38 bp, Artificial Sequence
  Synthetic oligonucleotide
tgcaccccgccctcttgtcgtcccgatccttctcgtga

SEQ ID NO: 202806 - DNA, 35 bp, Artificial Sequence
  Synthetic oligonucleotide
gaagggggggtcaaaatctgggggcggggttcaac

SEQ ID NO: 202807 - DNA, 35 bp, Artificial Sequence
  Synthetic oligonucleotide
agtcatcccgcgtgtcgttatgccccgtccctgtc

SEQ ID NO: 202808 - DNA, 35 bp, Artificial Sequence
  Synthetic oligonucleotide
acgatgggccacttcacgttactgtccttgttgtc

SEQ ID NO: 202809 - DNA, 35 bp, Artificial Sequence
  Synthetic oligonucleotide
gccttccatccgaccctgtaccttcgcctgtgtct

SEQ ID NO: 202810 - DNA, 35 bp, Artificial Sequence
  Synthetic oligonucleotide
gagtactgcgcggtactgtcatgagatcggctaaa

SEQ ID NO: 202811 - DNA, 37 bp, Artificial Sequence
  Synthetic oligonucleotide
gacggggaactgggaacaagggggggggtttcgacga

SEQ ID NO: 202812 - DNA, 36 bp, Artificial Sequence
  Synthetic oligonucleotide
gtactccgcaccattgcttatttttcccttttagga

SEQ ID NO: 202813 - DNA, 37 bp, Artificial Sequence
  Synthetic oligonucleotide
atggaaagggggtggatcgggcaaaaggatggcggga

SEQ ID NO: 202814 - DNA, 35 bp, Artificial Sequence
  Synthetic oligonucleotide
agaacggcggaagggataattggaaggggtgaaag

SEQ ID NO: 202815 - DNA, 36 bp, Artificial Sequence
  Synthetic oligonucleotide
tagcccatccaggtcggtcttggtccacgtatatta

SEQ ID NO: 202816 - DNA, 35 bp, Artificial Sequence
  Synthetic oligonucleotide
tcacccccccgttatgcactctccggtagtcactg

SEQ ID NO: 202817 - DNA, 35 bp, Artificial Sequence
  Synthetic oligonucleotide
agggccggggggatgagacatgaaggggcgggtta

SEQ ID NO: 202818 - DNA, 35 bp, Artificial Sequence
  Synthetic oligonucleotide
tccttcaccgccgcaggtaacgccccacagagtcc

SEQ ID NO: 202819 - DNA, 35 bp, Artificial Sequence
  Synthetic oligonucleotide
tcgaaacgtccccccctccgaccgctcgacagccg

SEQ ID NO: 202820 - DNA, 35 bp, Artificial Sequence
  Synthetic oligonucleotide
gcctggactcgccccttgtattgaacccatcgttg

SEQ ID NO: 202821 - DNA, 35 bp, Artificial Sequence
  Synthetic oligonucleotide
gcgatccctccccactctaccagcaaactccccgt

SEQ ID NO: 202822 - DNA, 36 bp, Artificial Sequence
  Synthetic oligonucleotide
cctacccgacctgcttccttggcttgacctccctaa

SEQ ID NO: 202823 - DNA, 35 bp, Artificial Sequence
  Synthetic oligonucleotide
gcctgccacccccctgccatacgtcccggcaacag

SEQ ID NO: 202824 - DNA, 35 bp, Artificial Sequence
  Synthetic oligonucleotide
acatcaccctaaccgttattagcttcgtacgcggt

SEQ ID NO: 202825 - DNA, 35 bp, Artificial Sequence
  Synthetic oligonucleotide
acacacgtattcgcttcaacctttccaccgccgtt

SEQ ID NO: 202826 - DNA, 36 bp, Artificial Sequence
  Synthetic oligonucleotide
atatgcgatcagtgtgggggggtacggatgggggga

SEQ ID NO: 202827 - DNA, 38 bp, Artificial Sequence
  Synthetic oligonucleotide
aaccgcaccgttgccatactcgtccctctgtttcatga

SEQ ID NO: 202828 - DNA, 35 bp, Artificial Sequence
  Synthetic oligonucleotide
gtggggggggggggcacacacgggggttatcgccc

SEQ ID NO: 202829 - DNA, 35 bp, Artificial Sequence
  Synthetic oligonucleotide
atggtggagggggagggaggcacgggctagagaca

SEQ ID NO: 202830 - DNA, 37 bp, Artificial Sequence
  Synthetic oligonucleotide
aaatgggggcacatggggacaaactatcgggagggga

SEQ ID NO: 202831 - DNA, 35 bp, Artificial Sequence
  Synthetic oligonucleotide
atgggagggaggggcgggtacgaggcaggggtcat

SEQ ID NO: 202832 - DNA, 35 bp, Artificial Sequence
  Synthetic oligonucleotide
acacacagtaggggcgggataagcaggactgggat

SEQ ID NO: 202833 - DNA, 35 bp, Artificial Sequence
  Synthetic oligonucleotide
gcccccattgcccgatcctttctgcgttctctcga

SEQ ID NO: 202834 - DNA, 35 bp, Artificial Sequence
  Synthetic oligonucleotide
tagcagatcgccaccgccctttatatgcccgctac

SEQ ID NO: 202835 - DNA, 35 bp, Artificial Sequence
  Synthetic oligonucleotide
tgatcaccccgtcccatgcctttgaccttacgacc

SEQ ID NO: 202836 - DNA, 34 bp, Artificial Sequence
  Synthetic oligonucleotide
ttcgccgccccattgcttgttccatacgtcttcc

SEQ ID NO: 202837 - DNA, 35 bp, Artificial Sequence
  Synthetic oligonucleotide
gatgatgcgatctcagagagcctgtactaccatcg

SEQ ID NO: 202838 - DNA, 36 bp, Artificial Sequence
  Synthetic oligonucleotide
gaacatgtatctggggaccgggcgggtagggtacaa

SEQ ID NO: 202839 - DNA, 36 bp, Artificial Sequence
  Synthetic oligonucleotide
atccccgcccgcccatgcttcattacacgtttggca

SEQ ID NO: 202840 - DNA, 38 bp, Artificial Sequence
  Synthetic oligonucleotide
gctccccctctcgtcatcacagctttgctgtctgatga

SEQ ID NO: 202841 - DNA, 37 bp, Artificial Sequence
  Synthetic oligonucleotide
atcaagaagggcgggtcgaatgaactattggggctga

SEQ ID NO: 202842 - DNA, 37 bp, Artificial Sequence
  Synthetic oligonucleotide
tcacttggcgccattccttttcgcaccttctccctga

SEQ ID NO: 202843 - DNA, 35 bp, Artificial Sequence
  Synthetic oligonucleotide
acaccgcctcgaccttgcattattgaaagcttgtt

SEQ ID NO: 202844 - DNA, 36 bp, Artificial Sequence
  Synthetic oligonucleotide
gcctccaccaccccaacatgctcacgtgcatgccaa

SEQ ID NO: 202845 - DNA, 35 bp, Artificial Sequence
  Synthetic oligonucleotide
acgatgcttactttgtgcctccctgtactttaatg

SEQ ID NO: 202846 - DNA, 35 bp, Artificial Sequence
  Synthetic oligonucleotide
atgcacgatcaggtcgggggaggagggtagccttt

SEQ ID NO: 202847 - DNA, 35 bp, Artificial Sequence
  Synthetic oligonucleotide
gttagaccaaccctgatatcgcccgccgcctcgca

SEQ ID NO: 202848 - DNA, 36 bp, Artificial Sequence
  Synthetic oligonucleotide
gagcgccctccgtttttctctagcacttctcctcga

SEQ ID NO: 202849 - DNA, 35 bp, Artificial Sequence
  Synthetic oligonucleotide
gcatgcggagggagggtagtagcaggttggaggga

SEQ ID NO: 202850 - DNA, 35 bp, Artificial Sequence
  Synthetic oligonucleotide
gccaacgcctcgtaattgtaacacccccctaccct

SEQ ID NO: 202851 - DNA, 37 bp, Artificial Sequence
  Synthetic oligonucleotide
gagtagggagggaggatatacgcagacagcaaggtga

SEQ ID NO: 202852 - DNA, 35 bp, Artificial Sequence
  Synthetic oligonucleotide
tgcaagaggaggggagaaggaactgtacggagtgg

SEQ ID NO: 202853 - DNA, 35 bp, Artificial Sequence
  Synthetic oligonucleotide
gcccaactccgccgaacctggtccttctttgaatg

SEQ ID NO: 202854 - DNA, 35 bp, Artificial Sequence
  Synthetic oligonucleotide
tgtccgcccccactatggaaggctacacatcttct

SEQ ID NO: 202855 - DNA, 38 bp, Artificial Sequence
  Synthetic oligonucleotide
aagggggggagggggtgttagtcggactggctggatga

SEQ ID NO: 202856 - DNA, 37 bp, Artificial Sequence
  Synthetic oligonucleotide
tacgcgttagcaggggggatgagggacgccggggtga

SEQ ID NO: 202857 - DNA, 35 bp, Artificial Sequence
  Synthetic oligonucleotide
ggaaacggagatagggcaaatggaactggggggat

SEQ ID NO: 202858 - DNA, 35 bp, Artificial Sequence
  Synthetic oligonucleotide
atcccctgcaatttggcatggttccttctgtcctt

SEQ ID NO: 202859 - DNA, 36 bp, Artificial Sequence
  Synthetic oligonucleotide
gccgccgaacgacagcagccccccgtactccgccga

SEQ ID NO: 202860 - DNA, 37 bp, Artificial Sequence
  Synthetic oligonucleotide
tgatgatcgggggaggtacggggttcggtggaaggga

SEQ ID NO: 202861 - DNA, 36 bp, Artificial Sequence
  Synthetic oligonucleotide
tgatacccccattgggctcagtactacccttaccta

SEQ ID NO: 202862 - DNA, 35 bp, Artificial Sequence
  Synthetic oligonucleotide
tcttattttagcaagatcttttatctaaatacaat

SEQ ID NO: 202863 - DNA, 37 bp, Artificial Sequence
  Synthetic oligonucleotide
acctcgccctccactactgttcgatctccccctacga

SEQ ID NO: 202864 - DNA, 35 bp, Artificial Sequence
  Synthetic oligonucleotide
gccttcacgccaccacctgctttgaccgttgcttc

SEQ ID NO: 202865 - DNA, 36 bp, Artificial Sequence
  Synthetic oligonucleotide
tgacgacaccatctgcacccctgtttttcgaattaa

SEQ ID NO: 202866 - DNA, 36 bp, Artificial Sequence
  Synthetic oligonucleotide
tggtgaggggtgagatcgcggaacgggggggggaca

SEQ ID NO: 202867 - DNA, 35 bp, Artificial Sequence
  Synthetic oligonucleotide
tacttccaccaccctgtacactgtgctttttatca

SEQ ID NO: 202868 - DNA, 35 bp, Artificial Sequence
  Synthetic oligonucleotide
tcacactgagctccattacgtcccgcctgaactga

SEQ ID NO: 202869 - DNA, 36 bp, Artificial Sequence
  Synthetic oligonucleotide
gttgggaagggagggcatgttgggttgtcgtgcata

SEQ ID NO: 202870 - DNA, 35 bp, Artificial Sequence
  Synthetic oligonucleotide
gtgtcgctccccttacgtaaggccctcttcaactg

SEQ ID NO: 202871 - DNA, 35 bp, Artificial Sequence
  Synthetic oligonucleotide
gtcccccattgcatatttgcctgccttcccattga

SEQ ID NO: 202872 - DNA, 36 bp, Artificial Sequence
  Synthetic oligonucleotide
tcagttcgccttctcttttctccactcttacgctta

SEQ ID NO: 202873 - DNA, 36 bp, Artificial Sequence
  Synthetic oligonucleotide
aacgcccctccacctgcatcctgtttcaacggttta

SEQ ID NO: 202874 - DNA, 35 bp, Artificial Sequence
  Synthetic oligonucleotide
gctgggagggagggggtagacggggggttgccgcc

SEQ ID NO: 202875 - DNA, 35 bp, Artificial Sequence
  Synthetic oligonucleotide
acgagacagacggtgaaggtagtagggggggacat

SEQ ID NO: 202876 - DNA, 35 bp, Artificial Sequence
  Synthetic oligonucleotide
tttcctaactgcctcatgtacgcttccccccatgt

SEQ ID NO: 202877 - DNA, 37 bp, Artificial Sequence
  Synthetic oligonucleotide
ccaccttcagctgcatctcccccgtttccgctcacga

SEQ ID NO: 202878 - DNA, 36 bp, Artificial Sequence
  Synthetic oligonucleotide
gtagggtgcggcgggaagggtatgtaaatgcggaca

SEQ ID NO: 202879 - DNA, 35 bp, Artificial Sequence
  Synthetic oligonucleotide
gatcccttcaggccagtcgtcactcctctgttgga

SEQ ID NO: 202880 - DNA, 36 bp, Artificial Sequence
  Synthetic oligonucleotide
taacgccgctctcctccttcctgcgaaccacctgta

SEQ ID NO: 202881 - DNA, 35 bp, Artificial Sequence
  Synthetic oligonucleotide
accgaaacagtccgccctatcaccctgtcatttta

SEQ ID NO: 202882 - DNA, 37 bp, Artificial Sequence
  Synthetic oligonucleotide
ttgaccaccacgttaggccctgctctccttatatcga

SEQ ID NO: 202883 - DNA, 36 bp, Artificial Sequence
  Synthetic oligonucleotide
ccccaaacgccaagtggtaccgtgctccctcttcga

SEQ ID NO: 202884 - DNA, 37 bp, Artificial Sequence
  Synthetic oligonucleotide
gcaccttgaccactcagcgtgcttaaaacctcttgga

SEQ ID NO: 202885 - DNA, 35 bp, Artificial Sequence
  Synthetic oligonucleotide
ggtgagggaattctggtatcagaagggcggggtga

SEQ ID NO: 202886 - DNA, 35 bp, Artificial Sequence
  Synthetic oligonucleotide
taaggggggctcaaaatctgggggcggggttcaac

SEQ ID NO: 202887 - DNA, 35 bp, Artificial Sequence
  Synthetic oligonucleotide
tgcaagaggaggggagaaggagcggtacggagtgg

SEQ ID NO: 202888 - DNA, 36 bp, Artificial Sequence
  Synthetic oligonucleotide
gactcactgcatctcacctttcgctcgcccgcccaa

SEQ ID NO: 202889 - DNA, 36 bp, Artificial Sequence
  Synthetic oligonucleotide
gtcatcgtagccgccgctgcccactccccgacgata

SEQ ID NO: 202890 - DNA, 35 bp, Artificial Sequence
  Synthetic oligonucleotide
gaacactagccgcctcatttccgtctcccttcgag

SEQ ID NO: 202891 - DNA, 35 bp, Artificial Sequence
  Synthetic oligonucleotide
agggggggggggggcgggtacgaggcagggggcat

SEQ ID NO: 202892 - DNA, 36 bp, Artificial Sequence
  Synthetic oligonucleotide
tactaagcagccccttgctaaccgctggccccttta

SEQ ID NO: 202893 - DNA, 35 bp, Artificial Sequence
  Synthetic oligonucleotide
atcgtgcacacgctgccgagcctccatccttttta

SEQ ID NO: 202894 - DNA, 37 bp, Artificial Sequence
  Synthetic oligonucleotide
gccccgacctctgcctgaatcacgtatcgtcgttaga

SEQ ID NO: 202895 - DNA, 36 bp, Artificial Sequence
  Synthetic oligonucleotide
tcctccgaacgacagcagccccccgtactccgccga

SEQ ID NO: 202896 - DNA, 35 bp, Artificial Sequence
  Synthetic oligonucleotide
tggggagggaggggcgggtacgaggcagggggcat

SEQ ID NO: 202897 - DNA, 35 bp, Artificial Sequence
  Synthetic oligonucleotide
tgcgacgaaatcggctctccctgttcccccgttga

SEQ ID NO: 202898 - DNA, 35 bp, Artificial Sequence
  Synthetic oligonucleotide
tgcaagaggaggggagaaggaacagtacggagtgg

SEQ ID NO: 202899 - DNA, 35 bp, Artificial Sequence
  Synthetic oligonucleotide
gtcacaccacctgccatctattagaatgagacttt

SEQ ID NO: 202900 - DNA, 36 bp, Artificial Sequence
  Synthetic oligonucleotide
aactcatcctctcgcattttgcctgcttcctccgaa

SEQ ID NO: 202901 - DNA, 38 bp, Artificial Sequence
  Synthetic oligonucleotide
agtggaatgaggtattgggagtgacgggatatgagtga

SEQ ID NO: 202902 - DNA, 36 bp, Artificial Sequence
  Synthetic oligonucleotide
aaggccacctccgccgcatccttgtatgcttaccta

SEQ ID NO: 202903 - DNA, 35 bp, Artificial Sequence
  Synthetic oligonucleotide
gcccgaatgcccgtggactcgcccatcctccccga

SEQ ID NO: 202904 - DNA, 35 bp, Artificial Sequence
  Synthetic oligonucleotide
tcacactcgccgcggacgccccgaacctctcaccg

SEQ ID NO: 202905 - DNA, 35 bp, Artificial Sequence
  Synthetic oligonucleotide
tcgttgacgcactgccttcttcttttcgctgttca

SEQ ID NO: 202906 - DNA, 35 bp, Artificial Sequence
  Synthetic oligonucleotide
gcatacgtgagcctgttcttcacatcttctccgtt

SEQ ID NO: 202907 - DNA, 38 bp, Artificial Sequence
  Synthetic oligonucleotide
ttggggggccggaggaagggcgggggggagacgtgtga

SEQ ID NO: 202908 - DNA, 35 bp, Artificial Sequence
  Synthetic oligonucleotide
tcacagactcgccatccagcctctaacttatcata

SEQ ID NO: 202909 - DNA, 35 bp, Artificial Sequence
  Synthetic oligonucleotide
acagagcgcatggggtgtaaaaatgggggggggat

SEQ ID NO: 202910 - DNA, 35 bp, Artificial Sequence
  Synthetic oligonucleotide
gcaactcgaaccccttccgcgccgccctcctgcct

SEQ ID NO: 202911 - DNA, 38 bp, Artificial Sequence
  Synthetic oligonucleotide
tacgacgcctattcacgcgttatgtccattatccctga

SEQ ID NO: 202912 - DNA, 36 bp, Artificial Sequence
  Synthetic oligonucleotide
tccactccgttcccccttagctgccgtacgtccgta

SEQ ID NO: 202913 - DNA, 36 bp, Artificial Sequence
  Synthetic oligonucleotide
cccgccgaacgacagcagccccccgtactccgccga

SEQ ID NO: 202914 - DNA, 38 bp, Artificial Sequence
  Synthetic oligonucleotide
ggatggggtggcggaggcatacgcaggcggcatcctga

SEQ ID NO: 202915 - DNA, 36 bp, Artificial Sequence
  Synthetic oligonucleotide
gacccatccctgctctcccgctgctaagctttccga

SEQ ID NO: 202916 - DNA, 38 bp, Artificial Sequence
  Synthetic oligonucleotide
acagacacccgcgccccactacgcctctcctgtcgtga

SEQ ID NO: 202917 - DNA, 35 bp, Artificial Sequence
  Synthetic oligonucleotide
acaccccgccccgttacgcccgaccgaagccccgt

SEQ ID NO: 202918 - DNA, 35 bp, Artificial Sequence
  Synthetic oligonucleotide
tgacggtccaccttcccagcatacttccttaacga

SEQ ID NO: 202919 - DNA, 37 bp, Artificial Sequence
  Synthetic oligonucleotide
gacccccgccggtgaataacgttctatccctcacgga

SEQ ID NO: 202920 - DNA, 37 bp, Artificial Sequence
  Synthetic oligonucleotide
accgtgctgcctcctcttggcctttcccggtttgtga

SEQ ID NO: 202921 - DNA, 38 bp, Artificial Sequence
  Synthetic oligonucleotide
gatctgggaagggtgggaagatggaaggatggagttga

SEQ ID NO: 202922 - DNA, 35 bp, Artificial Sequence
  Synthetic oligonucleotide
gattacgcatgcccccacgaccctccgcaatactg

SEQ ID NO: 202923 - DNA, 35 bp, Artificial Sequence
  Synthetic oligonucleotide
tcccgcctttcgctttgccacaaataccactctga

SEQ ID NO: 202924 - DNA, 35 bp, Artificial Sequence
  Synthetic oligonucleotide
gcctgcccccccctaatgcctacttggcgatatcg

SEQ ID NO: 202925 - DNA, 35 bp, Artificial Sequence
  Synthetic oligonucleotide
ggatgaggggggtgaagagcaaggagcataagcgt

SEQ ID NO: 202926 - DNA, 35 bp, Artificial Sequence
  Synthetic oligonucleotide
accgcctggtacctctttcttcatactcccacgta

SEQ ID NO: 202927 - DNA, 35 bp, Artificial Sequence
  Synthetic oligonucleotide
atggggggggggggcgggtacgaggcagggggcat

SEQ ID NO: 202928 - DNA, 38 bp, Artificial Sequence
  Synthetic oligonucleotide
tgttgagcgctctagcatcctctcctgttcctgcctga

SEQ ID NO: 202929 - DNA, 35 bp, Artificial Sequence
  Synthetic oligonucleotide
tcccgtgctgccccttctcgtctccttcccaggtg

SEQ ID NO: 202930 - DNA, 36 bp, Artificial Sequence
  Synthetic oligonucleotide
tgctgccaccatctctttttcacgctcgccagggat

SEQ ID NO: 202931 - DNA, 35 bp, Artificial Sequence
  Synthetic oligonucleotide
tgccccactccgtccgacttcttcacctccttaag

SEQ ID NO: 202932 - DNA, 35 bp, Artificial Sequence
  Synthetic oligonucleotide
aagagccggggggcagagcaggagggatgtttggg

SEQ ID NO: 202933 - DNA, 37 bp, Artificial Sequence
  Synthetic oligonucleotide
acgtacccgcatgctacccccctttggcatcacccga

SEQ ID NO: 202934 - DNA, 38 bp, Artificial Sequence
  Synthetic oligonucleotide
atcaagcccattgtgccactccccgtcacgctccctga

SEQ ID NO: 202935 - DNA, 38 bp, Artificial Sequence
  Synthetic oligonucleotide
atcgcgtagtcgacggagaaggaggaaagaaggcgtga

SEQ ID NO: 202936 - DNA, 35 bp, Artificial Sequence
  Synthetic oligonucleotide
atccccgcactacgctacaactcttttcctcgtga

SEQ ID NO: 202937 - DNA, 35 bp, Artificial Sequence
  Synthetic oligonucleotide
tcagggatagtaggagagggaagtgggggtccggg

SEQ ID NO: 202938 - DNA, 36 bp, Artificial Sequence
  Synthetic oligonucleotide
agatctgatacctgcgcccgctttcgctccctgcca

SEQ ID NO: 202939 - DNA, 35 bp, Artificial Sequence
  Synthetic oligonucleotide
ttggggaaggagtgggtgaaggggaggacactcaa

SEQ ID NO: 202940 - DNA, 36 bp, Artificial Sequence
  Synthetic oligonucleotide
acacgggtggcgatcgggggtggggtcagcctctaa

SEQ ID NO: 202941 - DNA, 35 bp, Artificial Sequence
  Synthetic oligonucleotide
agggtggagggggagggagggacgggctagagaca

SEQ ID NO: 202942 - DNA, 35 bp, Artificial Sequence
  Synthetic oligonucleotide
tcaacgccccctccttcacagctccactcgctcca

SEQ ID NO: 202943 - DNA, 37 bp, Artificial Sequence
  Synthetic oligonucleotide
gcccatgccgtactcctcgttactgttcatcatccga

SEQ ID NO: 202944 - DNA, 38 bp, Artificial Sequence
  Synthetic oligonucleotide
tctaccctccgacgcccttagccagctcagttcgctga

SEQ ID NO: 202945 - DNA, 35 bp, Artificial Sequence
  Synthetic oligonucleotide
gaagggggacggaagtaacattaaaggagtccggg

SEQ ID NO: 202946 - DNA, 35 bp, Artificial Sequence
  Synthetic oligonucleotide
gcaaacgcggggaaggaacgggaggaggggaagca

SEQ ID NO: 202947 - DNA, 35 bp, Artificial Sequence
  Synthetic oligonucleotide
tgcaaactgcctccgaccccccgctctcatgagtg

SEQ ID NO: 202948 - DNA, 36 bp, Artificial Sequence
  Synthetic oligonucleotide
ttggggggggggaggaatagcactaggctagggcga

SEQ ID NO: 202949 - DNA, 38 bp, Artificial Sequence
  Synthetic oligonucleotide
gatcacccccagaacgtatttcgcgccgccttttttga

SEQ ID NO: 202950 - DNA, 37 bp, Artificial Sequence
  Synthetic oligonucleotide
gctgacaccctccctgcttttcactggacactccaga

SEQ ID NO: 202951 - DNA, 35 bp, Artificial Sequence
  Synthetic oligonucleotide
gtcgtgttcccgctgtcctacccctacgtccccga

SEQ ID NO: 202952 - DNA, 38 bp, Artificial Sequence
  Synthetic oligonucleotide
tgagggcggagggaggagggtggatttggacggtatga

SEQ ID NO: 202953 - DNA, 36 bp, Artificial Sequence
  Synthetic oligonucleotide
gcagggcgagaagaaacgggcaacgggaggggggaa

SEQ ID NO: 202954 - DNA, 37 bp, Artificial Sequence
  Synthetic oligonucleotide
actccccagtcccaccgttgtcttccccggccttcga

SEQ ID NO: 202955 - DNA, 37 bp, Artificial Sequence
  Synthetic oligonucleotide
ttaacggtgatgtagggtggtaaaaggatagggcgga

SEQ ID NO: 202956 - DNA, 36 bp, Artificial Sequence
  Synthetic oligonucleotide
gtgcgtacccagccgtctccacttcactgccttgga

SEQ ID NO: 202957 - DNA, 36 bp, Artificial Sequence
  Synthetic oligonucleotide
gtatggcacacccatcatagcccattatttacccga

SEQ ID NO: 202958 - DNA, 35 bp, Artificial Sequence
  Synthetic oligonucleotide
tgagccggaggaagtggtggaggagggtgaacggg

SEQ ID NO: 202959 - DNA, 38 bp, Artificial Sequence
  Synthetic oligonucleotide
gaagggcgggaggggtgggcataaatcgttcaggttga

SEQ ID NO: 202960 - DNA, 37 bp, Artificial Sequence
  Synthetic oligonucleotide
acgtaccagcctgctacccccctttggcatcacccga

SEQ ID NO: 202961 - DNA, 38 bp, Artificial Sequence
  Synthetic oligonucleotide
aaacagggggatgggcggtggatgggctaggcatgtga

SEQ ID NO: 202962 - DNA, 36 bp, Artificial Sequence
  Synthetic oligonucleotide
acgctcacctccttgcattgtcctatcgattctgta

SEQ ID NO: 202963 - DNA, 35 bp, Artificial Sequence
  Synthetic oligonucleotide
gaccgccaacactcgcaccttcaccccctaccgtg

SEQ ID NO: 202964 - DNA, 35 bp, Artificial Sequence
  Synthetic oligonucleotide
tgctctgcccttgttttgttgtccctgtggtcttt

SEQ ID NO: 202965 - DNA, 38 bp, Artificial Sequence
  Synthetic oligonucleotide
ttgacgacacgaggggcttgcggaggagaattgggtga

SEQ ID NO: 202966 - DNA, 36 bp, Artificial Sequence
  Synthetic oligonucleotide
gatagggggggctagagaaaagagggggggccagaa

SEQ ID NO: 202967 - DNA, 37 bp, Artificial Sequence
  Synthetic oligonucleotide
acgtacacgcctgctacccccctttggcatcacccga

SEQ ID NO: 202968 - DNA, 38 bp, Artificial Sequence
  Synthetic oligonucleotide
ttgatggggttgttgtaacgggcgggagcacggggtga

SEQ ID NO: 202969 - DNA, 35 bp, Artificial Sequence
  Synthetic oligonucleotide
gagtgcaaggggggggtggggacgggggggtagag

SEQ ID NO: 202970 - DNA, 37 bp, Artificial Sequence
  Synthetic oligonucleotide
taggacccgcccccccggctgccgccgcctatcgtga

SEQ ID NO: 202971 - DNA, 38 bp, Artificial Sequence
  Synthetic oligonucleotide
aaccccaactgcacttctctccactcaagctcacttga

SEQ ID NO: 202972 - DNA, 37 bp, Artificial Sequence
  Synthetic oligonucleotide
gggggagagaacgggggggcatgtaggtaagggtaga

SEQ ID NO: 202973 - DNA, 36 bp, Artificial Sequence
  Synthetic oligonucleotide
atgtcaccgagccgcctgccttccctcatccccgca

SEQ ID NO: 202974 - DNA, 37 bp, Artificial Sequence
  Synthetic oligonucleotide
tgactgggtgaggggggtaggggaataaactggggga

SEQ ID NO: 202975 - DNA, 35 bp, Artificial Sequence
  Synthetic oligonucleotide
tagcaactggccggttctcccccgttcactcccga

SEQ ID NO: 202976 - DNA, 36 bp, Artificial Sequence
  Synthetic oligonucleotide
gacgtttatgggaacagggggagggcgcattacgga

SEQ ID NO: 202977 - DNA, 35 bp, Artificial Sequence
  Synthetic oligonucleotide
gcctgccacccccctgccataagtcccggccacag

SEQ ID NO: 202978 - DNA, 36 bp, Artificial Sequence
  Synthetic oligonucleotide
gttcctacgcacccaccacctagttctcgtttgtga

SEQ ID NO: 202979 - DNA, 35 bp, Artificial Sequence
  Synthetic oligonucleotide
atgcctcatatgaccgcgcccttagtctccttcta

SEQ ID NO: 202980 - DNA, 36 bp, Artificial Sequence
  Synthetic oligonucleotide
taaggtagtgcagccgcctttcttcgtccttaggta

SEQ ID NO: 202981 - DNA, 36 bp, Artificial Sequence
  Synthetic oligonucleotide
gctctccgcccaccccgtatacctcggttgcctcca

SEQ ID NO: 202982 - DNA, 35 bp, Artificial Sequence
  Synthetic oligonucleotide
gtccccgccgccctaccccttatggactatctcca

SEQ ID NO: 202983 - DNA, 35 bp, Artificial Sequence
  Synthetic oligonucleotide
gagacacaagggcgatgaggtgtgggggccgtgga

SEQ ID NO: 202984 - DNA, 38 bp, Artificial Sequence
  Synthetic oligonucleotide
ttgcgcctcggtctccggcctgcctgttccacccttga

SEQ ID NO: 202985 - DNA, 36 bp, Artificial Sequence
  Synthetic oligonucleotide
acctgcacccgtcctacttacctaaattctgctgta

SEQ ID NO: 202986 - DNA, 35 bp, Artificial Sequence
  Synthetic oligonucleotide
aggggaggctgggggcgggagggcaacagcagaat

SEQ ID NO: 202987 - DNA, 38 bp, Artificial Sequence
  Synthetic oligonucleotide
tactccgccatactacccagccctgatacttccggtga

SEQ ID NO: 202988 - DNA, 35 bp, Artificial Sequence
  Synthetic oligonucleotide
aattgtacgcctctccgccctattgctttacagaa

SEQ ID NO: 202989 - DNA, 35 bp, Artificial Sequence
  Synthetic oligonucleotide
tctcatgacccctccgacaaccaacgttagcctcg

SEQ ID NO: 202990 - DNA, 36 bp, Artificial Sequence
  Synthetic oligonucleotide
gggacctcccgcctttaccactttttgccatcatga

SEQ ID NO: 202991 - DNA, 35 bp, Artificial Sequence
  Synthetic oligonucleotide
gaacacagcggggggcaggtgggcgtagggggggg

SEQ ID NO: 202992 - DNA, 35 bp, Artificial Sequence
  Synthetic oligonucleotide
gagggtagtggggggaagcttggagtacggggggg

SEQ ID NO: 202993 - DNA, 37 bp, Artificial Sequence
  Synthetic oligonucleotide
gtgactccgtcgcaggacacatccccccctttcacga

SEQ ID NO: 202994 - DNA, 36 bp, Artificial Sequence
  Synthetic oligonucleotide
tccgccgaacgacagcatccccccgtactccgccga

SEQ ID NO: 202995 - DNA, 37 bp, Artificial Sequence
  Synthetic oligonucleotide
tgaccatggtctgcgcgcatcttgtcccccctcacga

SEQ ID NO: 202996 - DNA, 35 bp, Artificial Sequence
  Synthetic oligonucleotide
atggggggggagtgagacgggaaggggaagagaac

SEQ ID NO: 202997 - DNA, 35 bp, Artificial Sequence
  Synthetic oligonucleotide
tgcaagaggaggggagaaggaaccgtacggagtgg

SEQ ID NO: 202998 - DNA, 35 bp, Artificial Sequence
  Synthetic oligonucleotide
gcctcagaccgcctgcttcgtgttccatcccctca

SEQ ID NO: 202999 - DNA, 36 bp, Artificial Sequence
  Synthetic oligonucleotide
aactccgctgcactgcccctggtacccctctacgga

SEQ ID NO: 203000 - DNA, 37 bp, Artificial Sequence
  Synthetic oligonucleotide
acagagggggggagttatcgggggtcaagagagggga

SEQ ID NO: 203001 - DNA, 35 bp, Artificial Sequence
  Synthetic oligonucleotide
gcaaccatttccgtttccgcccctccgctgtggta

SEQ ID NO: 203002 - DNA, 37 bp, Artificial Sequence
  Synthetic oligonucleotide
gaggggcaatggaaaggggggggtccaaagtcgggga

SEQ ID NO: 203003 - DNA, 35 bp, Artificial Sequence
  Synthetic oligonucleotide
aggggaggggggggggggtacgaggcagggggcat

SEQ ID NO: 203004 - DNA, 35 bp, Artificial Sequence
  Synthetic oligonucleotide
accgacaccgctgctgctctcatgttgctccacct

SEQ ID NO: 203005 - DNA, 36 bp, Artificial Sequence
  Synthetic oligonucleotide
tgcatcgcgaagaccgccattatctttcccccccca

SEQ ID NO: 203006 - DNA, 35 bp, Artificial Sequence
  Synthetic oligonucleotide
atcccactccacgcaccctgaatccttcgttcgtt

SEQ ID NO: 203007 - DNA, 36 bp, Artificial Sequence
  Synthetic oligonucleotide
gttccggccaacctgatccgtgccttccccctgtga

SEQ ID NO: 203008 - DNA, 36 bp, Artificial Sequence
  Synthetic oligonucleotide
tgtaatcgacagttgttcccggcccttcattcgtca

SEQ ID NO: 203009 - DNA, 35 bp, Artificial Sequence
  Synthetic oligonucleotide
gagggagggggaattaaagcaaggcatgggggggg

SEQ ID NO: 203010 - DNA, 35 bp, Artificial Sequence
  Synthetic oligonucleotide
gagtggaaggggggagtggggacgggggggtagag

SEQ ID NO: 203011 - DNA, 35 bp, Artificial Sequence
  Synthetic oligonucleotide
atggggggggggggggggtacgaggcagggggcat

SEQ ID NO: 203012 - DNA, 37 bp, Artificial Sequence
  Synthetic oligonucleotide
ttcaccgcctaatctcgtcgcactatcttcagtcaga

SEQ ID NO: 203013 - DNA, 35 bp, Artificial Sequence
  Synthetic oligonucleotide
taccactgacttgcctaatctcgttcttcacccga

SEQ ID NO: 203014 - DNA, 37 bp, Artificial Sequence
  Synthetic oligonucleotide
attatgcccccgtaaccttctcgctgcacagttccga

SEQ ID NO: 203015 - DNA, 38 bp, Artificial Sequence
  Synthetic oligonucleotide
gtgccctctgctacttatacccgttcctccatctgtga

SEQ ID NO: 203016 - DNA, 35 bp, Artificial Sequence
  Synthetic oligonucleotide
agacccgatgtcattgcctatgatcctccctttca

SEQ ID NO: 203017 - DNA, 35 bp, Artificial Sequence
  Synthetic oligonucleotide
atgggaggggggggggggtacgaggcagggggcat

SEQ ID NO: 203018 - DNA, 36 bp, Artificial Sequence
  Synthetic oligonucleotide
tgtacaccaccatgcccatttaagcgtccttactga

SEQ ID NO: 203019 - DNA, 36 bp, Artificial Sequence
  Synthetic oligonucleotide
gctcatcacattataatctagctacgtaccccccga

SEQ ID NO: 203020 - DNA, 35 bp, Artificial Sequence
  Synthetic oligonucleotide
gagtgcaaggggggagtggggaggggggggtagag

SEQ ID NO: 203021 - DNA, 35 bp, Artificial Sequence
  Synthetic oligonucleotide
agggaaggggagaagggaagaacagaagtcatagg

SEQ ID NO: 203022 - DNA, 35 bp, Artificial Sequence
  Synthetic oligonucleotide
ttacccgcccaccatactgcgcctctccgccggaa

SEQ ID NO: 203023 - DNA, 35 bp, Artificial Sequence
  Synthetic oligonucleotide
gagtgcaaggggggagtggggacgggtgggtagag

SEQ ID NO: 203024 - DNA, 35 bp, Artificial Sequence
  Synthetic oligonucleotide
atccacacgcttacgacgctgccacttccattttt

SEQ ID NO: 203025 - DNA, 36 bp, Artificial Sequence
  Synthetic oligonucleotide
tcagcactatctatgccacttgcccgcccgcttgaa

SEQ ID NO: 203026 - DNA, 36 bp, Artificial Sequence
  Synthetic oligonucleotide
taaccccgctgacttgcgactccatgcgcctcccga

SEQ ID NO: 203027 - DNA, 36 bp, Artificial Sequence
  Synthetic oligonucleotide
gcccccaccttcccaagattgtcatttgcttctata

SEQ ID NO: 203028 - DNA, 35 bp, Artificial Sequence
  Synthetic oligonucleotide
tagcacgtgggggggaggagggaacctgagccggg

SEQ ID NO: 203029 - DNA, 35 bp, Artificial Sequence
  Synthetic oligonucleotide
gcaaacgcggggaaggaacgggaggaggggaatcg

SEQ ID NO: 203030 - DNA, 38 bp, Artificial Sequence
  Synthetic oligonucleotide
gagtactggagggggcgggagaaggggggtggagctga

SEQ ID NO: 203031 - DNA, 35 bp, Artificial Sequence
  Synthetic oligonucleotide
gtgtgcccatccgttccctctccatttcagttttg

SEQ ID NO: 203032 - DNA, 35 bp, Artificial Sequence
  Synthetic oligonucleotide
agagccaatgaggggggggggagacaagggatgga

SEQ ID NO: 203033 - DNA, 36 bp, Artificial Sequence
  Synthetic oligonucleotide
atttggggtggtgacggaccggagaggggtggtgga

SEQ ID NO: 203034 - DNA, 35 bp, Artificial Sequence
  Synthetic oligonucleotide
gcatcatgcctccatcccgtttcgctacgcatgta

SEQ ID NO: 203035 - DNA, 37 bp, Artificial Sequence
  Synthetic oligonucleotide
atgactgcgccctccccctgcctgccactatccctga

SEQ ID NO: 203036 - DNA, 35 bp, Artificial Sequence
  Synthetic oligonucleotide
accgccggcgaaggggctgaactagggggggggca

SEQ ID NO: 203037 - DNA, 35 bp, Artificial Sequence
  Synthetic oligonucleotide
ttggcgggctagcgatctgggggggtggatgtgga

SEQ ID NO: 203038 - DNA, 37 bp, Artificial Sequence
  Synthetic oligonucleotide
agaaggcggggggggtagggacggtagctagggggga

SEQ ID NO: 203039 - DNA, 34 bp, Artificial Sequence
  Synthetic oligonucleotide
gctgggagacgagagtggggggggggacacagcg

SEQ ID NO: 203040 - DNA, 35 bp, Artificial Sequence
  Synthetic oligonucleotide
tactgcccggcactctatgtattccacctctcttg

SEQ ID NO: 203041 - DNA, 36 bp, Artificial Sequence
  Synthetic oligonucleotide
gacgagcgggggggggagctaagtaggggggacgga

SEQ ID NO: 203042 - DNA, 35 bp, Artificial Sequence
  Synthetic oligonucleotide
agcgatgcttctgcccgttttatcctgctccgcta

SEQ ID NO: 203043 - DNA, 36 bp, Artificial Sequence
  Synthetic oligonucleotide
agaggagaagcgcaggtgggctggggcggggggtta

SEQ ID NO: 203044 - DNA, 38 bp, Artificial Sequence
  Synthetic oligonucleotide
aagatcgtgaggggggggccggatgaggtcggagctga

SEQ ID NO: 203045 - DNA, 36 bp, Artificial Sequence
  Synthetic oligonucleotide
ggacaggggtggaaaaggaggagtgaagtgtgtaag

SEQ ID NO: 203046 - DNA, 36 bp, Artificial Sequence
  Synthetic oligonucleotide
acatccgcctctgcctaccccgctctacatgcgtta

SEQ ID NO: 203047 - DNA, 38 bp, Artificial Sequence
  Synthetic oligonucleotide
gatgggcggggcacgagactaggagggggggaggttga

SEQ ID NO: 203048 - DNA, 35 bp, Artificial Sequence
  Synthetic oligonucleotide
tgagccggaggaagtggtggaggagagtgaactgg

SEQ ID NO: 203049 - DNA, 35 bp, Artificial Sequence
  Synthetic oligonucleotide
gatgcacgggggggggatatggagctgggggctaa

SEQ ID NO: 203050 - DNA, 36 bp, Artificial Sequence
  Synthetic oligonucleotide
tacgccgaacgacagcagccccccgtactccgccga

SEQ ID NO: 203051 - DNA, 37 bp, Artificial Sequence
  Synthetic oligonucleotide
gacctgggggggggtaggaactcggggtaaatgggga

SEQ ID NO: 203052 - DNA, 35 bp, Artificial Sequence
  Synthetic oligonucleotide
tataagaatctctacttactttacaaagtactgga

SEQ ID NO: 203053 - DNA, 35 bp, Artificial Sequence
  Synthetic oligonucleotide
gtttgctttttagaactcgataaattacagaatat

SEQ ID NO: 203054 - DNA, 35 bp, Artificial Sequence
  Synthetic oligonucleotide
gagtagagcgtggggggggaaattggctagggggg

SEQ ID NO: 203055 - DNA, 35 bp, Artificial Sequence
  Synthetic oligonucleotide
aactacctgcacatccctttcctatgcccgcccga

SEQ ID NO: 203056 - DNA, 38 bp, Artificial Sequence
  Synthetic oligonucleotide
gggtgggtggggtgggtatgtgtacgtcacgggactga

SEQ ID NO: 203057 - DNA, 37 bp, Artificial Sequence
  Synthetic oligonucleotide
gcatggggggggaggtgaggtaaggggggcatcttga

SEQ ID NO: 203058 - DNA, 36 bp, Artificial Sequence
  Synthetic oligonucleotide
ggacaggggtggaaaaggaggagtgaaggttgtaag

SEQ ID NO: 203059 - DNA, 36 bp, Artificial Sequence
  Synthetic oligonucleotide
ggacaggggtggaaaaggaggagtgaaggctgtaag

SEQ ID NO: 203060 - DNA, 35 bp, Artificial Sequence
  Synthetic oligonucleotide
atgaggggggtcgacagagagacgggggggaaagg

SEQ ID NO: 203061 - DNA, 37 bp, Artificial Sequence
  Synthetic oligonucleotide
tcagggtgggggggagaatagacgacggggtacaaga

SEQ ID NO: 203062 - DNA, 35 bp, Artificial Sequence
  Synthetic oligonucleotide
aaaaaaaaaaaaaaaaaaaaaaaaaaaaaaaaaaa

SEQ ID NO: 203063 - DNA, 15 bp, Artificial Sequence
  Synthetic oligonucleotide
tcgtcggcagcgtca

SEQ ID NO: 203064 - DNA, 35 bp, Artificial Sequence
  Synthetic oligonucleotide
gcttcccgcaaccgtcctacccatcctacgcctcc

SEQ ID NO: 203065 - DNA, 36 bp, Artificial Sequence
  Synthetic oligonucleotide
tggtcaccgcttccgctggtacgccccaccccataa

SEQ ID NO: 203066 - DNA, 36 bp, Artificial Sequence
  Synthetic oligonucleotide
acctagctgctccctactcccttcttatgtacatta

SEQ ID NO: 203067 - DNA, 38 bp, Artificial Sequence
  Synthetic oligonucleotide
ttcatgctgttccatgacctccacatttctcacgctga

SEQ ID NO: 203068 - DNA, 88 bp, Artificial Sequence
  Synthetic oligonucleotide
ctagcatgactgcagtacgtgcttcccgcaaccgtcctacccatcctacgcctccctgtctcttatacacatctgacgctgccgacga

SEQ ID NO: 203069 - DNA, 88 bp, Artificial Sequence
  Synthetic oligonucleotide
tcgtcggcagcgtcagatgtgtataagagacagggaggcgtaggatgggtaggacggttgcgggaagcacgtactgcagtcatgctag

SEQ ID NO: 203070 - DNA, 89 bp, Artificial Sequence
  Synthetic oligonucleotide
ctagcatgactgcagtacgttggtcaccgcttccgctggtacgccccaccccataactgtctcttatacacatctgacgctgccgacga

SEQ ID NO: 203071 - DNA, 89 bp, Artificial Sequence
  Synthetic oligonucleotide
tcgtcggcagcgtcagatgtgtataagagacagttatggggtggggcgtaccagcggaagcggtgaccaacgtactgcagtcatgctag

SEQ ID NO: 203072 - DNA, 89 bp, Artificial Sequence
  Synthetic oligonucleotide
ctagcatgactgcagtacgtacctagctgctccctactcccttcttatgtacattactgtctcttatacacatctgacgctgccgacga

SEQ ID NO: 203073 - DNA, 89 bp, Artificial Sequence
  Synthetic oligonucleotide
tcgtcggcagcgtcagatgtgtataagagacagtaatgtacataagaagggagtagggagcagctaggtacgtactgcagtcatgctag

SEQ ID NO: 203074 - DNA, 91 bp, Artificial Sequence
  Synthetic oligonucleotide
ctagcatgactgcagtacgtttcatgctgttccatgacctccacatttctcacgctgactgtctcttatacacatctgacgctgccgacga

SEQ ID NO: 203075 - DNA, 91 bp, Artificial Sequence
  Synthetic oligonucleotide
tcgtcggcagcgtcagatgtgtataagagacagtcagcgtgagaaatgtggaggtcatggaacagcatgaaacgtactgcagtcatgctag

SEQ ID NO: 203076 - DNA, 35 bp, Artificial Sequence
  Synthetic oligonucleotide
atatgcgatgctagctcgaagcgtgtgcagtccct

SEQ ID NO: 203077 - DNA, 36 bp, Artificial Sequence
  Synthetic oligonucleotide
gtccagctcgcaattacactagtttgccagtaaaag

SEQ ID NO: 203078 - DNA, 35 bp, Artificial Sequence
  Synthetic oligonucleotide
tccggagtccataagactacggatagctttgaccg

SEQ ID NO: 203079 - DNA, 36 bp, Artificial Sequence
  Synthetic oligonucleotide
catgcacatcgcgtttcggaaacaaaagtgtagata

SEQ ID NO: 203080 - DNA, 35 bp, Artificial Sequence
  Synthetic oligonucleotide
ccacacgacgtgtgacctcggattcctcatacact

SEQ ID NO: 203081 - DNA, 35 bp, Artificial Sequence
  Synthetic oligonucleotide
actgggtacttgaatcattgtcgcatttccctatt

SEQ ID NO: 203082 - DNA, 36 bp, Artificial Sequence
  Synthetic oligonucleotide
cgtagttaagacgcctcaagacacatacggcttgaa

SEQ ID NO: 203083 - DNA, 34 bp, Artificial Sequence
  Synthetic oligonucleotide
tcatgaccgagtaacgaccgacccacatatccgc

SEQ ID NO: 203084 - DNA, 33 bp, Artificial Sequence
  Synthetic oligonucleotide
gttggctccctctagcatatccccactagctgg

SEQ ID NO: 203085 - DNA, 35 bp, Artificial Sequence
  Synthetic oligonucleotide
cgcccactcttgttgttaccgtgctgtcctcggtc

SEQ ID NO: 203086 - DNA, 35 bp, Artificial Sequence
  Synthetic oligonucleotide
gcatgtgtggtttccccagcgcactcgagacgact

SEQ ID NO: 203087 - DNA, 35 bp, Artificial Sequence
  Synthetic oligonucleotide
gaaaagtcagacttttgaaggattgtgctggaact

SEQ ID NO: 203088 - DNA, 37 bp, Artificial Sequence
  Synthetic oligonucleotide
gaacatgaagcatcgaaagcacttcacgtagattcga

SEQ ID NO: 203089 - DNA, 37 bp, Artificial Sequence
  Synthetic oligonucleotide
ttgtggattcaagcggtcaccactatgccaacttcca

SEQ ID NO: 203090 - DNA, 37 bp, Artificial Sequence
  Synthetic oligonucleotide
ccaccttttccacccattccaggatagtcgcccacga

SEQ ID NO: 203091 - DNA, 37 bp, Artificial Sequence
  Synthetic oligonucleotide
gttcggatgcccacagcccgttaaggtattttcacga

SEQ ID NO: 203092 - DNA, 35 bp, Artificial Sequence
  Synthetic oligonucleotide
ttgtgggggacgtatgagcagatccatgcgcgcca

SEQ ID NO: 203093 - DNA, 35 bp, Artificial Sequence
  Synthetic oligonucleotide
agatctccggtacgccaccggcgataccgattcag

SEQ ID NO: 203094 - DNA, 35 bp, Artificial Sequence
  Synthetic oligonucleotide
gtaacccgattttcacggccgaccgcatacgcgcc

SEQ ID NO: 203095 - DNA, 35 bp, Artificial Sequence
  Synthetic oligonucleotide
gctagacacttacagtgacgttactgtcttgagct

SEQ ID NO: 203096 - DNA, 35 bp, Artificial Sequence
  Synthetic oligonucleotide
ggacattcaggtgtcgctcatccaaagctacgtgc

SEQ ID NO: 203097 - DNA, 35 bp, Artificial Sequence
  Synthetic oligonucleotide
gttatcgcactgaaaagtaattccttgtatactct

SEQ ID NO: 203098 - DNA, 35 bp, Artificial Sequence
  Synthetic oligonucleotide
gcaaaggatcctggttgggcactttgttcctttcc

SEQ ID NO: 203099 - DNA, 38 bp, Artificial Sequence
  Synthetic oligonucleotide
acccactaggaggtcgttaaaggatagttgtaaactca

SEQ ID NO: 203100 - DNA, 38 bp, Artificial Sequence
  Synthetic oligonucleotide
tcttgcctctgtatgagcgagaacttctcgcgcgttca

SEQ ID NO: 203101 - DNA, 35 bp, Artificial Sequence
  Synthetic oligonucleotide
gtcagtccctggagtccatgtgctttaccgccgtc

SEQ ID NO: 203102 - DNA, 37 bp, Artificial Sequence
  Synthetic oligonucleotide
gaaagacaacacgtatacatccctgagccacccacga

SEQ ID NO: 203103 - DNA, 37 bp, Artificial Sequence
  Synthetic oligonucleotide
ccattgctcttacaccgcctgtccttacggttgtgga

SEQ ID NO: 203104 - DNA, 34 bp, Artificial Sequence
  Synthetic oligonucleotide
tgtttgccgatctctcatctggaggaacggggca

SEQ ID NO: 203105 - DNA, 38 bp, Artificial Sequence
  Synthetic oligonucleotide
gtagtatgttctctttactgcgacatgagtttcggtca

SEQ ID NO: 203106 - DNA, 37 bp, Artificial Sequence
  Synthetic oligonucleotide
cgtcacgacacctacacaaagccgcactccctctgga

SEQ ID NO: 203107 - DNA, 36 bp, Artificial Sequence
  Synthetic oligonucleotide
gtatggttaacaccaattaccggatccgtagattca

SEQ ID NO: 203108 - DNA, 35 bp, Artificial Sequence
  Synthetic oligonucleotide
aacaataccacagtggatgctaccagtcccattat

SEQ ID NO: 203109 - DNA, 38 bp, Artificial Sequence
  Synthetic oligonucleotide
gacccgttttgtcgttgtattgatatggtacgtcttga

SEQ ID NO: 203110 - DNA, 35 bp, Artificial Sequence
  Synthetic oligonucleotide
aaatcgcgaccgggacagtgccgatatttttcacg

SEQ ID NO: 203111 - DNA, 35 bp, Artificial Sequence
  Synthetic oligonucleotide
ctatccgatgctaccactgtttgaaatcaacagcc

SEQ ID NO: 203112 - DNA, 37 bp, Artificial Sequence
  Synthetic oligonucleotide
cttcattcggttcggccgttcgaacacacttgtccca

SEQ ID NO: 203113 - DNA, 35 bp, Artificial Sequence
  Synthetic oligonucleotide
gctaatgctcggtgaggatcgagctccggtgcctc

SEQ ID NO: 203114 - DNA, 37 bp, Artificial Sequence
  Synthetic oligonucleotide
ttgaaaaacagtactgtcataattactctctactcgt

SEQ ID NO: 203115 - DNA, 35 bp, Artificial Sequence
  Synthetic oligonucleotide
actaataatcggagcaaatgagttcgggtgtctcc

SEQ ID NO: 203116 - DNA, 35 bp, Artificial Sequence
  Synthetic oligonucleotide
gttgatgttttcacaccccagataggccgtgggat

SEQ ID NO: 203117 - DNA, 38 bp, Artificial Sequence
  Synthetic oligonucleotide
ctggtcattggacacagttttccctcgctccaaactca

SEQ ID NO: 203118 - DNA, 36 bp, Artificial Sequence
  Synthetic oligonucleotide
gggcaaaacggatcgatatggaggcctatttgtgca

SEQ ID NO: 203119 - DNA, 36 bp, Artificial Sequence
  Synthetic oligonucleotide
gtgacgatcctcatgtttgccatttacaggtacgca

SEQ ID NO: 203120 - DNA, 37 bp, Artificial Sequence
  Synthetic oligonucleotide
aaaggggacttcatgacctcaattgccattgtacgca

SEQ ID NO: 203121 - DNA, 37 bp, Artificial Sequence
  Synthetic oligonucleotide
tagttccttagacagtatgcttttagctctttttaca

SEQ ID NO: 203122 - DNA, 38 bp, Artificial Sequence
  Synthetic oligonucleotide
tttagaagggctttcgttggatgaggaatatttgatca

SEQ ID NO: 203123 - DNA, 35 bp, Artificial Sequence
  Synthetic oligonucleotide
attagcggatgctattggacacttcgatggtgggt

SEQ ID NO: 203124 - DNA, 37 bp, Artificial Sequence
  Synthetic oligonucleotide
cctcacatgggcaacctaccccccggacccttcacga

SEQ ID NO: 203125 - DNA, 35 bp, Artificial Sequence
  Synthetic oligonucleotide
gtcgcaaaaatggcttgcgacattgctgcgtaccg

SEQ ID NO: 203126 - DNA, 26 bp, Artificial Sequence
  Synthetic oligonucleotide
cgtttgcgtgtttctcgacttcctca

SEQ ID NO: 203127 - DNA, 36 bp, Artificial Sequence
  Synthetic oligonucleotide
ttggcccaaggctgcattcggctcgcacctcccata

SEQ ID NO: 203128 - DNA, 35 bp, Artificial Sequence
  Synthetic oligonucleotide
gacttggtcctcctagactctccatgacttcttcg

SEQ ID NO: 203129 - DNA, 35 bp, Artificial Sequence
  Synthetic oligonucleotide
ggccacacccgtttacctctatacgccccgcgatc

SEQ ID NO: 203130 - DNA, 35 bp, Artificial Sequence
  Synthetic oligonucleotide
gcgagtcattactaagttggaccctccacgctgca

SEQ ID NO: 203131 - DNA, 37 bp, Artificial Sequence
  Synthetic oligonucleotide
taccctctaaaccgtggacgggaaggtatgtacctca

SEQ ID NO: 203132 - DNA, 35 bp, Artificial Sequence
  Synthetic oligonucleotide
ttcggagtctcatacacggttattcgcgtgcttcg

SEQ ID NO: 203133 - DNA, 35 bp, Artificial Sequence
  Synthetic oligonucleotide
atatgcgaggactaccttatgacgcatcggtcaca

SEQ ID NO: 203134 - DNA, 35 bp, Artificial Sequence
  Synthetic oligonucleotide
ccgtcattcactccctcccgacctagttaggttca

SEQ ID NO: 203135 - DNA, 38 bp, Artificial Sequence
  Synthetic oligonucleotide
acaggaaggccactccgtttcacttgccaatcgcctga

SEQ ID NO: 203136 - DNA, 38 bp, Artificial Sequence
  Synthetic oligonucleotide
cgactggggacaacatcgcgcattaaattacaggttca

SEQ ID NO: 203137 - DNA, 35 bp, Artificial Sequence
  Synthetic oligonucleotide
cccgcgtgcataaatactttgcatagtttgtactc

SEQ ID NO: 203138 - DNA, 35 bp, Artificial Sequence
  Synthetic oligonucleotide
tgtttagccgaacctcgttgacttaggatgttccc

SEQ ID NO: 203139 - DNA, 38 bp, Artificial Sequence
  Synthetic oligonucleotide
tgttcgtaaagtgaaaagtgtacatccttcgcgactca

SEQ ID NO: 203140 - DNA, 36 bp, Artificial Sequence
  Synthetic oligonucleotide
gaacctttgtattcctcgcaaaacagtactttggca

SEQ ID NO: 203141 - DNA, 38 bp, Artificial Sequence
  Synthetic oligonucleotide
aattcgtcactcgttgtgtggagccggtgcccaattga

SEQ ID NO: 203142 - DNA, 35 bp, Artificial Sequence
  Synthetic oligonucleotide
gccctggcaccaaagtcgcacagtcaatcgtgtgc

SEQ ID NO: 203143 - DNA, 36 bp, Artificial Sequence
  Synthetic oligonucleotide
cggggctcttgagtagacagccccctttcgagtcca

SEQ ID NO: 203144 - DNA, 36 bp, Artificial Sequence
  Synthetic oligonucleotide
gcatccagcgttctttacgggcacagtgggttgcca

SEQ ID NO: 203145 - DNA, 35 bp, Artificial Sequence
  Synthetic oligonucleotide
cgggccaccagtcgcatttctagagtcattatact

SEQ ID NO: 203146 - DNA, 35 bp, Artificial Sequence
  Synthetic oligonucleotide
gaatccccgcattctcataaaatatgactaccgcc

SEQ ID NO: 203147 - DNA, 38 bp, Artificial Sequence
  Synthetic oligonucleotide
aagcccggtgtcggttgccacgtcacatctatagatca

SEQ ID NO: 203148 - DNA, 35 bp, Artificial Sequence
  Synthetic oligonucleotide
tgtcaacgtttagctcccagaagccgacctgaggg

SEQ ID NO: 203149 - DNA, 35 bp, Artificial Sequence
  Synthetic oligonucleotide
tactttgttgaaactccgactaatccgacgcacct

SEQ ID NO: 203150 - DNA, 25 bp, Artificial Sequence
  Synthetic oligonucleotide
gtcccttctcacttttctcgtttaa

SEQ ID NO: 203151 - DNA, 37 bp, Artificial Sequence
  Synthetic oligonucleotide
actcttggtcgtctacatttctcagggggtttccgga

SEQ ID NO: 203152 - DNA, 37 bp, Artificial Sequence
  Synthetic oligonucleotide
tgtctgactgtaatgatcgacctatcgatcatttaga

SEQ ID NO: 203153 - DNA, 37 bp, Artificial Sequence
  Synthetic oligonucleotide
ctcttctgtacgtaacaaaaaaatgtgctgacatcca

SEQ ID NO: 203154 - DNA, 35 bp, Artificial Sequence
  Synthetic oligonucleotide
gcgatacgtcccatgaggtacctcaatatactggt

SEQ ID NO: 203155 - DNA, 35 bp, Artificial Sequence
  Synthetic oligonucleotide
tgatgtgcgtggcatttttgtgtggtccgtgcgct

SEQ ID NO: 203156 - DNA, 37 bp, Artificial Sequence
  Synthetic oligonucleotide
gtccgttgtccccccacacgcctgtagtgagcttcca

SEQ ID NO: 203157 - DNA, 35 bp, Artificial Sequence
  Synthetic oligonucleotide
cgcccgcgacctctttcgctcgccactacgacctt

SEQ ID NO: 203158 - DNA, 36 bp, Artificial Sequence
  Synthetic oligonucleotide
gagtcattgttttatatccgacgaagtcacatgcca

SEQ ID NO: 203159 - DNA, 37 bp, Artificial Sequence
  Synthetic oligonucleotide
gttatacaattttatctcgaccaatgaaaatacgagg

SEQ ID NO: 203160 - DNA, 35 bp, Artificial Sequence
  Synthetic oligonucleotide
acactagcggagccttgcacacgtcttgatcagcc

SEQ ID NO: 203161 - DNA, 35 bp, Artificial Sequence
  Synthetic oligonucleotide
gagcaaaccgacattcctaacgtgtacacggatct

SEQ ID NO: 203162 - DNA, 36 bp, Artificial Sequence
  Synthetic oligonucleotide
caatgctatgggaccctcaatagtattatagcatca

SEQ ID NO: 203163 - DNA, 35 bp, Artificial Sequence
  Synthetic oligonucleotide
tcaatctgtgagcagtttttatcgagggtaagtcc

SEQ ID NO: 203164 - DNA, 35 bp, Artificial Sequence
  Synthetic oligonucleotide
gcacaaacggtacaatggaggctgtgccccttgtg

SEQ ID NO: 203165 - DNA, 35 bp, Artificial Sequence
  Synthetic oligonucleotide
ccaatatttgatctcttcaggtcggtcgcccctgg

SEQ ID NO: 203166 - DNA, 35 bp, Artificial Sequence
  Synthetic oligonucleotide
gatgacgccggtcatgcctctctgaatttcgatcg

SEQ ID NO: 203167 - DNA, 35 bp, Artificial Sequence
  Synthetic oligonucleotide
cctgacctagcgtctcttcatagtcggtttgtccg

SEQ ID NO: 203168 - DNA, 37 bp, Artificial Sequence
  Synthetic oligonucleotide
cgcaaccagatcttcacggttactaatgtcccctaca

SEQ ID NO: 203169 - DNA, 37 bp, Artificial Sequence
  Synthetic oligonucleotide
gactactcagatgcacgaactgctatctattccttgg

SEQ ID NO: 203170 - DNA, 37 bp, Artificial Sequence
  Synthetic oligonucleotide
ttggaggaaaaaatataaccaaaatgcaccgccacga

SEQ ID NO: 203171 - DNA, 35 bp, Artificial Sequence
  Synthetic oligonucleotide
acatcggtacaactagctgggtattctcatattgc

SEQ ID NO: 203172 - DNA, 37 bp, Artificial Sequence
  Synthetic oligonucleotide
gtcggtgtgttgtctggtcattattgtcgggctccca

SEQ ID NO: 203173 - DNA, 36 bp, Artificial Sequence
  Synthetic oligonucleotide
gcgcctttatgggtattcaaaagacgagcccgcaca

SEQ ID NO: 203174 - DNA, 35 bp, Artificial Sequence
  Synthetic oligonucleotide
agtcctcacaccactcatcgaggtgcacgatcggg

SEQ ID NO: 203175 - DNA, 38 bp, Artificial Sequence
  Synthetic oligonucleotide
tcgacgtgattagctgttggttcactcataatttatga

SEQ ID NO: 203176 - DNA, 35 bp, Artificial Sequence
  Synthetic oligonucleotide
tgagggataatttaggtaccttaggtgtacacgtt

SEQ ID NO: 203177 - DNA, 34 bp, Artificial Sequence
  Synthetic oligonucleotide
accgaaacccgggtgatgctcctgttcatgaccc

SEQ ID NO: 203178 - DNA, 35 bp, Artificial Sequence
  Synthetic oligonucleotide
ttgaggctgaataggttacgcgtcaacggagcatc

SEQ ID NO: 203179 - DNA, 37 bp, Artificial Sequence
  Synthetic oligonucleotide
ccattgctcttacccctcctgtccttacggttgtgga

SEQ ID NO: 203180 - DNA, 35 bp, Artificial Sequence
  Synthetic oligonucleotide
tgcggtaagggttttacccaactcatgacatcgcc

SEQ ID NO: 203181 - DNA, 35 bp, Artificial Sequence
  Synthetic oligonucleotide
tttgagattgcccttggcccttcttcgtccgccct

SEQ ID NO: 203182 - DNA, 38 bp, Artificial Sequence
  Synthetic oligonucleotide
ccatagttctttatgctgcctgacggtctcgtgtttca

SEQ ID NO: 203183 - DNA, 35 bp, Artificial Sequence
  Synthetic oligonucleotide
attggggcgactactcgcgctccacatcaaacacg

SEQ ID NO: 203184 - DNA, 35 bp, Artificial Sequence
  Synthetic oligonucleotide
gctttaactgatgaccgtaggggaattgctggagt

SEQ ID NO: 203185 - DNA, 35 bp, Artificial Sequence
  Synthetic oligonucleotide
tgtcggaaatggtgcacgtgttaaccgaaagagct

SEQ ID NO: 203186 - DNA, 36 bp, Artificial Sequence
  Synthetic oligonucleotide
gcgggcaaagcggattggtaaattcgaaataacaca

SEQ ID NO: 203187 - DNA, 36 bp, Artificial Sequence
  Synthetic oligonucleotide
ggtcactcgcaattctactgtataccgtttctacaa

SEQ ID NO: 203188 - DNA, 36 bp, Artificial Sequence
  Synthetic oligonucleotide
tgaggtcatcgtttgggctattatgtctctttgtta

SEQ ID NO: 203189 - DNA, 35 bp, Artificial Sequence
  Synthetic oligonucleotide
accaactctacactcccctgcgcggtgaagcgacc

SEQ ID NO: 203190 - DNA, 38 bp, Artificial Sequence
  Synthetic oligonucleotide
aattcgtcactcgttgtgtgaagccggtgcccaattga

SEQ ID NO: 203191 - DNA, 35 bp, Artificial Sequence
  Synthetic oligonucleotide
cctttgccatgaagtaggcatggtgtcctatatct

SEQ ID NO: 203192 - DNA, 35 bp, Artificial Sequence
  Synthetic oligonucleotide
tatcttcctgctttcaatcctgtctcgatgacacc

SEQ ID NO: 203193 - DNA, 35 bp, Artificial Sequence
  Synthetic oligonucleotide
cgcaaccgggctgatgtctcactgaacgataatcg

SEQ ID NO: 203194 - DNA, 37 bp, Artificial Sequence
  Synthetic oligonucleotide
ccgcgtgctactgaaacgcggttctcaggtacgacca

SEQ ID NO: 203195 - DNA, 35 bp, Artificial Sequence
  Synthetic oligonucleotide
cttccttgaaagagtcccgctctcttattgcctcg

SEQ ID NO: 203196 - DNA, 35 bp, Artificial Sequence
  Synthetic oligonucleotide
gctcctcccgggcgctggtgaacgactccaaggtg

SEQ ID NO: 203197 - DNA, 35 bp, Artificial Sequence
  Synthetic oligonucleotide
gacagctctatgagtttcgatccgaaacccccacg

SEQ ID NO: 203198 - DNA, 35 bp, Artificial Sequence
  Synthetic oligonucleotide
gccgtggtggtatggctaacttgtgcttttcacct

SEQ ID NO: 203199 - DNA, 35 bp, Artificial Sequence
  Synthetic oligonucleotide
acatcgaagaacaagctagcttatgtcatctcact

SEQ ID NO: 203200 - DNA, 35 bp, Artificial Sequence
  Synthetic oligonucleotide
gtatctagaaagcttattgtttcttccacgcgcca

SEQ ID NO: 203201 - DNA, 36 bp, Artificial Sequence
  Synthetic oligonucleotide
tgatcgcgactccccgtagccgcgctattgtagtta

SEQ ID NO: 203202 - DNA, 35 bp, Artificial Sequence
  Synthetic oligonucleotide
gtgaccgttccctactttgtctggactccgtctgg

SEQ ID NO: 203203 - DNA, 35 bp, Artificial Sequence
  Synthetic oligonucleotide
tccggatgtgctccggtcaataatggcatcttgcc

SEQ ID NO: 203204 - DNA, 35 bp, Artificial Sequence
  Synthetic oligonucleotide
tggtgagtctttttacgaacatgtccctgttggcc

SEQ ID NO: 203205 - DNA, 35 bp, Artificial Sequence
  Synthetic oligonucleotide
ccctctcgtatcgctactgggtaacgaccgcgccc

SEQ ID NO: 203206 - DNA, 38 bp, Artificial Sequence
  Synthetic oligonucleotide
cgttagactgccagagaacgcatactgatatcatttga

SEQ ID NO: 203207 - DNA, 35 bp, Artificial Sequence
  Synthetic oligonucleotide
gtaatagccgttgatcatcctatcgctacactctt

SEQ ID NO: 203208 - DNA, 35 bp, Artificial Sequence
  Synthetic oligonucleotide
tacttagggggggggggggattctgttttgtctct

SEQ ID NO: 203209 - DNA, 38 bp, Artificial Sequence
  Synthetic oligonucleotide
gtatacgttgctaccgatcgctatcacggtcttgttca

SEQ ID NO: 203210 - DNA, 35 bp, Artificial Sequence
  Synthetic oligonucleotide
tcatgataagctcctcgtagagctacgttatttta

SEQ ID NO: 203211 - DNA, 35 bp, Artificial Sequence
  Synthetic oligonucleotide
tgcggtgcgcaggaattggatacacgtgtcgcaca

SEQ ID NO: 203212 - DNA, 36 bp, Artificial Sequence
  Synthetic oligonucleotide
gttgacccatgattttcgtaactcgttccctctgga

SEQ ID NO: 203213 - DNA, 37 bp, Artificial Sequence
  Synthetic oligonucleotide
acatctccaactttcgagaatcgaaagcgcttgcaca

SEQ ID NO: 203214 - DNA, 35 bp, Artificial Sequence
  Synthetic oligonucleotide
acccaggcttgtaagaacacgtctgacctatgtcg

SEQ ID NO: 203215 - DNA, 36 bp, Artificial Sequence
  Synthetic oligonucleotide
gctggaggccctattcacttgctggtgaatcgccat

SEQ ID NO: 203216 - DNA, 35 bp, Artificial Sequence
  Synthetic oligonucleotide
cacgtggcaaagggcgcgcttgctcctatattgct

SEQ ID NO: 203217 - DNA, 35 bp, Artificial Sequence
  Synthetic oligonucleotide
gctgcacccttgtgtctgttatgtggcgataaacg

SEQ ID NO: 203218 - DNA, 35 bp, Artificial Sequence
  Synthetic oligonucleotide
ggtgaatgttgacctctggtccctctgtcgaacgt

SEQ ID NO: 203219 - DNA, 35 bp, Artificial Sequence
  Synthetic oligonucleotide
ccggttcaggcctcacgtgacgttcccgtactcct

SEQ ID NO: 203220 - DNA, 36 bp, Artificial Sequence
  Synthetic oligonucleotide
ttggcctaaggctgcattcggctcgcacctcccata

SEQ ID NO: 203221 - DNA, 36 bp, Artificial Sequence
  Synthetic oligonucleotide
aatgatagtccaacgagctgctcggtaacggtctaa

SEQ ID NO: 203222 - DNA, 37 bp, Artificial Sequence
  Synthetic oligonucleotide
ctatcgcttcgaacacgtgtctcgcatgcgggcgaga

SEQ ID NO: 203223 - DNA, 35 bp, Artificial Sequence
  Synthetic oligonucleotide
gtcggggaaatcggcatttggcccgtaacccagcc

SEQ ID NO: 203224 - DNA, 35 bp, Artificial Sequence
  Synthetic oligonucleotide
tgattggagtggctctatcatatccggatccatag

SEQ ID NO: 203225 - DNA, 36 bp, Artificial Sequence
  Synthetic oligonucleotide
gtactcggacagccatgcacatagccttttcgagca

SEQ ID NO: 203226 - DNA, 38 bp, Artificial Sequence
  Synthetic oligonucleotide
tcgtatgccactctacgcgcatacgtaccctcccatca

SEQ ID NO: 203227 - DNA, 36 bp, Artificial Sequence
  Synthetic oligonucleotide
catttcttgcttgcatgcgaaccgctttgctaccaa

SEQ ID NO: 203228 - DNA, 35 bp, Artificial Sequence
  Synthetic oligonucleotide
catcgcataatggttcatacatacctatcagcccg

SEQ ID NO: 203229 - DNA, 36 bp, Artificial Sequence
  Synthetic oligonucleotide
cctcgaaaggcacttgccgggaagaacgaggggact

SEQ ID NO: 203230 - DNA, 34 bp, Artificial Sequence
  Synthetic oligonucleotide
cccggcgagccacgggtgtacgagcaagtcaccc

SEQ ID NO: 203231 - DNA, 36 bp, Artificial Sequence
  Synthetic oligonucleotide
catgttcggccgttaatggggtctcccctcctacta

SEQ ID NO: 203232 - DNA, 36 bp, Artificial Sequence
  Synthetic oligonucleotide
acccttcgtaaagggtattgtagagctcttaatcga

SEQ ID NO: 203233 - DNA, 36 bp, Artificial Sequence
  Synthetic oligonucleotide
accaagaaatgatatggcggtttacatttcggagca

SEQ ID NO: 203234 - DNA, 35 bp, Artificial Sequence
  Synthetic oligonucleotide
attgaatatctcgactaagacagttggccgtagca

SEQ ID NO: 203235 - DNA, 35 bp, Artificial Sequence
  Synthetic oligonucleotide
ccatgcattcaatgcagccccaggctcgataatcc

SEQ ID NO: 203236 - DNA, 35 bp, Artificial Sequence
  Synthetic oligonucleotide
gtcaccgtgggcgacattctaaattcttctctcta

SEQ ID NO: 203237 - DNA, 31 bp, Artificial Sequence
  Synthetic oligonucleotide
ttgcgttgcagtctactaccttgtcattcta

SEQ ID NO: 203238 - DNA, 35 bp, Artificial Sequence
  Synthetic oligonucleotide
gatccgacctccatatatgccgccagtgatacgcc

SEQ ID NO: 203239 - DNA, 35 bp, Artificial Sequence
  Synthetic oligonucleotide
ttcctgactttcatggaggctctgttttttgatcg

SEQ ID NO: 203240 - DNA, 37 bp, Artificial Sequence
  Synthetic oligonucleotide
ctaccactagtcacttgtcattggcccggtccggggt

SEQ ID NO: 203241 - DNA, 35 bp, Artificial Sequence
  Synthetic oligonucleotide
gctatactctcgggtccctcattagtttcgtctca

SEQ ID NO: 203242 - DNA, 36 bp, Artificial Sequence
  Synthetic oligonucleotide
agggcgctgccctgcaaaactggcttgtgagcacca

SEQ ID NO: 203243 - DNA, 37 bp, Artificial Sequence
  Synthetic oligonucleotide
cgtcacgacaccgacacaaagcctcactccctctgga

SEQ ID NO: 203244 - DNA, 38 bp, Artificial Sequence
  Synthetic oligonucleotide
tgatccgagtcaacaggaggggtgaaatctattactca

SEQ ID NO: 203245 - DNA, 38 bp, Artificial Sequence
  Synthetic oligonucleotide
gtttaccccgagattcgctgtacacataggatatctga

SEQ ID NO: 203246 - DNA, 35 bp, Artificial Sequence
  Synthetic oligonucleotide
tcctgttcgagtcagatcgtacttgcggtcaatcc

SEQ ID NO: 203247 - DNA, 37 bp, Artificial Sequence
  Synthetic oligonucleotide
gtcgcggaactcgtacggacatctgatgtatcgtgca

SEQ ID NO: 203248 - DNA, 35 bp, Artificial Sequence
  Synthetic oligonucleotide
tggttccaatttctatccttatatatcgcgcacct

SEQ ID NO: 203249 - DNA, 35 bp, Artificial Sequence
  Synthetic oligonucleotide
cccggcgacccacgggctgtacgagcaagtcacac

SEQ ID NO: 203250 - DNA, 38 bp, Artificial Sequence
  Synthetic oligonucleotide
gcgaacagtctgaatgagcaaacgcgcccgctcaatca

SEQ ID NO: 203251 - DNA, 35 bp, Artificial Sequence
  Synthetic oligonucleotide
gctgggtaagatttgatcgttccgtatgacccaca

SEQ ID NO: 203252 - DNA, 36 bp, Artificial Sequence
  Synthetic oligonucleotide
tcccccccccgatgctggccatgcgccgtttaacgg

SEQ ID NO: 203253 - DNA, 35 bp, Artificial Sequence
  Synthetic oligonucleotide
ctactaaggtcctggacgacgtattggttcgcgca

SEQ ID NO: 203254 - DNA, 37 bp, Artificial Sequence
  Synthetic oligonucleotide
aatcttgcggtaaagattcgttcactgtaaggtatca

SEQ ID NO: 203255 - DNA, 35 bp, Artificial Sequence
  Synthetic oligonucleotide
ccacataggattcaagaaatacttgtcaaacctag

SEQ ID NO: 203256 - DNA, 35 bp, Artificial Sequence
  Synthetic oligonucleotide
aataggtccgtattatgatcgttcacagcctgttc

SEQ ID NO: 203257 - DNA, 36 bp, Artificial Sequence
  Synthetic oligonucleotide
tacttaattgggggggggggattctgttttgtctct

SEQ ID NO: 203258 - DNA, 36 bp, Artificial Sequence
  Synthetic oligonucleotide
gtgacaccaaagacccagcctgtgcgtcattcctca

SEQ ID NO: 203259 - DNA, 36 bp, Artificial Sequence
  Synthetic oligonucleotide
ggagcgaccactctctcctttcgaacctgcttctca

SEQ ID NO: 203260 - DNA, 35 bp, Artificial Sequence
  Synthetic oligonucleotide
cgaccagcctcataaccgttacgcttttcctttct

SEQ ID NO: 203261 - DNA, 37 bp, Artificial Sequence
  Synthetic oligonucleotide
gaatagcaaaaattcttaaagaagtacgccaggggca

SEQ ID NO: 203262 - DNA, 34 bp, Artificial Sequence
  Synthetic oligonucleotide
ccccccttcgagcgtgcattgacattgtgcagtt

SEQ ID NO: 203263 - DNA, 35 bp, Artificial Sequence
  Synthetic oligonucleotide
gaccggcattagaagcgatcgtggggtgccgacac

SEQ ID NO: 203264 - DNA, 37 bp, Artificial Sequence
  Synthetic oligonucleotide
caagtagtgcagcctagcactgatctaccaatgtaca

SEQ ID NO: 203265 - DNA, 35 bp, Artificial Sequence
  Synthetic oligonucleotide
gcttctacgaccgtaccgccccggaaagtccaggc

SEQ ID NO: 203266 - DNA, 35 bp, Artificial Sequence
  Synthetic oligonucleotide
tgttctattgcggaacgcgagtttccctaaggtcg

SEQ ID NO: 203267 - DNA, 36 bp, Artificial Sequence
  Synthetic oligonucleotide
ccccatggttgggcgaactctccgaagtttaccgca

SEQ ID NO: 203268 - DNA, 35 bp, Artificial Sequence
  Synthetic oligonucleotide
gtccgcttctaaactctattgcaagaccgtcatag

SEQ ID NO: 203269 - DNA, 37 bp, Artificial Sequence
  Synthetic oligonucleotide
caccaaagttaacgctgtctcgtcaccaaggttggca

SEQ ID NO: 203270 - DNA, 35 bp, Artificial Sequence
  Synthetic oligonucleotide
acgcaggcgtacatgctgggataaccgaccgttcc

SEQ ID NO: 203271 - DNA, 37 bp, Artificial Sequence
  Synthetic oligonucleotide
gcccctccgcgtccaatacgctccgtatacggtgtca

SEQ ID NO: 203272 - DNA, 35 bp, Artificial Sequence
  Synthetic oligonucleotide
tcggcctgcttcgtcgtcgagaatcaggctcatcg

SEQ ID NO: 203273 - DNA, 35 bp, Artificial Sequence
  Synthetic oligonucleotide
tagtcaggatgcgcagttgtactgccttcaaaact

SEQ ID NO: 203274 - DNA, 36 bp, Artificial Sequence
  Synthetic oligonucleotide
cagtactgcacatgtccttagccccttccgtctcca

SEQ ID NO: 203275 - DNA, 35 bp, Artificial Sequence
  Synthetic oligonucleotide
cgtcgaattatcgtatgccgccgttacaatgcacc

SEQ ID NO: 203276 - DNA, 35 bp, Artificial Sequence
  Synthetic oligonucleotide
cgacgatcacatcaacgcacaatggccgtataccg

SEQ ID NO: 203277 - DNA, 35 bp, Artificial Sequence
  Synthetic oligonucleotide
cgctattattcggcccgttttgcacgcccctaggc

SEQ ID NO: 203278 - DNA, 35 bp, Artificial Sequence
  Synthetic oligonucleotide
gtggaatcgccctcctctctttttaaatggacgag

SEQ ID NO: 203279 - DNA, 35 bp, Artificial Sequence
  Synthetic oligonucleotide
gccctggcaccaaagtcgcacaatcaatcgtgtct

SEQ ID NO: 203280 - DNA, 35 bp, Artificial Sequence
  Synthetic oligonucleotide
gtgatcatggctactctgctgtttgtccctcgcaa

SEQ ID NO: 203281 - DNA, 37 bp, Artificial Sequence
  Synthetic oligonucleotide
gtccacactcgcatctacccgccctcccgggttagga

SEQ ID NO: 203282 - DNA, 37 bp, Artificial Sequence
  Synthetic oligonucleotide
gagcataactctctcgacatgtgtttgtgaagaaaca

SEQ ID NO: 203283 - DNA, 36 bp, Artificial Sequence
  Synthetic oligonucleotide
gcaatgtgctcgtagggttatcactcttattcccca

SEQ ID NO: 203284 - DNA, 38 bp, Artificial Sequence
  Synthetic oligonucleotide
aattcgtcactcgtcgtgtgtagccggtgcccaattga

SEQ ID NO: 203285 - DNA, 35 bp, Artificial Sequence
  Synthetic oligonucleotide
atactactactatcgccttatcacgtcgcatttca

SEQ ID NO: 203286 - DNA, 36 bp, Artificial Sequence
  Synthetic oligonucleotide
cactggcccgggtgacgctatctcgtacctctgata

SEQ ID NO: 203287 - DNA, 35 bp, Artificial Sequence
  Synthetic oligonucleotide
gtgcaccgtattgtctccatttaactttctcctag

SEQ ID NO: 203288 - DNA, 35 bp, Artificial Sequence
  Synthetic oligonucleotide
gcatgtgccagtgtacgcaccccatcgcgcccccg

SEQ ID NO: 203289 - DNA, 35 bp, Artificial Sequence
  Synthetic oligonucleotide
tttcttctggtactgtgtgacccagttcttgttcg

SEQ ID NO: 203290 - DNA, 36 bp, Artificial Sequence
  Synthetic oligonucleotide
gctaatcgggtaatgatatatttccggctctctgtt

SEQ ID NO: 203291 - DNA, 36 bp, Artificial Sequence
  Synthetic oligonucleotide
gtggtgggccaaatttccaacacctgtcacctacca

SEQ ID NO: 203292 - DNA, 35 bp, Artificial Sequence
  Synthetic oligonucleotide
gtacgtctgacacctatccccaaagtgcttcgggc

SEQ ID NO: 203293 - DNA, 38 bp, Artificial Sequence
  Synthetic oligonucleotide
tttcgcggacgctcaatctctccaatatccgcatgtca

SEQ ID NO: 203294 - DNA, 36 bp, Artificial Sequence
  Synthetic oligonucleotide
gcgaggtgtatgtccggttctgtagcaattgttcca

SEQ ID NO: 203295 - DNA, 35 bp, Artificial Sequence
  Synthetic oligonucleotide
agtggatacacaattgttcgtggtcttctctcgtc

SEQ ID NO: 203296 - DNA, 36 bp, Artificial Sequence
  Synthetic oligonucleotide
cgtagtgaacaaccgccgctctgttgttaccttcca

SEQ ID NO: 203297 - DNA, 35 bp, Artificial Sequence
  Synthetic oligonucleotide
tccatccagtatcgcgtctacccgttccgcgggct

SEQ ID NO: 203298 - DNA, 36 bp, Artificial Sequence
  Synthetic oligonucleotide
agtccgttgtggagtgcaacgggtaacaccgtctca

SEQ ID NO: 203299 - DNA, 37 bp, Artificial Sequence
  Synthetic oligonucleotide
tcctggttagtgctcaggtacccttctatttgtggca

SEQ ID NO: 203300 - DNA, 35 bp, Artificial Sequence
  Synthetic oligonucleotide
gcttgaactgatgaccttaggggaattgctggagt

SEQ ID NO: 203301 - DNA, 37 bp, Artificial Sequence
  Synthetic oligonucleotide
tcacttgagcgttccgccgatcccgtcctctataaga

SEQ ID NO: 203302 - DNA, 36 bp, Artificial Sequence
  Synthetic oligonucleotide
gaggagggacccacgtatcgtgttttactcacttca

SEQ ID NO: 203303 - DNA, 36 bp, Artificial Sequence
  Synthetic oligonucleotide
ttgccgcaggtttagtaacggtgcgtgatgtaggaa

SEQ ID NO: 203304 - DNA, 35 bp, Artificial Sequence
  Synthetic oligonucleotide
ttgtcaactgacgcttccgttgttatcactctctt

SEQ ID NO: 203305 - DNA, 27 bp, Artificial Sequence
  Synthetic oligonucleotide
cgctagcttgatgccttacagcacgcg

SEQ ID NO: 203306 - DNA, 37 bp, Artificial Sequence
  Synthetic oligonucleotide
cactccacgtttgaacgaaaggtagcatcactacagt

SEQ ID NO: 203307 - DNA, 35 bp, Artificial Sequence
  Synthetic oligonucleotide
ttttcgagatctgtacataaagattctgggtgtgg

SEQ ID NO: 203308 - DNA, 36 bp, Artificial Sequence
  Synthetic oligonucleotide
gcggtgtgcgaacgcgcccacttctgggtgatctta

SEQ ID NO: 203309 - DNA, 36 bp, Artificial Sequence
  Synthetic oligonucleotide
ggtccctaacgccgtacggcgtatgcacaaggtggt

SEQ ID NO: 203310 - DNA, 36 bp, Artificial Sequence
  Synthetic oligonucleotide
tatgctattacgattcagcctcgtccatggcctgca

SEQ ID NO: 203311 - DNA, 35 bp, Artificial Sequence
  Synthetic oligonucleotide
cgcattccacgtcagttccctactcccaagttaga

SEQ ID NO: 203312 - DNA, 35 bp, Artificial Sequence
  Synthetic oligonucleotide
gccatccgcgaaatcgcaagatgccgtcgacccat

SEQ ID NO: 203313 - DNA, 35 bp, Artificial Sequence
  Synthetic oligonucleotide
actctcacaaacgattggtaataagtcgtcttaac

SEQ ID NO: 203314 - DNA, 35 bp, Artificial Sequence
  Synthetic oligonucleotide
tttggtccgtgttcccatgcactctcgatgaagtt

SEQ ID NO: 203315 - DNA, 36 bp, Artificial Sequence
  Synthetic oligonucleotide
cgccctcggtccgggaaggcaagactagtgacgaca

SEQ ID NO: 203316 - DNA, 38 bp, Artificial Sequence
  Synthetic oligonucleotide
tacttcgcccacgtgatcttccgcatgggtaagtgtca

SEQ ID NO: 203317 - DNA, 37 bp, Artificial Sequence
  Synthetic oligonucleotide
gaacaccacctcatacgcaactcgccatgacatgtca

SEQ ID NO: 203318 - DNA, 35 bp, Artificial Sequence
  Synthetic oligonucleotide
atccttgggaatgagtggggttacaaattgcctca

SEQ ID NO: 203319 - DNA, 30 bp, Artificial Sequence
  Synthetic oligonucleotide
tattgaacacgcgcttgcctcatttgttca

SEQ ID NO: 203320 - DNA, 35 bp, Artificial Sequence
  Synthetic oligonucleotide
atagctagtgcagtcagctatgcctaaacacatcg

SEQ ID NO: 203321 - DNA, 36 bp, Artificial Sequence
  Synthetic oligonucleotide
ttcgacgcaacttagctcacctgtcactccggtcca

SEQ ID NO: 203322 - DNA, 35 bp, Artificial Sequence
  Synthetic oligonucleotide
cggtgtccgccgatcgggcccgggctattccaact

SEQ ID NO: 203323 - DNA, 35 bp, Artificial Sequence
  Synthetic oligonucleotide
ctcatttatgccgctcgtctccgtggtcgtctacc

SEQ ID NO: 203324 - DNA, 36 bp, Artificial Sequence
  Synthetic oligonucleotide
taatggtgtaggtttgttagcgtaacgttccataca

SEQ ID NO: 203325 - DNA, 37 bp, Artificial Sequence
  Synthetic oligonucleotide
aatcatgaactagatgggctatcaacagtatctgtca

SEQ ID NO: 203326 - DNA, 33 bp, Artificial Sequence
  Synthetic oligonucleotide
gatttcgggttccactgtctaatttcgctttgt

SEQ ID NO: 203327 - DNA, 36 bp, Artificial Sequence
  Synthetic oligonucleotide
ttataagtactagccctcagcgtttttgcacccccc

SEQ ID NO: 203328 - DNA, 38 bp, Artificial Sequence
  Synthetic oligonucleotide
ctccactacggtcgggtcgtgtgatagtatacccatca

SEQ ID NO: 203329 - DNA, 37 bp, Artificial Sequence
  Synthetic oligonucleotide
gcgaagcattctcatcttaataacatatgtcaccgca

SEQ ID NO: 203330 - DNA, 37 bp, Artificial Sequence
  Synthetic oligonucleotide
tgcgatctgcggggggtacgccggtctcacctgtcga

SEQ ID NO: 203331 - DNA, 35 bp, Artificial Sequence
  Synthetic oligonucleotide
ctacatagcgttgcccggttcggttcgttccttac

SEQ ID NO: 203332 - DNA, 36 bp, Artificial Sequence
  Synthetic oligonucleotide
tgtcatgttttcctggctcaatatttcctcgttcca

SEQ ID NO: 203333 - DNA, 35 bp, Artificial Sequence
  Synthetic oligonucleotide
gccctggcaccaaagtcccacaatcaatcgtgtgc

SEQ ID NO: 203334 - DNA, 30 bp, Artificial Sequence
  Synthetic oligonucleotide
gagtcgacgtctctttaatagagaggctca

SEQ ID NO: 203335 - DNA, 38 bp, Artificial Sequence
  Synthetic oligonucleotide
aatcatcctcagggccttcctttagaaggcgagcttga

SEQ ID NO: 203336 - DNA, 37 bp, Artificial Sequence
  Synthetic oligonucleotide
gatcgccagccctgcgtactactttattcacctaaga

SEQ ID NO: 203337 - DNA, 38 bp, Artificial Sequence
  Synthetic oligonucleotide
gtatttcgctccgtaaccgttcgtactgcctagtttca

SEQ ID NO: 203338 - DNA, 38 bp, Artificial Sequence
  Synthetic oligonucleotide
ctcctggtcccttttcagaggcacgacgcgcttcgtta

SEQ ID NO: 203339 - DNA, 38 bp, Artificial Sequence
  Synthetic oligonucleotide
accgaaactatgacgtgcacttgacaagtcctgtctga

SEQ ID NO: 203340 - DNA, 35 bp, Artificial Sequence
  Synthetic oligonucleotide
tatccgagacaatcggtaaacgtactggcgccctc

SEQ ID NO: 203341 - DNA, 35 bp, Artificial Sequence
  Synthetic oligonucleotide
atttgggctgtattgtcatcgtggacttctacgct

SEQ ID NO: 203342 - DNA, 35 bp, Artificial Sequence
  Synthetic oligonucleotide
gagatgcccttgtttcataattatttctattcccg

SEQ ID NO: 203343 - DNA, 35 bp, Artificial Sequence
  Synthetic oligonucleotide
gttcgtgccggcgaaatcgccgtgggtcgaccggc

SEQ ID NO: 203344 - DNA, 36 bp, Artificial Sequence
  Synthetic oligonucleotide
gctgatcggaggaattatattttctttgtccgatct

SEQ ID NO: 203345 - DNA, 35 bp, Artificial Sequence
  Synthetic oligonucleotide
tagcaaagtcccttattagctccatgctccccgtt

SEQ ID NO: 203346 - DNA, 37 bp, Artificial Sequence
  Synthetic oligonucleotide
ttattgaggctgatatacatccgctggttattgaaca

SEQ ID NO: 203347 - DNA, 35 bp, Artificial Sequence
  Synthetic oligonucleotide
cgactccgggatatcgcaacatgctggctgaaccg

SEQ ID NO: 203348 - DNA, 38 bp, Artificial Sequence
  Synthetic oligonucleotide
cctgaggacgcccttatggggttttcctaggcacatca

SEQ ID NO: 203349 - DNA, 37 bp, Artificial Sequence
  Synthetic oligonucleotide
ctcgtaagcccgggtggggcacgtgtgcggatgtagt

SEQ ID NO: 203350 - DNA, 37 bp, Artificial Sequence
  Synthetic oligonucleotide
gtctacgcagccgataagataggaatttctaggccca

SEQ ID NO: 203351 - DNA, 37 bp, Artificial Sequence
  Synthetic oligonucleotide
aacgtcagttcatgaacggttacacctcgcgcctcgt

SEQ ID NO: 203352 - DNA, 35 bp, Artificial Sequence
  Synthetic oligonucleotide
gctagggcccccctactactttagtaattgggagc

SEQ ID NO: 203353 - DNA, 36 bp, Artificial Sequence
  Synthetic oligonucleotide
ttagtctgcgtctttgctgctatgtttcgactagag

SEQ ID NO: 203354 - DNA, 38 bp, Artificial Sequence
  Synthetic oligonucleotide
ctctgcatgggcatctctggcctatcatttagccctga

SEQ ID NO: 203355 - DNA, 37 bp, Artificial Sequence
  Synthetic oligonucleotide
gaccaagggtcccgtctaagaccaataggttccgaca

SEQ ID NO: 203356 - DNA, 35 bp, Artificial Sequence
  Synthetic oligonucleotide
cccggcgagccccgggctgtacgagcaagtcacac

SEQ ID NO: 203357 - DNA, 38 bp, Artificial Sequence
  Synthetic oligonucleotide
tgagtaccaggcctggccatcaatgcacaggattgtca

SEQ ID NO: 203358 - DNA, 35 bp, Artificial Sequence
  Synthetic oligonucleotide
aatagcgactgccattgtttttgtgatcaccggat

SEQ ID NO: 203359 - DNA, 35 bp, Artificial Sequence
  Synthetic oligonucleotide
tacgtgccaacttttagttgtccacttgagacgcc

SEQ ID NO: 203360 - DNA, 36 bp, Artificial Sequence
  Synthetic oligonucleotide
cccatcgggcgtggtgaggtaacccgtgagtgatca

SEQ ID NO: 203361 - DNA, 38 bp, Artificial Sequence
  Synthetic oligonucleotide
tcgtaatactgcgtcaaagtgcgcacatgcagccatca

SEQ ID NO: 203362 - DNA, 36 bp, Artificial Sequence
  Synthetic oligonucleotide
gtcccgttaatgatagacgttacacgcgctacctca

SEQ ID NO: 203363 - DNA, 38 bp, Artificial Sequence
  Synthetic oligonucleotide
gcttgcgttctcagttccagaggcgacaccgcacctca

SEQ ID NO: 203364 - DNA, 36 bp, Artificial Sequence
  Synthetic oligonucleotide
cgtagtgaacaaccgccgctctgttgttaccttctt

SEQ ID NO: 203365 - DNA, 35 bp, Artificial Sequence
  Synthetic oligonucleotide
tacttaattggggggggggattctgttttgtctcc

SEQ ID NO: 203366 - DNA, 37 bp, Artificial Sequence
  Synthetic oligonucleotide
ttcgtcagaatctcccggtggtccgatctcgattgca

SEQ ID NO: 203367 - DNA, 36 bp, Artificial Sequence
  Synthetic oligonucleotide
cagtctagtccatactgacgggcgaaggacctttaa

SEQ ID NO: 203368 - DNA, 35 bp, Artificial Sequence
  Synthetic oligonucleotide
gatgcgtaatttgcacgcgctccgcccagaatccg

SEQ ID NO: 203369 - DNA, 36 bp, Artificial Sequence
  Synthetic oligonucleotide
ggagttaccggttcgcttcgccctttcttgggacag

SEQ ID NO: 203370 - DNA, 34 bp, Artificial Sequence
  Synthetic oligonucleotide
gcgtcttgagaatgcatgcatcacacttacggct

SEQ ID NO: 203371 - DNA, 35 bp, Artificial Sequence
  Synthetic oligonucleotide
cccctgaccttgctacccctcgcccttgtgcgcga

SEQ ID NO: 203372 - DNA, 35 bp, Artificial Sequence
  Synthetic oligonucleotide
gacccttcgcacgagcgatgttgatgtaatgtacg

SEQ ID NO: 203373 - DNA, 36 bp, Artificial Sequence
  Synthetic oligonucleotide
ttatcagtctaccctctccatcttaacctagtcgca

SEQ ID NO: 203374 - DNA, 35 bp, Artificial Sequence
  Synthetic oligonucleotide
tcctcggcgatcataatcgccaccgctagccagct

SEQ ID NO: 203375 - DNA, 37 bp, Artificial Sequence
  Synthetic oligonucleotide
ctaatgcgtgtgttacaactcgcaccgcctatactca

SEQ ID NO: 203376 - DNA, 38 bp, Artificial Sequence
  Synthetic oligonucleotide
aactcgtcactcgttgtgtgtagccggtgcccaattga

SEQ ID NO: 203377 - DNA, 37 bp, Artificial Sequence
  Synthetic oligonucleotide
gctgctgctcgcccggtttatgatacctcgaccgtga

SEQ ID NO: 203378 - DNA, 37 bp, Artificial Sequence
  Synthetic oligonucleotide
gggtatccgttgtttgtatataattcactctctctga

SEQ ID NO: 203379 - DNA, 37 bp, Artificial Sequence
  Synthetic oligonucleotide
gtctaccgggaccgatagaggtgttttctctggtaca

SEQ ID NO: 203380 - DNA, 30 bp, Artificial Sequence
  Synthetic oligonucleotide
ttcagctcacttgccggctatgggcctcca

SEQ ID NO: 203381 - DNA, 35 bp, Artificial Sequence
  Synthetic oligonucleotide
gatcagctgtgtgatctaatgtatatcactttaat

SEQ ID NO: 203382 - DNA, 35 bp, Artificial Sequence
  Synthetic oligonucleotide
agctaagtacgcgaagacccacccgacgtttgcag

SEQ ID NO: 203383 - DNA, 35 bp, Artificial Sequence
  Synthetic oligonucleotide
gcgccatctgcccacattcagggtatgaccgggcg

SEQ ID NO: 203384 - DNA, 35 bp, Artificial Sequence
  Synthetic oligonucleotide
tttggcctgtgactccctatcgttttaggtcagta

SEQ ID NO: 203385 - DNA, 35 bp, Artificial Sequence
  Synthetic oligonucleotide
acccgcttgcagggagtccctcctgtcataactgg

SEQ ID NO: 203386 - DNA, 37 bp, Artificial Sequence
  Synthetic oligonucleotide
actgttgttaccacctggttgttgggggcctgttaga

SEQ ID NO: 203387 - DNA, 37 bp, Artificial Sequence
  Synthetic oligonucleotide
gtgcccacgtccctccggttcgtctgagatctaagca

SEQ ID NO: 203388 - DNA, 36 bp, Artificial Sequence
  Synthetic oligonucleotide
gtctccttagtcaccgacatgttagttctcttcaca

SEQ ID NO: 203389 - DNA, 36 bp, Artificial Sequence
  Synthetic oligonucleotide
cagtactgcacatgtccttagccccttccgtctctt

SEQ ID NO: 203390 - DNA, 36 bp, Artificial Sequence
  Synthetic oligonucleotide
tgctggtttaagctagctaaccgttcgtttcgggca

SEQ ID NO: 203391 - DNA, 35 bp, Artificial Sequence
  Synthetic oligonucleotide
gcgtcctccctccgtccacgattcttagaataata

SEQ ID NO: 203392 - DNA, 35 bp, Artificial Sequence
  Synthetic oligonucleotide
gataggggttggtacgttcacacgattctatctct

SEQ ID NO: 203393 - DNA, 29 bp, Artificial Sequence
  Synthetic oligonucleotide
gccctatctcttgagatatctattctcaa

SEQ ID NO: 203394 - DNA, 36 bp, Artificial Sequence
  Synthetic oligonucleotide
acaatcgggtggtagacatccactgcggattaggct

SEQ ID NO: 203395 - DNA, 36 bp, Artificial Sequence
  Synthetic oligonucleotide
acctttgtacgggagctagacaacttttttcaagca

SEQ ID NO: 203396 - DNA, 36 bp, Artificial Sequence
  Synthetic oligonucleotide
actcctcggatcctctcacctcgtgtgctaatgtgt

SEQ ID NO: 203397 - DNA, 35 bp, Artificial Sequence
  Synthetic oligonucleotide
cgatccagcccctaccccccgtccatctgtcgcgt

SEQ ID NO: 203398 - DNA, 36 bp, Artificial Sequence
  Synthetic oligonucleotide
catcgggagaatggaggacgcacgccacctcagaca

SEQ ID NO: 203399 - DNA, 35 bp, Artificial Sequence
  Synthetic oligonucleotide
ttgctttcgaccgagcaatgcttgaggttatcacc

SEQ ID NO: 203400 - skipped

SEQ ID NO: 203401 - DNA, 36 bp, Artificial Sequence
  Synthetic oligonucleotide
attcaagtgtctggtcaataattgtgccgtatttca

SEQ ID NO: 203402 - DNA, 35 bp, Artificial Sequence
  Synthetic oligonucleotide
tcttcccgataagggtctacacagagttaatggcg

SEQ ID NO: 203403 - DNA, 38 bp, Artificial Sequence
  Synthetic oligonucleotide
cgacggacccgttgcccacgcatcaggcgcccttctca

SEQ ID NO: 203404 - DNA, 35 bp, Artificial Sequence
  Synthetic oligonucleotide
ggatcgtactgtacgtctcgataattcttgctaac

SEQ ID NO: 203405 - DNA, 36 bp, Artificial Sequence
  Synthetic oligonucleotide
ctcattgaaggcttaaccttgcttcaaaagcccggg

SEQ ID NO: 203406 - DNA, 38 bp, Artificial Sequence
  Synthetic oligonucleotide
tggcccgcaacaccaacccccaaatattggtaacctca

SEQ ID NO: 203407 - DNA, 38 bp, Artificial Sequence
  Synthetic oligonucleotide
gaggtcccgtccggttgagaaaccctcataaagagtga

SEQ ID NO: 203408 - DNA, 38 bp, Artificial Sequence
  Synthetic oligonucleotide
gactaacatctttgggtcccctccgcgttcatacatca

SEQ ID NO: 203409 - DNA, 35 bp, Artificial Sequence
  Synthetic oligonucleotide
cgcgcccaaaacttttgcgggttaaggatccaacc

SEQ ID NO: 203410 - DNA, 38 bp, Artificial Sequence
  Synthetic oligonucleotide
cgttcatgcaatgctgagtgggccaacttctccattca

SEQ ID NO: 203411 - DNA, 35 bp, Artificial Sequence
  Synthetic oligonucleotide
tcggtccgtgggctaatttccgtcccacactctcg

SEQ ID NO: 203412 - DNA, 38 bp, Artificial Sequence
  Synthetic oligonucleotide
tttcagataaagcggactcccggggaagggggacttca

SEQ ID NO: 203413 - DNA, 34 bp, Artificial Sequence
  Synthetic oligonucleotide
gtatgctaacgcatcactccattgttgatccgct

SEQ ID NO: 203414 - DNA, 35 bp, Artificial Sequence
  Synthetic oligonucleotide
ggtgtccccccttgcgcaacgggccatgagagtag

SEQ ID NO: 203415 - DNA, 38 bp, Artificial Sequence
  Synthetic oligonucleotide
gccctggtcgactcttctcgctacgtgtatcgccctca

SEQ ID NO: 203416 - DNA, 36 bp, Artificial Sequence
  Synthetic oligonucleotide
cccctacttagccaacgacaggcgactccggtatca

SEQ ID NO: 203417 - DNA, 35 bp, Artificial Sequence
  Synthetic oligonucleotide
gcagaactgcgcatgactcacaagacccgcatctt

SEQ ID NO: 203418 - DNA, 38 bp, Artificial Sequence
  Synthetic oligonucleotide
gcttttcagaattcgagccgagtaattgtaacgagtca

SEQ ID NO: 203419 - DNA, 37 bp, Artificial Sequence
  Synthetic oligonucleotide
catgccctcgccgtgctccgcaaaattaccattagca

SEQ ID NO: 203420 - DNA, 35 bp, Artificial Sequence
  Synthetic oligonucleotide
gcgtcctgtaggtgttctctcttgttaattagaca

SEQ ID NO: 203421 - DNA, 38 bp, Artificial Sequence
  Synthetic oligonucleotide
tagatttgtcgtcgtgctttagggccacagtaggatga

SEQ ID NO: 203422 - DNA, 35 bp, Artificial Sequence
  Synthetic oligonucleotide
tactctttctgttgtttacacgtactcagaatgct

SEQ ID NO: 203423 - DNA, 35 bp, Artificial Sequence
  Synthetic oligonucleotide
caggcacattgctagacgagaaatgtcatacgtac

SEQ ID NO: 203424 - DNA, 36 bp, Artificial Sequence
  Synthetic oligonucleotide
tatgctcctcagtcgaggcaaaccattcacgctgca

SEQ ID NO: 203425 - DNA, 35 bp, Artificial Sequence
  Synthetic oligonucleotide
agtccatctacacgtattccggggtgcacgcatct

SEQ ID NO: 203426 - DNA, 37 bp, Artificial Sequence
  Synthetic oligonucleotide
gtcgcggaactcgtacggacatctgatgtatcgtggt

SEQ ID NO: 203427 - DNA, 35 bp, Artificial Sequence
  Synthetic oligonucleotide
agtctttgattggtgcgctatcctacggtagtacg

SEQ ID NO: 203428 - DNA, 37 bp, Artificial Sequence
  Synthetic oligonucleotide
catgcattgcaatctgcacacatcctcttttccgcca

SEQ ID NO: 203429 - DNA, 37 bp, Artificial Sequence
  Synthetic oligonucleotide
acatctccaactttcgagaatcgaaagctcttgcaga

SEQ ID NO: 203430 - DNA, 36 bp, Artificial Sequence
  Synthetic oligonucleotide
gtatcgtatgatctgatagttaattggctcccccct

SEQ ID NO: 203431 - DNA, 38 bp, Artificial Sequence
  Synthetic oligonucleotide
aggtttgatcgtctcaccgatcccgtgttcttatatca

SEQ ID NO: 203432 - DNA, 35 bp, Artificial Sequence
  Synthetic oligonucleotide
cgtgcgtcatgtccgctggtactatcgttttttcg

SEQ ID NO: 203433 - DNA, 35 bp, Artificial Sequence
  Synthetic oligonucleotide
cacgccgtcgcggcgggtacagttcctctgggcag

SEQ ID NO: 203434 - DNA, 35 bp, Artificial Sequence
  Synthetic oligonucleotide
tttcttctgtaacctcgatacctcagccgatctca

SEQ ID NO: 203435 - DNA, 35 bp, Artificial Sequence
  Synthetic oligonucleotide
gaaccccaaacctccggttatgagacagcttcgta

SEQ ID NO: 203436 - DNA, 36 bp, Artificial Sequence
  Synthetic oligonucleotide
aaccgaaacgccttcgctaccatgtgtgacctcttt

SEQ ID NO: 203437 - DNA, 35 bp, Artificial Sequence
  Synthetic oligonucleotide
cacggcgtgtcgtgcgccaactccccgccgatgtc

SEQ ID NO: 203438 - DNA, 35 bp, Artificial Sequence
  Synthetic oligonucleotide
gcgcccgatgaagattgtggtccggccactatact

SEQ ID NO: 203439 - DNA, 38 bp, Artificial Sequence
  Synthetic oligonucleotide
gcttgatcgtcgcaaaagttcgtcccgccaaccttgat

SEQ ID NO: 203440 - DNA, 38 bp, Artificial Sequence
  Synthetic oligonucleotide
tgcatatgcgatcacacagtcgaagacatcatgaatca

SEQ ID NO: 203441 - DNA, 35 bp, Artificial Sequence
  Synthetic oligonucleotide
cgttggacgtgtcttagcttaactgtgcaggtact

SEQ ID NO: 203442 - DNA, 38 bp, Artificial Sequence
  Synthetic oligonucleotide
ccccggcggactgtggtactaggtggacttaccgttgt

SEQ ID NO: 203443 - DNA, 38 bp, Artificial Sequence
  Synthetic oligonucleotide
tgcctctcgcactgtcaaagtgggatcaaggacattca

SEQ ID NO: 203444 - DNA, 36 bp, Artificial Sequence
  Synthetic oligonucleotide
tgtgcacatgggctcgaccgcccctgcccttactag

SEQ ID NO: 203445 - DNA, 36 bp, Artificial Sequence
  Synthetic oligonucleotide
tcgttgacatgactaatcgtgccacaagcgccaaca

SEQ ID NO: 203446 - DNA, 35 bp, Artificial Sequence
  Synthetic oligonucleotide
cgtctgtacttaatcggattaatagcgctgcacct

SEQ ID NO: 203447 - DNA, 35 bp, Artificial Sequence
  Synthetic oligonucleotide
cacctataccttcgtctatgcttgctcgccgttct

SEQ ID NO: 203448 - DNA, 36 bp, Artificial Sequence
  Synthetic oligonucleotide
attccggtccggtttgcctagtacacgtcatatggt

SEQ ID NO: 203449 - DNA, 38 bp, Artificial Sequence
  Synthetic oligonucleotide
catctacggctctccacccaggtgtccttactgcctca

SEQ ID NO: 203450 - DNA, 38 bp, Artificial Sequence
  Synthetic oligonucleotide
gcgcactatgcatcagggatccttgttagctttagtta

SEQ ID NO: 203451 - DNA, 38 bp, Artificial Sequence
  Synthetic oligonucleotide
aaccctatcctgatctgggttaccgtacgacaatttgg

SEQ ID NO: 203452 - DNA, 36 bp, Artificial Sequence
  Synthetic oligonucleotide
cgtcgcggacgtcgaatagtagccacgggcctccca

SEQ ID NO: 203453 - DNA, 36 bp, Artificial Sequence
  Synthetic oligonucleotide
ccacccacaatcacgagaggggttgctgatcgagca

SEQ ID NO: 203454 - DNA, 34 bp, Artificial Sequence
  Synthetic oligonucleotide
tgccctctattcgccccccgcggacattcgcaat

SEQ ID NO: 203455 - DNA, 38 bp, Artificial Sequence
  Synthetic oligonucleotide
acggcattacatattccttgttcataatgatccgctga

SEQ ID NO: 203456 - DNA, 31 bp, Artificial Sequence
  Synthetic oligonucleotide
ctcctaccgaactacatcacggggaccttcg

SEQ ID NO: 203457 - DNA, 36 bp, Artificial Sequence
  Synthetic oligonucleotide
ggcttgctcaacgttgtctcgcggacacgcgtgtgt

SEQ ID NO: 203458 - DNA, 37 bp, Artificial Sequence
  Synthetic oligonucleotide
ttggatcggtttggtaatctcatatggtggctttaga

SEQ ID NO: 203459 - DNA, 38 bp, Artificial Sequence
  Synthetic oligonucleotide
tcgtcgctgcaacatccagacgaacaattgacgattgt

SEQ ID NO: 203460 - DNA, 38 bp, Artificial Sequence
  Synthetic oligonucleotide
ccgcgctactagccactgtccgcctgggctcacagtgt

SEQ ID NO: 203461 - DNA, 35 bp, Artificial Sequence
  Synthetic oligonucleotide
agagcatcccccttgtcacatgaatagggaacgtt

SEQ ID NO: 203462 - DNA, 36 bp, Artificial Sequence
  Synthetic oligonucleotide
actgcgctcgtgcactcttgcatcgttatctccact

SEQ ID NO: 203463 - DNA, 35 bp, Artificial Sequence
  Synthetic oligonucleotide
acttcatcttagtaagctttgtgcagattactcct

SEQ ID NO: 203464 - DNA, 35 bp, Artificial Sequence
  Synthetic oligonucleotide
cgatcacttaacgttcttgtctcagccccgctaat

SEQ ID NO: 203465 - DNA, 37 bp, Artificial Sequence
  Synthetic oligonucleotide
cgataactacaagccccgcttcctttcatgcactaga

SEQ ID NO: 203466 - DNA, 35 bp, Artificial Sequence
  Synthetic oligonucleotide
tagtcaggatgcgcagttgtactgcctgcaaaaag

SEQ ID NO: 203467 - DNA, 35 bp, Artificial Sequence
  Synthetic oligonucleotide
gctcgatagcagtacgaaccatattctaggtggcc

SEQ ID NO: 203468 - DNA, 37 bp, Artificial Sequence
  Synthetic oligonucleotide
tatctttggtccaccaagcgcggatcgcaacgaacca

SEQ ID NO: 203469 - DNA, 35 bp, Artificial Sequence
  Synthetic oligonucleotide
gactcttaacgatcgccggcccgagaaaccctcgc

SEQ ID NO: 203470 - DNA, 38 bp, Artificial Sequence
  Synthetic oligonucleotide
tgccgtcatgtggaaacaatgacgttcgccaaccttca

SEQ ID NO: 203471 - DNA, 36 bp, Artificial Sequence
  Synthetic oligonucleotide
gggcaaaacggatcgatatggaggcctatttgtgtt

SEQ ID NO: 203472 - DNA, 36 bp, Artificial Sequence
  Synthetic oligonucleotide
tacagcaactccctcagtttttcatgatagcgtcaa

SEQ ID NO: 203473 - DNA, 38 bp, Artificial Sequence
  Synthetic oligonucleotide
tttagttggggggacagcccctattagtctcccactca

SEQ ID NO: 203474 - DNA, 36 bp, Artificial Sequence
  Synthetic oligonucleotide
tgagtctacatgtggaaaacgttatgcctttcctca

SEQ ID NO: 203475 - DNA, 38 bp, Artificial Sequence
  Synthetic oligonucleotide
gggcaccgaaatgccgcgcccacgataggagctcttca

SEQ ID NO: 203476 - DNA, 36 bp, Artificial Sequence
  Synthetic oligonucleotide
ttgatctgagggactccgctccacccgcccttgaca

SEQ ID NO: 203477 - DNA, 38 bp, Artificial Sequence
  Synthetic oligonucleotide
acttatattagttgtcatattgcgcccagttgatttca

SEQ ID NO: 203478 - DNA, 35 bp, Artificial Sequence
  Synthetic oligonucleotide
tgaaggtggtcctcctactatccggttcctgtgct

SEQ ID NO: 203479 - DNA, 35 bp, Artificial Sequence
  Synthetic oligonucleotide
cgacggatgcctgttccccctttacatatgccgca

SEQ ID NO: 203480 - DNA, 35 bp, Artificial Sequence
  Synthetic oligonucleotide
tgtcatgaagcgaacgattgcggaatgtgccacag

SEQ ID NO: 203481 - DNA, 35 bp, Artificial Sequence
  Synthetic oligonucleotide
atccctaagcgaccaacggacacggttattgcacg

SEQ ID NO: 203482 - DNA, 37 bp, Artificial Sequence
  Synthetic oligonucleotide
gctatggcattgggcaatccttgccgttctgtgtaca

SEQ ID NO: 203483 - DNA, 35 bp, Artificial Sequence
  Synthetic oligonucleotide
gcgattatgatcctgtccacttccggacggtctcc

SEQ ID NO: 203484 - DNA, 35 bp, Artificial Sequence
  Synthetic oligonucleotide
tcctgtggtgtacgcatgcgcactatctaatggcg

SEQ ID NO: 203485 - DNA, 38 bp, Artificial Sequence
  Synthetic oligonucleotide
tttactgctaccatttcttcatctggggcatccagtga

SEQ ID NO: 203486 - DNA, 38 bp, Artificial Sequence
  Synthetic oligonucleotide
ttgcttcctgtcccgggagtgctatgtatttcggttca

SEQ ID NO: 203487 - DNA, 35 bp, Artificial Sequence
  Synthetic oligonucleotide
tcgttcgccctccaaggccttcctggaggttagcc

SEQ ID NO: 203488 - DNA, 34 bp, Artificial Sequence
  Synthetic oligonucleotide
tgtttgccgatctctcatctggaggaacggggtt

SEQ ID NO: 203489 - DNA, 38 bp, Artificial Sequence
  Synthetic oligonucleotide
ctctgcccgtatcgtttctgtgcgatgcgcactgctca

SEQ ID NO: 203490 - DNA, 38 bp, Artificial Sequence
  Synthetic oligonucleotide
agaattgttccagcgctacgcccggttcgtgttaatca

SEQ ID NO: 203491 - DNA, 37 bp, Artificial Sequence
  Synthetic oligonucleotide
ttcgtcacggagaattgtttgccgctacaaccgtagt

SEQ ID NO: 203492 - DNA, 38 bp, Artificial Sequence
  Synthetic oligonucleotide
ctagacgcctagtgaattttacactcccccctttctgt

SEQ ID NO: 203493 - DNA, 36 bp, Artificial Sequence
  Synthetic oligonucleotide
tatacgtccacgcccttatttcccgcctgattccca

SEQ ID NO: 203494 - DNA, 35 bp, Artificial Sequence
  Synthetic oligonucleotide
ccctggcatcttctgtggccctcttcatagttcgg

SEQ ID NO: 203495 - DNA, 36 bp, Artificial Sequence
  Synthetic oligonucleotide
atcccacgctcaaggtccatcagaatacatctcctg

SEQ ID NO: 203496 - DNA, 36 bp, Artificial Sequence
  Synthetic oligonucleotide
agggggtcctaaagcctaaagtccatacggcaagaa

SEQ ID NO: 203497 - DNA, 36 bp, Artificial Sequence
  Synthetic oligonucleotide
gccacagacgtgaatctgttccttagactagctgtt

SEQ ID NO: 203498 - DNA, 36 bp, Artificial Sequence
  Synthetic oligonucleotide
gaactgatccatcactgcgattcccgctttcttctt

SEQ ID NO: 203499 - DNA, 37 bp, Artificial Sequence
  Synthetic oligonucleotide
gtaactgctgcttgataagtgggtctcttaattctca

SEQ ID NO: 203500 - DNA, 35 bp, Artificial Sequence
  Synthetic oligonucleotide
cctccaccgacaacggtacacagactttacatgga

SEQ ID NO: 203501 - DNA, 36 bp, Artificial Sequence
  Synthetic oligonucleotide
agacatggccagtttttgagccgttgattttcgccg

SEQ ID NO: 203502 - DNA, 35 bp, Artificial Sequence
  Synthetic oligonucleotide
tccatccgctgatttactgagtgctacttcctttg

SEQ ID NO: 203503 - DNA, 37 bp, Artificial Sequence
  Synthetic oligonucleotide
gtcctttcgattatgagcgggccgccaagccgcctca

SEQ ID NO: 203504 - DNA, 34 bp, Artificial Sequence
  Synthetic oligonucleotide
acatgtcgatgtccgtcgacgcatctgatctact

SEQ ID NO: 203505 - DNA, 36 bp, Artificial Sequence
  Synthetic oligonucleotide
gcgcctctatgggtagtcaaaagacgagcccgcaca

SEQ ID NO: 203506 - DNA, 35 bp, Artificial Sequence
  Synthetic oligonucleotide
taaactttatgttagcccttagtcatcacacatca

SEQ ID NO: 203507 - DNA, 37 bp, Artificial Sequence
  Synthetic oligonucleotide
acaggaaaaagtactgttacgttccttttctttgcgt

SEQ ID NO: 203508 - DNA, 38 bp, Artificial Sequence
  Synthetic oligonucleotide
actgcgttaggtgttatcgctgctttgcccatgtctca

SEQ ID NO: 203509 - DNA, 35 bp, Artificial Sequence
  Synthetic oligonucleotide
ggttcgagctcgtgctctgtaatccggcctgacgc

SEQ ID NO: 203510 - DNA, 35 bp, Artificial Sequence
  Synthetic oligonucleotide
tgtcttcacgtatcgcaaggttaataggcgcctat

SEQ ID NO: 203511 - DNA, 36 bp, Artificial Sequence
  Synthetic oligonucleotide
gttcgaggcccaactgatcaaatgccgactgacaca

SEQ ID NO: 203512 - DNA, 36 bp, Artificial Sequence
  Synthetic oligonucleotide
acacctgccgagcgggcggttgtccgtagcgtacca

SEQ ID NO: 203513 - DNA, 36 bp, Artificial Sequence
  Synthetic oligonucleotide
cgaatggccgccgctcatgatctgtactgaggtgaa

SEQ ID NO: 203514 - DNA, 35 bp, Artificial Sequence
  Synthetic oligonucleotide
cccggcgagccaccggctgtacgagcaagtcacac

SEQ ID NO: 203515 - DNA, 37 bp, Artificial Sequence
  Synthetic oligonucleotide
ttgaatatgacttcaactcgtcgaacccatcggtcga

SEQ ID NO: 203516 - DNA, 36 bp, Artificial Sequence
  Synthetic oligonucleotide
gctccgcgacactcgaacaaaagaacttccttgcaa

SEQ ID NO: 203517 - DNA, 35 bp, Artificial Sequence
  Synthetic oligonucleotide
gcaggcgctggcgcactgcgtgaaccggctactct

SEQ ID NO: 203518 - DNA, 37 bp, Artificial Sequence
  Synthetic oligonucleotide
tgcgatagcggatcggcccgttgtttacgacttctca

SEQ ID NO: 203519 - DNA, 36 bp, Artificial Sequence
  Synthetic oligonucleotide
ccatccctcgaccagtcgggctggtaacaatataca

SEQ ID NO: 203520 - DNA, 35 bp, Artificial Sequence
  Synthetic oligonucleotide
agtccacgaatggggtattttaattacgttctgag

SEQ ID NO: 203521 - DNA, 36 bp, Artificial Sequence
  Synthetic oligonucleotide
ttatttcagggagtcccacaataatactagggggca

SEQ ID NO: 203522 - DNA, 35 bp, Artificial Sequence
  Synthetic oligonucleotide
gcatctactacgactggacccgttaggccttacca

SEQ ID NO: 203523 - DNA, 35 bp, Artificial Sequence
  Synthetic oligonucleotide
tgaggaggacccacatttaagcttgtacttaccca

SEQ ID NO: 203524 - DNA, 35 bp, Artificial Sequence
  Synthetic oligonucleotide
ccggctactgccttcggtgttaaaatctgtgtccg

SEQ ID NO: 203525 - DNA, 38 bp, Artificial Sequence
  Synthetic oligonucleotide
gtcaacggttggttgctgcacattcatcagcagaatgt

SEQ ID NO: 203526 - DNA, 36 bp, Artificial Sequence
  Synthetic oligonucleotide
atcctgctaagtgtatgctatcactttcctccgtaa

SEQ ID NO: 203527 - DNA, 35 bp, Artificial Sequence
  Synthetic oligonucleotide
cgtcgaagatgttcttcgctactaacgtggcccca

SEQ ID NO: 203528 - DNA, 36 bp, Artificial Sequence
  Synthetic oligonucleotide
cgaatgaccgcctctcatgatctgtactgaggtgaa

SEQ ID NO: 203529 - DNA, 36 bp, Artificial Sequence
  Synthetic oligonucleotide
agaattatggattcattaggtgtgacctcgttcgca

SEQ ID NO: 203530 - DNA, 36 bp, Artificial Sequence
  Synthetic oligonucleotide
tccgcatgggatcataggaaggtcttggtatccgca

SEQ ID NO: 203531 - DNA, 35 bp, Artificial Sequence
  Synthetic oligonucleotide
cccggcgcgccacgggctgtacgagcaagtcacac

SEQ ID NO: 203532 - DNA, 37 bp, Artificial Sequence
  Synthetic oligonucleotide
ccttacctttgttcgtccacgtgatcgaattgggcca

SEQ ID NO: 203533 - DNA, 38 bp, Artificial Sequence
  Synthetic oligonucleotide
agttggcacgtctccactccttctcgccctcccgctca

SEQ ID NO: 203534 - DNA, 35 bp, Artificial Sequence
  Synthetic oligonucleotide
gcggtgaaattgctctttgtatttcgcttaaggag

SEQ ID NO: 203535 - DNA, 35 bp, Artificial Sequence
  Synthetic oligonucleotide
ttccgatcataagcattcactcaatggaattaggg

SEQ ID NO: 203536 - DNA, 35 bp, Artificial Sequence
  Synthetic oligonucleotide
ccatagttatgatgattacatcttagtgccccacc

SEQ ID NO: 203537 - DNA, 36 bp, Artificial Sequence
  Synthetic oligonucleotide
agggtgtaaataaccccggctactattggtgaatca

SEQ ID NO: 203538 - DNA, 37 bp, Artificial Sequence
  Synthetic oligonucleotide
gcgttgccttatgtgcgttcggggtgtaccaaggcca

SEQ ID NO: 203539 - DNA, 37 bp, Artificial Sequence
  Synthetic oligonucleotide
tggccctattagagccagatccgagtatgatgtcaca

SEQ ID NO: 203540 - DNA, 36 bp, Artificial Sequence
  Synthetic oligonucleotide
gttgctccaatctttgccaacgagctctatgtaaca

SEQ ID NO: 203541 - DNA, 35 bp, Artificial Sequence
  Synthetic oligonucleotide
acattgcatttgtgccaacttcgatcttgcttgcg

SEQ ID NO: 203542 - DNA, 35 bp, Artificial Sequence
  Synthetic oligonucleotide
ctcgccacggtctctgataagatcattgttgtcat

SEQ ID NO: 203543 - DNA, 35 bp, Artificial Sequence
  Synthetic oligonucleotide
aatggtagcttctggactgccacacctcccgttct

SEQ ID NO: 203544 - DNA, 37 bp, Artificial Sequence
  Synthetic oligonucleotide
gccttcaccggccactgccataaagtacgtcattaca

SEQ ID NO: 203545 - DNA, 35 bp, Artificial Sequence
  Synthetic oligonucleotide
ctatttcagctctcgatttattatgacacgcgtcg

SEQ ID NO: 203546 - DNA, 36 bp, Artificial Sequence
  Synthetic oligonucleotide
ggctagtagcagtacaagtaattgcgcccccggtca

SEQ ID NO: 203547 - DNA, 35 bp, Artificial Sequence
  Synthetic oligonucleotide
attacaccgccgttccctctttgtgggggactcat

SEQ ID NO: 203548 - DNA, 35 bp, Artificial Sequence
  Synthetic oligonucleotide
tctgggttcacaatccttgcatagttctagtgtct

SEQ ID NO: 203549 - DNA, 36 bp, Artificial Sequence
  Synthetic oligonucleotide
tgctcttcaggttgacccaccccgtttgagacgcga

SEQ ID NO: 203550 - DNA, 35 bp, Artificial Sequence
  Synthetic oligonucleotide
cccggcgagccacgggctgtacgagcacgtcacac

SEQ ID NO: 203551 - DNA, 35 bp, Artificial Sequence
  Synthetic oligonucleotide
tagtcgtttactgaactaggtcgaagttctcaaag

SEQ ID NO: 203552 - DNA, 36 bp, Artificial Sequence
  Synthetic oligonucleotide
tcgttgacatgactaatcgtgccacaagcgccaaat

SEQ ID NO: 203553 - DNA, 34 bp, Artificial Sequence
  Synthetic oligonucleotide
tcaccttcgccagtagtgactcaccactgcgtgc

SEQ ID NO: 203554 - DNA, 38 bp, Artificial Sequence
  Synthetic oligonucleotide
gaaccaagatgcgtcttaacgttagtgttcccttttga

SEQ ID NO: 203555 - DNA, 35 bp, Artificial Sequence
  Synthetic oligonucleotide
cttggcctttatagactgaaatacgacaatttgag

SEQ ID NO: 203556 - DNA, 35 bp, Artificial Sequence
  Synthetic oligonucleotide
gcgttgttcctaatcacactgatctttcactggtg

SEQ ID NO: 203557 - DNA, 36 bp, Artificial Sequence
  Synthetic oligonucleotide
tgcacgtactagtctgctggcacatgtttctgtgca

SEQ ID NO: 203558 - DNA, 36 bp, Artificial Sequence
  Synthetic oligonucleotide
taatcaagcctgggaatgcacattctcgtggtaact

SEQ ID NO: 203559 - DNA, 35 bp, Artificial Sequence
  Synthetic oligonucleotide
gcacacgcggtacaatggaggctgtgccccttgtg

SEQ ID NO: 203560 - DNA, 37 bp, Artificial Sequence
  Synthetic oligonucleotide
atttgagggttcccgtcccgtttttctttaatatgca

SEQ ID NO: 203561 - DNA, 35 bp, Artificial Sequence
  Synthetic oligonucleotide
aggcgctggagtaccgcgctctcctaaaacctccg

SEQ ID NO: 203562 - DNA, 38 bp, Artificial Sequence
  Synthetic oligonucleotide
gttctcagttctgccgtattgacatggttctatactga

SEQ ID NO: 203563 - DNA, 29 bp, Artificial Sequence
  Synthetic oligonucleotide
ggtacgaatcacacccaccccgagaacga

SEQ ID NO: 203564 - DNA, 38 bp, Artificial Sequence
  Synthetic oligonucleotide
gataaagtgtgggttcttggtggaactttcaaccctca

SEQ ID NO: 203565 - DNA, 38 bp, Artificial Sequence
  Synthetic oligonucleotide
tttcgaggagtttcgcccagggtctcgcgagccagtca

SEQ ID NO: 203566 - DNA, 35 bp, Artificial Sequence
  Synthetic oligonucleotide
cctattccgagctccacccgttggtgtcttaccct

SEQ ID NO: 203567 - DNA, 36 bp, Artificial Sequence
  Synthetic oligonucleotide
gtccgtgagggtgtatgggaattagaccccacatca

SEQ ID NO: 203568 - DNA, 35 bp, Artificial Sequence
  Synthetic oligonucleotide
aaccccctgaggcacgaattcccttggcactggca

SEQ ID NO: 203569 - DNA, 38 bp, Artificial Sequence
  Synthetic oligonucleotide
tagtcagtcgctgacctcctgtgggctaccgtgcctca

SEQ ID NO: 203570 - DNA, 35 bp, Artificial Sequence
  Synthetic oligonucleotide
taagttgtccgttgctgttcttatttcctttccct

SEQ ID NO: 203571 - DNA, 34 bp, Artificial Sequence
  Synthetic oligonucleotide
atcacgattcagcgccacggcttctggagcaacc

SEQ ID NO: 203572 - DNA, 35 bp, Artificial Sequence
  Synthetic oligonucleotide
tgctgtctaaatactctcgatgcgtttacgtccct

SEQ ID NO: 203573 - DNA, 36 bp, Artificial Sequence
  Synthetic oligonucleotide
gaaacgaacgcagtgtgagattggactggtaacgaa

SEQ ID NO: 203574 - DNA, 37 bp, Artificial Sequence
  Synthetic oligonucleotide
ccgttacaggtacatttctatcacttgtgcttgatga

SEQ ID NO: 203575 - DNA, 37 bp, Artificial Sequence
  Synthetic oligonucleotide
gccatgaggagtggttgtatttcggtaaatccccgca

SEQ ID NO: 203576 - DNA, 38 bp, Artificial Sequence
  Synthetic oligonucleotide
acctattttgatgcacctacagattagttacttcatgt

SEQ ID NO: 203577 - DNA, 38 bp, Artificial Sequence
  Synthetic oligonucleotide
cctgtcatcttggttttttggccacgtaagtccattca

SEQ ID NO: 203578 - DNA, 36 bp, Artificial Sequence
  Synthetic oligonucleotide
ttgtcgttccccgaaaaaggggtcaccccggtacaa

SEQ ID NO: 203579 - DNA, 35 bp, Artificial Sequence
  Synthetic oligonucleotide
gccctggcaccaaagtcgcacactcaatcgtgtgc

SEQ ID NO: 203580 - DNA, 35 bp, Artificial Sequence
  Synthetic oligonucleotide
cgccgtacagtaagtcagccggatgcttgctaact

SEQ ID NO: 203581 - DNA, 37 bp, Artificial Sequence
  Synthetic oligonucleotide
tagttccttagacagtatgcttttagctctttttagt

SEQ ID NO: 203582 - DNA, 35 bp, Artificial Sequence
  Synthetic oligonucleotide
caaaaaatactgacttcccgtgcagtttcgcaaag

SEQ ID NO: 203583 - DNA, 38 bp, Artificial Sequence
  Synthetic oligonucleotide
ctggtacagagaatctattatctcgtatttggtcctca

SEQ ID NO: 203584 - DNA, 36 bp, Artificial Sequence
  Synthetic oligonucleotide
cgccgtcattagaaactatcgatgccagccgctcca

SEQ ID NO: 203585 - DNA, 35 bp, Artificial Sequence
  Synthetic oligonucleotide
atatctgtagaaatgtctcgtcacgctcgccgtac

SEQ ID NO: 203586 - DNA, 38 bp, Artificial Sequence
  Synthetic oligonucleotide
catgacctggacgagtgacgttccaatcgaaggagtca

SEQ ID NO: 203587 - DNA, 37 bp, Artificial Sequence
  Synthetic oligonucleotide
agacagtcgcaccccctacatgccaagttggtgtaca

SEQ ID NO: 203588 - DNA, 35 bp, Artificial Sequence
  Synthetic oligonucleotide
gcgtttgtccaccgctcactttattacacgtatct

SEQ ID NO: 203589 - DNA, 35 bp, Artificial Sequence
  Synthetic oligonucleotide
ctacagagcgttgcccggttctgttcgttccttac

SEQ ID NO: 203590 - DNA, 35 bp, Artificial Sequence
  Synthetic oligonucleotide
tgaggcatttcccggagttcagtttcgttgcctgc

SEQ ID NO: 203591 - DNA, 38 bp, Artificial Sequence
  Synthetic oligonucleotide
cctccactatacatgccgtcacgtgtgacgttctgtca

SEQ ID NO: 203592 - DNA, 35 bp, Artificial Sequence
  Synthetic oligonucleotide
gatcattcctgcaaataggccaggctttctctcct

SEQ ID NO: 203593 - DNA, 36 bp, Artificial Sequence
  Synthetic oligonucleotide
cacctgaagtctgagccgctacattcacccctcgca

SEQ ID NO: 203594 - DNA, 37 bp, Artificial Sequence
  Synthetic oligonucleotide
ctaatgcgtgtgttacaactcgcacctcctatactga

SEQ ID NO: 203595 - DNA, 35 bp, Artificial Sequence
  Synthetic oligonucleotide
tccggttcctgcgcgcttaccaccaacttatattt

SEQ ID NO: 203596 - DNA, 37 bp, Artificial Sequence
  Synthetic oligonucleotide
actggagctaagtagtagtcccttgcgatacattcca

SEQ ID NO: 203597 - DNA, 35 bp, Artificial Sequence
  Synthetic oligonucleotide
gcaaagagtcgcatcaccagctccgcgtactttcc

SEQ ID NO: 203598 - DNA, 35 bp, Artificial Sequence
  Synthetic oligonucleotide
tatctgagaccaccatgggttgatcagtcgctccc

SEQ ID NO: 203599 - DNA, 35 bp, Artificial Sequence
  Synthetic oligonucleotide
ccgcctaatacatcgtacaggatctcactgtctcg

SEQ ID NO: 203600 - DNA, 37 bp, Artificial Sequence
  Synthetic oligonucleotide
gccatcggacgtccctaaccccccattgtccgacaca

SEQ ID NO: 203601 - DNA, 35 bp, Artificial Sequence
  Synthetic oligonucleotide
attgaagtcacggcatccataactagggtctatct

SEQ ID NO: 203602 - DNA, 35 bp, Artificial Sequence
  Synthetic oligonucleotide
gataagtcacggacggtttctctactgtgccttct

SEQ ID NO: 203603 - DNA, 35 bp, Artificial Sequence
  Synthetic oligonucleotide
gattatggcctcttcactcgcgtgatgcactttgt

SEQ ID NO: 203604 - DNA, 35 bp, Artificial Sequence
  Synthetic oligonucleotide
ttagcgcgttcatcattcattggcttatcggtaat

SEQ ID NO: 203605 - DNA, 35 bp, Artificial Sequence
  Synthetic oligonucleotide
agcctggatagacttttcagctggctcatctcgct

SEQ ID NO: 203606 - DNA, 35 bp, Artificial Sequence
  Synthetic oligonucleotide
taccgatttcgcaaaccgtatgaacctcctggcac

SEQ ID NO: 203607 - DNA, 38 bp, Artificial Sequence
  Synthetic oligonucleotide
gacgacactcactttatgatcgtctcagcgcgtattca

SEQ ID NO: 203608 - DNA, 35 bp, Artificial Sequence
  Synthetic oligonucleotide
gtcggacactgataagctcctcttggctcttcgtg

SEQ ID NO: 203609 - DNA, 35 bp, Artificial Sequence
  Synthetic oligonucleotide
aggcattgcacttgtctcttccgaggtccgtttca

SEQ ID NO: 203610 - DNA, 35 bp, Artificial Sequence
  Synthetic oligonucleotide
gcccgcttggccactctatggattcaccacagacc

SEQ ID NO: 203611 - DNA, 35 bp, Artificial Sequence
  Synthetic oligonucleotide
ttttgtatcggaaaccagatcaattgctcttaacc

SEQ ID NO: 203612 - DNA, 37 bp, Artificial Sequence
  Synthetic oligonucleotide
gcggaaggctacgagtctctccgcgggtttacgcgca

SEQ ID NO: 203613 - DNA, 37 bp, Artificial Sequence
  Synthetic oligonucleotide
gatctcgacgaacatacttgctgcgtcttacacgaca

SEQ ID NO: 203614 - DNA, 36 bp, Artificial Sequence
  Synthetic oligonucleotide
tctcccagccacgacgcccttacgttacactcatga

SEQ ID NO: 203615 - DNA, 37 bp, Artificial Sequence
  Synthetic oligonucleotide
agtatagtgaccgattacaccccggtacccctcctca

SEQ ID NO: 203616 - DNA, 38 bp, Artificial Sequence
  Synthetic oligonucleotide
attgacttggccgccgataatttcctactagaacatgg

SEQ ID NO: 203617 - DNA, 35 bp, Artificial Sequence
  Synthetic oligonucleotide
gcgatggagccagttattttacaatatggtgctgt

SEQ ID NO: 203618 - DNA, 38 bp, Artificial Sequence
  Synthetic oligonucleotide
tgaatcggcgccccggatcatcatccggccaactgtgt

SEQ ID NO: 203619 - DNA, 36 bp, Artificial Sequence
  Synthetic oligonucleotide
caccggcgctcattatatattgggagttcaacttaa

SEQ ID NO: 203620 - DNA, 36 bp, Artificial Sequence
  Synthetic oligonucleotide
ctcctctcagtgttctgttgcccgtcgttgctacta

SEQ ID NO: 203621 - DNA, 35 bp, Artificial Sequence
  Synthetic oligonucleotide
atcaccttcgcgccctgcactttccaatcgggctt

SEQ ID NO: 203622 - DNA, 35 bp, Artificial Sequence
  Synthetic oligonucleotide
aaagggcgtagtgcactatgttttcgggttttcca

SEQ ID NO: 203623 - DNA, 35 bp, Artificial Sequence
  Synthetic oligonucleotide
ccctgcatgctcaacaggtacatatccgcccttct

SEQ ID NO: 203624 - DNA, 37 bp, Artificial Sequence
  Synthetic oligonucleotide
ccaccttttccaaccatcccaggatagtcgcccacga

SEQ ID NO: 203625 - DNA, 38 bp, Artificial Sequence
  Synthetic oligonucleotide
tggtggggtaaaccgtggtaaacgtactgtgatattca

SEQ ID NO: 203626 - DNA, 36 bp, Artificial Sequence
  Synthetic oligonucleotide
ttacatggacaggagtgcaccaaattccgcacccca

SEQ ID NO: 203627 - DNA, 35 bp, Artificial Sequence
  Synthetic oligonucleotide
tttcttctggtactttgtgacccagttcttgtttg

SEQ ID NO: 203628 - DNA, 35 bp, Artificial Sequence
  Synthetic oligonucleotide
gttgaatcgtgggcgttgagccgccgacgcgccct

SEQ ID NO: 203629 - DNA, 36 bp, Artificial Sequence
  Synthetic oligonucleotide
ctgctcccttacaaaaaacttcccccttgtactaaa

SEQ ID NO: 203630 - DNA, 36 bp, Artificial Sequence
  Synthetic oligonucleotide
acccctcgtctctctgctcattattgacgatggcca

SEQ ID NO: 203631 - DNA, 37 bp, Artificial Sequence
  Synthetic oligonucleotide
ctatgtgtgcgctccttcccattgatgtacgttaaca

SEQ ID NO: 203632 - DNA, 36 bp, Artificial Sequence
  Synthetic oligonucleotide
gacgcctaggtgctggatcgtcttttccttctcgct

SEQ ID NO: 203633 - DNA, 35 bp, Artificial Sequence
  Synthetic oligonucleotide
ctagggatgcggtctgattatggcgacgtatatag

SEQ ID NO: 203634 - DNA, 35 bp, Artificial Sequence
  Synthetic oligonucleotide
cccagctccccgaaagactaaggctaataccggaa

SEQ ID NO: 203635 - DNA, 37 bp, Artificial Sequence
  Synthetic oligonucleotide
gcgtgacactcatcgccgtgcatatctgggaacaaca

SEQ ID NO: 203636 - DNA, 35 bp, Artificial Sequence
  Synthetic oligonucleotide
tacgctcagactgaactctggtcccgtaacatgct

SEQ ID NO: 203637 - DNA, 38 bp, Artificial Sequence
  Synthetic oligonucleotide
ttaccattgttactggccgtttaacacagccacaatca

SEQ ID NO: 203638 - DNA, 35 bp, Artificial Sequence
  Synthetic oligonucleotide
cccggcgagccacgggctgttcgagcaagtcacac

SEQ ID NO: 203639 - DNA, 35 bp, Artificial Sequence
  Synthetic oligonucleotide
gagccggccctatgtatcaacaattttaataacag

SEQ ID NO: 203640 - DNA, 38 bp, Artificial Sequence
  Synthetic oligonucleotide
tcctagtagcagacggactgcatgtccgctagtaatca

SEQ ID NO: 203641 - DNA, 35 bp, Artificial Sequence
  Synthetic oligonucleotide
cccggcgagccacgggctgtgcgagcaagtcacac

SEQ ID NO: 203642 - DNA, 35 bp, Artificial Sequence
  Synthetic oligonucleotide
ccccgaccctactctcgcgccccgtgaagcccacg

SEQ ID NO: 203643 - DNA, 36 bp, Artificial Sequence
  Synthetic oligonucleotide
cgtacgtccagttggagttacattaatatccgtcaa

SEQ ID NO: 203644 - DNA, 36 bp, Artificial Sequence
  Synthetic oligonucleotide
agctggaacctgaattagacggttcttgtctatgca

SEQ ID NO: 203645 - DNA, 38 bp, Artificial Sequence
  Synthetic oligonucleotide
aacggcctaccctgtttggctttccggtaaagacatca

SEQ ID NO: 203646 - DNA, 35 bp, Artificial Sequence
  Synthetic oligonucleotide
gtccgtctgcaagtgtttgacttgacgagcgaccc

SEQ ID NO: 203647 - DNA, 36 bp, Artificial Sequence
  Synthetic oligonucleotide
aggccccgcaccgtacctcgatttgaatcgattctt

SEQ ID NO: 203648 - DNA, 37 bp, Artificial Sequence
  Synthetic oligonucleotide
catgcacagtttcagcttcgaccctagcagtctggca

SEQ ID NO: 203649 - DNA, 35 bp, Artificial Sequence
  Synthetic oligonucleotide
cgtatacacgacgcagccgtagggtccgttattca

SEQ ID NO: 203650 - DNA, 34 bp, Artificial Sequence
  Synthetic oligonucleotide
tactctcttgctaaatatgaattggccgagttcc

SEQ ID NO: 203651 - DNA, 35 bp, Artificial Sequence
  Synthetic oligonucleotide
cccggccagccacgggctgtacgagcaagtcacac

SEQ ID NO: 203652 - DNA, 35 bp, Artificial Sequence
  Synthetic oligonucleotide
tttgccgtccatctattcagagtgcactccccgct

SEQ ID NO: 203653 - DNA, 36 bp, Artificial Sequence
  Synthetic oligonucleotide
cacaccgctaatttatgcaatcttgctggcccatca

SEQ ID NO: 203654 - DNA, 35 bp, Artificial Sequence
  Synthetic oligonucleotide
tccagagtcatcgttgagcccttcggccttgaata

SEQ ID NO: 203655 - DNA, 38 bp, Artificial Sequence
  Synthetic oligonucleotide
acccgcgaactggttcctctattcctgtcatccgttga

SEQ ID NO: 203656 - DNA, 36 bp, Artificial Sequence
  Synthetic oligonucleotide
gagcctccccattctaatcacataggccgggtctaa

SEQ ID NO: 203657 - DNA, 36 bp, Artificial Sequence
  Synthetic oligonucleotide
ttatcgaaggcccacgtcttgtcatctgtaattgaa

SEQ ID NO: 203658 - DNA, 35 bp, Artificial Sequence
  Synthetic oligonucleotide
aggtaagcattcctaaacaaattgtcttgatccat

SEQ ID NO: 203659 - DNA, 37 bp, Artificial Sequence
  Synthetic oligonucleotide
acgaattcatgtgggctacgctgaccgttccgattca

SEQ ID NO: 203660 - DNA, 35 bp, Artificial Sequence
  Synthetic oligonucleotide
attggagagacctggaagtccatcacctatcctct

SEQ ID NO: 203661 - DNA, 36 bp, Artificial Sequence
  Synthetic oligonucleotide
gaattggggtcttgccgcggctcgttataacttcaa

SEQ ID NO: 203662 - DNA, 29 bp, Artificial Sequence
  Synthetic oligonucleotide
gacatcactccggccgttttcggtccttc

SEQ ID NO: 203663 - DNA, 36 bp, Artificial Sequence
  Synthetic oligonucleotide
gagccagtgtacgctgctaacgctataattatgtca

SEQ ID NO: 203664 - DNA, 37 bp, Artificial Sequence
  Synthetic oligonucleotide
aatattggatgcgaatagggggctttgtacatggtgt

SEQ ID NO: 203665 - DNA, 35 bp, Artificial Sequence
  Synthetic oligonucleotide
gttcgtgccggcgaaatcgccttgggtcgaccgcc

SEQ ID NO: 203666 - DNA, 36 bp, Artificial Sequence
  Synthetic oligonucleotide
ggctagaggtaaaactctaaagtgtccttctcgcca

SEQ ID NO: 203667 - DNA, 37 bp, Artificial Sequence
  Synthetic oligonucleotide
ttcctctataatgctttacactgagacggacccccca

SEQ ID NO: 203668 - DNA, 35 bp, Artificial Sequence
  Synthetic oligonucleotide
attttcactccgttggtgcgtactgcctcctgttg

SEQ ID NO: 203669 - DNA, 36 bp, Artificial Sequence
  Synthetic oligonucleotide
cgtcgatcagtcgctttctacccagcctcatccgtt

SEQ ID NO: 203670 - DNA, 36 bp, Artificial Sequence
  Synthetic oligonucleotide
ttcgtgccaccgtacagctagacgggacgttccctt

SEQ ID NO: 203671 - DNA, 35 bp, Artificial Sequence
  Synthetic oligonucleotide
agaatccaggctgtgggaccattaattgtccttct

SEQ ID NO: 203672 - DNA, 37 bp, Artificial Sequence
  Synthetic oligonucleotide
ttgaaaaacagtactgtcataattactctctactcca

SEQ ID NO: 203673 - DNA, 35 bp, Artificial Sequence
  Synthetic oligonucleotide
ttatggctctacgcaccgccaacagcccagcttat

SEQ ID NO: 203674 - DNA, 37 bp, Artificial Sequence
  Synthetic oligonucleotide
gtatctgcgcccactcgatatgttgttacgaattcgt

SEQ ID NO: 203675 - DNA, 36 bp, Artificial Sequence
  Synthetic oligonucleotide
cctaccggagtgtgtacggttctagcagcatttgtt

SEQ ID NO: 203676 - DNA, 36 bp, Artificial Sequence
  Synthetic oligonucleotide
tcatgaaacgagctaattccgtatgggtttaccaca

SEQ ID NO: 203677 - DNA, 37 bp, Artificial Sequence
  Synthetic oligonucleotide
ctatgcatacgccccgaccgtattattgctattgtca

SEQ ID NO: 203678 - DNA, 35 bp, Artificial Sequence
  Synthetic oligonucleotide
tggcttcaagctccatttcaacctacattgctaga

SEQ ID NO: 203679 - DNA, 35 bp, Artificial Sequence
  Synthetic oligonucleotide
acgcgttaagccctacgaccggtgcgtatgcgtct

SEQ ID NO: 203680 - DNA, 36 bp, Artificial Sequence
  Synthetic oligonucleotide
gttgccccccgtcagtgtaactggtgcggttaccaa

SEQ ID NO: 203681 - DNA, 38 bp, Artificial Sequence
  Synthetic oligonucleotide
taggaatctagttggcgaactccagtcgacctaaatca

SEQ ID NO: 203682 - DNA, 35 bp, Artificial Sequence
  Synthetic oligonucleotide
cccgacgagccacgggctgtacgagcaagtcacac

SEQ ID NO: 203683 - DNA, 35 bp, Artificial Sequence
  Synthetic oligonucleotide
tactagcagggacatagcctttacgcctgcctgta

SEQ ID NO: 203684 - DNA, 37 bp, Artificial Sequence
  Synthetic oligonucleotide
ggcgatcaactggctcaacagccgatagtcaatctga

SEQ ID NO: 203685 - DNA, 37 bp, Artificial Sequence
  Synthetic oligonucleotide
tctcagtgctccaccgcttcatactggtgttttcggt

SEQ ID NO: 203686 - DNA, 37 bp, Artificial Sequence
  Synthetic oligonucleotide
gcgtacagtcccgtctacctagtctcattgtgatcga

SEQ ID NO: 203687 - DNA, 27 bp, Artificial Sequence
  Synthetic oligonucleotide
cgctaaaatcattattcgctcatttca

SEQ ID NO: 203688 - DNA, 35 bp, Artificial Sequence
  Synthetic oligonucleotide
tagccccctttttctcgtaacccaacattacatct

SEQ ID NO: 203689 - DNA, 36 bp, Artificial Sequence
  Synthetic oligonucleotide
tgttatgtactggcaatatttggtcaggctgtttcg

SEQ ID NO: 203690 - DNA, 37 bp, Artificial Sequence
  Synthetic oligonucleotide
gccctgtcatatagtcaaatgggtgacccgcgcatca

SEQ ID NO: 203691 - DNA, 35 bp, Artificial Sequence
  Synthetic oligonucleotide
ggtaccttcagccattgttatatgctgctttccga

SEQ ID NO: 203692 - DNA, 36 bp, Artificial Sequence
  Synthetic oligonucleotide
ttttgagccgtgagggccccaggtgatccagcttag

SEQ ID NO: 203693 - DNA, 37 bp, Artificial Sequence
  Synthetic oligonucleotide
caccgccaactgcgccctgatgtcgattgatcattca

SEQ ID NO: 203694 - DNA, 38 bp, Artificial Sequence
  Synthetic oligonucleotide
gtcctagcttggtattcgctttgatatccaccccgtga

SEQ ID NO: 203695 - DNA, 38 bp, Artificial Sequence
  Synthetic oligonucleotide
gatgtgactgcctgccatggtttggttattgcccttca

SEQ ID NO: 203696 - DNA, 34 bp, Artificial Sequence
  Synthetic oligonucleotide
gagggataagggcgccgggtgacgccttttctag

SEQ ID NO: 203697 - DNA, 36 bp, Artificial Sequence
  Synthetic oligonucleotide
gatccattcggaccgatgctagtagctgctatattg

SEQ ID NO: 203698 - DNA, 38 bp, Artificial Sequence
  Synthetic oligonucleotide
gcctgcgttaaagggcatcttatcctatcatctgctga

SEQ ID NO: 203699 - DNA, 38 bp, Artificial Sequence
  Synthetic oligonucleotide
ggtcttgcccgctcgcactttccgagtgttagaattca

SEQ ID NO: 203700 - DNA, 38 bp, Artificial Sequence
  Synthetic oligonucleotide
cctttcccttcaatcataatacgtggcccctatactga

SEQ ID NO: 203701 - DNA, 38 bp, Artificial Sequence
  Synthetic oligonucleotide
ctctatcctcggatagctgtatcgcattacatgtttga

SEQ ID NO: 203702 - DNA, 35 bp, Artificial Sequence
  Synthetic oligonucleotide
tagtcaggatgcgcagttgtactgtcttcaaaacg

SEQ ID NO: 203703 - DNA, 36 bp, Artificial Sequence
  Synthetic oligonucleotide
gtcgctccctccaccgtcaccagatcgagccctgca

SEQ ID NO: 203704 - DNA, 35 bp, Artificial Sequence
  Synthetic oligonucleotide
ggtctataggtttgtgccctaagcttcttgcgtgg

SEQ ID NO: 203705 - DNA, 35 bp, Artificial Sequence
  Synthetic oligonucleotide
gtatcaattacgttcctatatatatgtgtttcatt

SEQ ID NO: 203706 - DNA, 35 bp, Artificial Sequence
  Synthetic oligonucleotide
cccggcgagccacgggccgtacgagcaagtcacac

SEQ ID NO: 203707 - DNA, 38 bp, Artificial Sequence
  Synthetic oligonucleotide
gtgttgcgcgcaccgaatagcttgctgactgagattgt

SEQ ID NO: 203708 - DNA, 37 bp, Artificial Sequence
  Synthetic oligonucleotide
ggctccataccaccacagatacgcgctgaagtctaca

SEQ ID NO: 203709 - DNA, 35 bp, Artificial Sequence
  Synthetic oligonucleotide
tgttcccaacctcgatttatttcattcggggtata

SEQ ID NO: 203710 - DNA, 37 bp, Artificial Sequence
  Synthetic oligonucleotide
gtcctctcgactgaattactattctagatctatgcca

SEQ ID NO: 203711 - DNA, 36 bp, Artificial Sequence
  Synthetic oligonucleotide
tctgtagtctgggtgctctgtgtgcacgtaacccca

SEQ ID NO: 203712 - DNA, 38 bp, Artificial Sequence
  Synthetic oligonucleotide
ccctggacgttcattactcaggttcccgtccctcatga

SEQ ID NO: 203713 - DNA, 35 bp, Artificial Sequence
  Synthetic oligonucleotide
gccatcctcgaaatcgcaagatgccgtcgaccccg

SEQ ID NO: 203714 - DNA, 38 bp, Artificial Sequence
  Synthetic oligonucleotide
gatctatctacccgataatgtcacgatttatggaatgt

SEQ ID NO: 203715 - DNA, 35 bp, Artificial Sequence
  Synthetic oligonucleotide
ttaaggatatgtacgcatacgcgttagaatgcacg

SEQ ID NO: 203716 - DNA, 38 bp, Artificial Sequence
  Synthetic oligonucleotide
gcggcctccgtgagctattttccatgctatgctggtca

SEQ ID NO: 203717 - DNA, 36 bp, Artificial Sequence
  Synthetic oligonucleotide
attggcttcttcgtatggttaattatcgctgactca

SEQ ID NO: 203718 - DNA, 38 bp, Artificial Sequence
  Synthetic oligonucleotide
agccccatgctacacagagtgcgtctcttatcctgtca

SEQ ID NO: 203719 - DNA, 35 bp, Artificial Sequence
  Synthetic oligonucleotide
actttgcgctcgacatctgaaagccctgcgcagca

SEQ ID NO: 203720 - DNA, 35 bp, Artificial Sequence
  Synthetic oligonucleotide
ggtacctcgtacttttttgcacaccacccgctgat

SEQ ID NO: 203721 - DNA, 36 bp, Artificial Sequence
  Synthetic oligonucleotide
cctgcagcatgttattgggtgctaaactcttaccct

SEQ ID NO: 203722 - DNA, 37 bp, Artificial Sequence
  Synthetic oligonucleotide
tggttgccgaacattcgtaggctgcatttcaccagca

SEQ ID NO: 203723 - DNA, 35 bp, Artificial Sequence
  Synthetic oligonucleotide
cctgttacatcgaacctgttaaagttccggatgat

SEQ ID NO: 203724 - DNA, 35 bp, Artificial Sequence
  Synthetic oligonucleotide
agctcctctgtcaaggccgctgttgccacggattt

SEQ ID NO: 203725 - DNA, 37 bp, Artificial Sequence
  Synthetic oligonucleotide
gccttcaccggccacttccataaagtacgtcattaga

SEQ ID NO: 203726 - DNA, 35 bp, Artificial Sequence
  Synthetic oligonucleotide
ctcgacggggtcttgactaccctacgatgaatccc

SEQ ID NO: 203727 - DNA, 35 bp, Artificial Sequence
  Synthetic oligonucleotide
agaaggccattccgttctttgtcttggattccgct

SEQ ID NO: 203728 - DNA, 35 bp, Artificial Sequence
  Synthetic oligonucleotide
tacttaattggggggggggattcttttttgtctct

SEQ ID NO: 203729 - DNA, 37 bp, Artificial Sequence
  Synthetic oligonucleotide
tcgcgccatagactcccacttcgtaaatagacggaca

SEQ ID NO: 203730 - DNA, 34 bp, Artificial Sequence
  Synthetic oligonucleotide
atcaaagccacattatttgacgcttgtgcggatt

SEQ ID NO: 203731 - DNA, 36 bp, Artificial Sequence
  Synthetic oligonucleotide
ggagcacacgcaaataccgatttgtctatttggtca

SEQ ID NO: 203732 - DNA, 38 bp, Artificial Sequence
  Synthetic oligonucleotide
gcacaccttggccccagtcaaagtgttcatctcgctca

SEQ ID NO: 203733 - DNA, 33 bp, Artificial Sequence
  Synthetic oligonucleotide
gttgtatcgatcccggctcatggccttatcatc

SEQ ID NO: 203734 - DNA, 36 bp, Artificial Sequence
  Synthetic oligonucleotide
gccagccctagctgagttctcgtaggcgatccacct

SEQ ID NO: 203735 - DNA, 35 bp, Artificial Sequence
  Synthetic oligonucleotide
tgagggcccaatcatgcgtgaggtgctctgccaac

SEQ ID NO: 203736 - DNA, 37 bp, Artificial Sequence
  Synthetic oligonucleotide
tccgtccttgaatcgctgcttttctttgacacgcaga

SEQ ID NO: 203737 - DNA, 36 bp, Artificial Sequence
  Synthetic oligonucleotide
tctgcgtacagaatgtaccccatttttatgccgaga

SEQ ID NO: 203738 - DNA, 36 bp, Artificial Sequence
  Synthetic oligonucleotide
tcgcttggtaggtccggctagaagggtccactagca

SEQ ID NO: 203739 - DNA, 37 bp, Artificial Sequence
  Synthetic oligonucleotide
ccatgcaactgtctataactaagagggtaacccgtgt

SEQ ID NO: 203740 - DNA, 38 bp, Artificial Sequence
  Synthetic oligonucleotide
gtccctcgagcactacacggattgtagtaccgttttca

SEQ ID NO: 203741 - DNA, 35 bp, Artificial Sequence
  Synthetic oligonucleotide
tcccgcttcgttacagcgcccggcgaattaaggcg

SEQ ID NO: 203742 - DNA, 36 bp, Artificial Sequence
  Synthetic oligonucleotide
gcagtatgcggaaaaaggtgcccccgtgtaaccagt

SEQ ID NO: 203743 - DNA, 34 bp, Artificial Sequence
  Synthetic oligonucleotide
cgccatgtccgacctcccccgccctccgccgtga

SEQ ID NO: 203744 - DNA, 36 bp, Artificial Sequence
  Synthetic oligonucleotide
cctgctcatccggatattgtgatcgttatattacca

SEQ ID NO: 203745 - DNA, 34 bp, Artificial Sequence
  Synthetic oligonucleotide
tcccatcgtcatgtgaactttggccaatgcctca

SEQ ID NO: 203746 - DNA, 35 bp, Artificial Sequence
  Synthetic oligonucleotide
ccacgggaggtagcttgattggtttctcgtccctt

SEQ ID NO: 203747 - DNA, 38 bp, Artificial Sequence
  Synthetic oligonucleotide
cttccgatccctagttcgcagtcacgcttttcatgtgg

SEQ ID NO: 203748 - DNA, 37 bp, Artificial Sequence
  Synthetic oligonucleotide
ttgcggtctgattggacctgaacctggggccgagtca

SEQ ID NO: 203749 - DNA, 35 bp, Artificial Sequence
  Synthetic oligonucleotide
tgcgacgctcatgcgccatctggctacctaacgag

SEQ ID NO: 203750 - DNA, 35 bp, Artificial Sequence
  Synthetic oligonucleotide
ctttctggtgttcacctcgcctcacactatagtgt

SEQ ID NO: 203751 - DNA, 38 bp, Artificial Sequence
  Synthetic oligonucleotide
aattcgtcacgcgttgtgtgtagccggtgcccaattga

SEQ ID NO: 203752 - DNA, 36 bp, Artificial Sequence
  Synthetic oligonucleotide
atccatatctggagtgaatctccatctacacccgca

SEQ ID NO: 203753 - DNA, 38 bp, Artificial Sequence
  Synthetic oligonucleotide
agggcctaaacggttatgtaggattaggtttgggttgt

SEQ ID NO: 203754 - DNA, 35 bp, Artificial Sequence
  Synthetic oligonucleotide
ctcatctacatcgaactctattttagtttagttgt

SEQ ID NO: 203755 - DNA, 35 bp, Artificial Sequence
  Synthetic oligonucleotide
tctgggtgcacaatccttgcatagttctagtgtag

SEQ ID NO: 203756 - DNA, 37 bp, Artificial Sequence
  Synthetic oligonucleotide
gacatctcttgggcgttgactggctcaccattttgca

SEQ ID NO: 203757 - DNA, 37 bp, Artificial Sequence
  Synthetic oligonucleotide
ccctactgtgacgctttgtatgtggtccgttctgtga

SEQ ID NO: 203758 - DNA, 36 bp, Artificial Sequence
  Synthetic oligonucleotide
cgcggccagttcaatcacctgatgtaatggctccca

SEQ ID NO: 203759 - DNA, 37 bp, Artificial Sequence
  Synthetic oligonucleotide
gtcccctcccattgctattttagttagccccgcagga

SEQ ID NO: 203760 - DNA, 35 bp, Artificial Sequence
  Synthetic oligonucleotide
agttcatagccaacatggcctgctgtggccggtag

SEQ ID NO: 203761 - DNA, 38 bp, Artificial Sequence
  Synthetic oligonucleotide
gaccttggttctggctcagtaacaggtatgcgctttgg

SEQ ID NO: 203762 - DNA, 35 bp, Artificial Sequence
  Synthetic oligonucleotide
cagtttcactagctattcacatcacatgccgccca

SEQ ID NO: 203763 - DNA, 37 bp, Artificial Sequence
  Synthetic oligonucleotide
agataggtgctttttaaccgcggtgttgttccctcca

SEQ ID NO: 203764 - DNA, 37 bp, Artificial Sequence
  Synthetic oligonucleotide
ttcgtcagaatctcccggtggtccgatctcgattggt

SEQ ID NO: 203765 - DNA, 35 bp, Artificial Sequence
  Synthetic oligonucleotide
gtggaatttctcttacgtgtgtttcactgaacgag

SEQ ID NO: 203766 - DNA, 38 bp, Artificial Sequence
  Synthetic oligonucleotide
aggggataacctgtcactcacatgacatacaatcctca

SEQ ID NO: 203767 - DNA, 37 bp, Artificial Sequence
  Synthetic oligonucleotide
gattactagcccgtgtctcccagcatctgagagcctg

SEQ ID NO: 203768 - DNA, 36 bp, Artificial Sequence
  Synthetic oligonucleotide
aatgcggaccatgtacgaagaggttccaccttacca

SEQ ID NO: 203769 - DNA, 35 bp, Artificial Sequence
  Synthetic oligonucleotide
ctgctcttcgtctttcgctaatcacgaggagggac

SEQ ID NO: 203770 - DNA, 35 bp, Artificial Sequence
  Synthetic oligonucleotide
agttgtgatgagcccgactgccgcaactccccccg

SEQ ID NO: 203771 - DNA, 38 bp, Artificial Sequence
  Synthetic oligonucleotide
tccattgaatacgcacccccaggtcgatttgatggtca

SEQ ID NO: 203772 - DNA, 37 bp, Artificial Sequence
  Synthetic oligonucleotide
tgcccggggcaccctgtagtgaggtcgagttcctgga

SEQ ID NO: 203773 - DNA, 35 bp, Artificial Sequence
  Synthetic oligonucleotide
accgtctaatcgcttgtgccttgttcgagcctaac

SEQ ID NO: 203774 - DNA, 36 bp, Artificial Sequence
  Synthetic oligonucleotide
tgagggcatcgtttgggctattatgtctctttgtca

SEQ ID NO: 203775 - DNA, 37 bp, Artificial Sequence
  Synthetic oligonucleotide
tcccttacatgggaggttcacacggtggacgggacca

SEQ ID NO: 203776 - DNA, 36 bp, Artificial Sequence
  Synthetic oligonucleotide
gtctgccaccgctctatgtcctcccgaagcgaagca

SEQ ID NO: 203777 - DNA, 36 bp, Artificial Sequence
  Synthetic oligonucleotide
gtgtgggtgtgtagcttctgccctttgtcgcatata

SEQ ID NO: 203778 - DNA, 36 bp, Artificial Sequence
  Synthetic oligonucleotide
cgcttcgctcccctattggcttacattgcggaaata

SEQ ID NO: 203779 - DNA, 35 bp, Artificial Sequence
  Synthetic oligonucleotide
caagccccccggatccatcttactacgaggcttcc

SEQ ID NO: 203780 - DNA, 36 bp, Artificial Sequence
  Synthetic oligonucleotide
cttccgtgcggatcgtgcctaaccgctctacataca

SEQ ID NO: 203781 - DNA, 35 bp, Artificial Sequence
  Synthetic oligonucleotide
acgcaaccgggtggtcttcgtagctcccactgtct

SEQ ID NO: 203782 - DNA, 36 bp, Artificial Sequence
  Synthetic oligonucleotide
atatcggcgtatacaccgagatacctaaacttgtca

SEQ ID NO: 203783 - DNA, 35 bp, Artificial Sequence
  Synthetic oligonucleotide
aatgcggttaacgaaccgtcatcacggcatatccc

SEQ ID NO: 203784 - DNA, 35 bp, Artificial Sequence
  Synthetic oligonucleotide
tgagcatgcctaggccgtctcgttctcgctaatct

SEQ ID NO: 203785 - DNA, 35 bp, Artificial Sequence
  Synthetic oligonucleotide
agcaagtagtgctcttactcgaacctggcccttct

SEQ ID NO: 203786 - DNA, 35 bp, Artificial Sequence
  Synthetic oligonucleotide
tcatgctgagtcgattcccatctctcgcttttcat

SEQ ID NO: 203787 - DNA, 35 bp, Artificial Sequence
  Synthetic oligonucleotide
ttaatgagctaaacgtaaagcaacttcctttacct

SEQ ID NO: 203788 - DNA, 35 bp, Artificial Sequence
  Synthetic oligonucleotide
acaccggccacacgcttcttcgacaagttcaatgg

SEQ ID NO: 203789 - DNA, 36 bp, Artificial Sequence
  Synthetic oligonucleotide
catgccgctggcgacccttttctgccgactctctga

SEQ ID NO: 203790 - DNA, 36 bp, Artificial Sequence
  Synthetic oligonucleotide
acccaaaagtagcatctccgcgcactagagcaggca

SEQ ID NO: 203791 - DNA, 38 bp, Artificial Sequence
  Synthetic oligonucleotide
gatcaagtcttcaacatgtgatcagcactacgacgtca

SEQ ID NO: 203792 - DNA, 35 bp, Artificial Sequence
  Synthetic oligonucleotide
gagagacctggcgtacacgaaaagatgccactgcc

SEQ ID NO: 203793 - DNA, 35 bp, Artificial Sequence
  Synthetic oligonucleotide
acccagtacgactggtagactgacacccgtgccca

SEQ ID NO: 203794 - DNA, 35 bp, Artificial Sequence
  Synthetic oligonucleotide
tcgtacgcattttgtactaatgtcttccttgatct

SEQ ID NO: 203795 - DNA, 37 bp, Artificial Sequence
  Synthetic oligonucleotide
gaggagaaagctcccgaatcctgctaatgaggccgga

SEQ ID NO: 203796 - DNA, 35 bp, Artificial Sequence
  Synthetic oligonucleotide
aagtctgcatatgtatttctttcgtatagtacacg

SEQ ID NO: 203797 - DNA, 37 bp, Artificial Sequence
  Synthetic oligonucleotide
gcatggagaattgctactcacgcgagtacccagctca

SEQ ID NO: 203798 - DNA, 35 bp, Artificial Sequence
  Synthetic oligonucleotide
tgtgatcacgtaagttttccgagtgattgagtgtt

SEQ ID NO: 203799 - DNA, 35 bp, Artificial Sequence
  Synthetic oligonucleotide
cccggcgagccacgggctgtacgagtaagtcacac

SEQ ID NO: 203800 - DNA, 37 bp, Artificial Sequence
  Synthetic oligonucleotide
catcattcgtttccgtagttccgcctgtttaccgtgg

SEQ ID NO: 203801 - DNA, 35 bp, Artificial Sequence
  Synthetic oligonucleotide
cgatcacttaacgttctggtctcagcccctctaat

SEQ ID NO: 203802 - DNA, 36 bp, Artificial Sequence
  Synthetic oligonucleotide
gccaacgggaatttcctcttttattctagtcttgtg

SEQ ID NO: 203803 - DNA, 37 bp, Artificial Sequence
  Synthetic oligonucleotide
gtaggtcccacaggtctgacagtctcctattttccgt

SEQ ID NO: 203804 - DNA, 37 bp, Artificial Sequence
  Synthetic oligonucleotide
gaccagtcgtgatgattctagccaccggacctttgca

SEQ ID NO: 203805 - DNA, 36 bp, Artificial Sequence
  Synthetic oligonucleotide
atcgttcccagatacgttgtggagttgaaatgatca

SEQ ID NO: 203806 - DNA, 37 bp, Artificial Sequence
  Synthetic oligonucleotide
gcggtatttgacgcgtagttattacataacatttcgt

SEQ ID NO: 203807 - DNA, 38 bp, Artificial Sequence
  Synthetic oligonucleotide
gctttccaatgttgggtggcaacaccgcccgcttttca

SEQ ID NO: 203808 - DNA, 35 bp, Artificial Sequence
  Synthetic oligonucleotide
ttgtgtccctggcctccctattcagattccccgca

SEQ ID NO: 203809 - DNA, 38 bp, Artificial Sequence
  Synthetic oligonucleotide
gcccgagcccgtttaaccgggcgtgtagtaagacttca

SEQ ID NO: 203810 - DNA, 36 bp, Artificial Sequence
  Synthetic oligonucleotide
gctcggagtgcgccctaattgcatccttccgagtca

SEQ ID NO: 203811 - DNA, 37 bp, Artificial Sequence
  Synthetic oligonucleotide
aacggattgatcacaattggtccggaacctagccggt

SEQ ID NO: 203812 - DNA, 37 bp, Artificial Sequence
  Synthetic oligonucleotide
atactggatgtagtctcctacccttcctctgacgagg

SEQ ID NO: 203813 - DNA, 36 bp, Artificial Sequence
  Synthetic oligonucleotide
ctcatatcggcctgttgagtattccataacaacgtg

SEQ ID NO: 203814 - DNA, 38 bp, Artificial Sequence
  Synthetic oligonucleotide
aattcgtcactcgttgtctgtagccggtgcccaattga

SEQ ID NO: 203815 - DNA, 36 bp, Artificial Sequence
  Synthetic oligonucleotide
cgcccttccgtactgcccgaactatgtaattctaca

SEQ ID NO: 203816 - DNA, 35 bp, Artificial Sequence
  Synthetic oligonucleotide
ttcgccatttaaattgcggccgttccgaaataatt

SEQ ID NO: 203817 - DNA, 29 bp, Artificial Sequence
  Synthetic oligonucleotide
acttggctacattgcgttgcggtctaccc

SEQ ID NO: 203818 - DNA, 37 bp, Artificial Sequence
  Synthetic oligonucleotide
tcgacatgcttagtattcataagcaataccaacatgg

SEQ ID NO: 203819 - DNA, 35 bp, Artificial Sequence
  Synthetic oligonucleotide
gccctggcaccaaagtcacacaatcaatcgtgtgc

SEQ ID NO: 203820 - DNA, 35 bp, Artificial Sequence
  Synthetic oligonucleotide
gtcgtgaaaatcggcatttggcccgtaacccagcc

SEQ ID NO: 203821 - DNA, 36 bp, Artificial Sequence
  Synthetic oligonucleotide
atccttaaggatctcctgatccactggaggcacaca

SEQ ID NO: 203822 - DNA, 35 bp, Artificial Sequence
  Synthetic oligonucleotide
gactggcgactggcacttggagaggctatactatt

SEQ ID NO: 203823 - DNA, 35 bp, Artificial Sequence
  Synthetic oligonucleotide
gagcaagccgacattccgaacgtgtacacggatct

SEQ ID NO: 203824 - DNA, 35 bp, Artificial Sequence
  Synthetic oligonucleotide
tgctttagtcacgtactgaagccaacagtttaaag

SEQ ID NO: 203825 - DNA, 37 bp, Artificial Sequence
  Synthetic oligonucleotide
tgcctaccagtccccgctatgtacatgcatgcgcggt

SEQ ID NO: 203826 - DNA, 37 bp, Artificial Sequence
  Synthetic oligonucleotide
acatcccgaaagacccggtcaacttgagcgtaattca

SEQ ID NO: 203827 - DNA, 36 bp, Artificial Sequence
  Synthetic oligonucleotide
cactctttaataaagcagttttgcccggaatgacat

SEQ ID NO: 203828 - DNA, 38 bp, Artificial Sequence
  Synthetic oligonucleotide
tcccgaggagggttaagccttcgcaagacagcacatgt

SEQ ID NO: 203829 - DNA, 36 bp, Artificial Sequence
  Synthetic oligonucleotide
gcttgggctcgccagccgacccctcgttgtacaggt

SEQ ID NO: 203830 - DNA, 36 bp, Artificial Sequence
  Synthetic oligonucleotide
tcatttgtggaaacttacgtagtaacatttatacaa

SEQ ID NO: 203831 - DNA, 35 bp, Artificial Sequence
  Synthetic oligonucleotide
cccggcgagccacgggctctacgagcaagtcacac

SEQ ID NO: 203832 - DNA, 36 bp, Artificial Sequence
  Synthetic oligonucleotide
tcccttgccccaccgtacttccttggcggtgtgact

SEQ ID NO: 203833 - DNA, 38 bp, Artificial Sequence
  Synthetic oligonucleotide
cgactccgtatagtctttttgtatgctctgcacgctca

SEQ ID NO: 203834 - DNA, 38 bp, Artificial Sequence
  Synthetic oligonucleotide
ttcgcgagcagtctctacccattgaacgctcgagttca

SEQ ID NO: 203835 - DNA, 35 bp, Artificial Sequence
  Synthetic oligonucleotide
tgacactggcggttctgtaactactggagtgtaca

SEQ ID NO: 203836 - DNA, 25 bp, Artificial Sequence
  Synthetic oligonucleotide
ctgtcaagtcaactgcgtttcgtcg

SEQ ID NO: 203837 - DNA, 35 bp, Artificial Sequence
  Synthetic oligonucleotide
cggtctctgccactcatctatctagtacccgccat

SEQ ID NO: 203838 - DNA, 37 bp, Artificial Sequence
  Synthetic oligonucleotide
tgtccacgcgtgacccgggtgcctcatattctaaaca

SEQ ID NO: 203839 - DNA, 35 bp, Artificial Sequence
  Synthetic oligonucleotide
cccggcgagccacgggcggtacgagcaagtcacac

SEQ ID NO: 203840 - DNA, 35 bp, Artificial Sequence
  Synthetic oligonucleotide
gtggtcacgtaatgttgagccatatgcctctcact

SEQ ID NO: 203841 - DNA, 35 bp, Artificial Sequence
  Synthetic oligonucleotide
atgcgacaagttcacggctaacggcgttttttaag

SEQ ID NO: 203842 - DNA, 37 bp, Artificial Sequence
  Synthetic oligonucleotide
gcctccccgggccccccatagtgtctactgtctatga

SEQ ID NO: 203843 - DNA, 36 bp, Artificial Sequence
  Synthetic oligonucleotide
tactttaacgcgctccagttccgtaatgagacgtca

SEQ ID NO: 203844 - DNA, 37 bp, Artificial Sequence
  Synthetic oligonucleotide
gtctggtgtgaatccactgggtatttggttcgctcgt

SEQ ID NO: 203845 - DNA, 37 bp, Artificial Sequence
  Synthetic oligonucleotide
ctccatcggcgccggctgtacttcgattaacgcgtca

SEQ ID NO: 203846 - DNA, 37 bp, Artificial Sequence
  Synthetic oligonucleotide
tgcccgccttcgggtgagtcccgcgggtcctcgccca

SEQ ID NO: 203847 - DNA, 36 bp, Artificial Sequence
  Synthetic oligonucleotide
ggacgtaccgatcgctctctgtccctggttctcaca

SEQ ID NO: 203848 - DNA, 31 bp, Artificial Sequence
  Synthetic oligonucleotide
tcatactcggtaacgagctcatttcacttgt

SEQ ID NO: 203849 - DNA, 35 bp, Artificial Sequence
  Synthetic oligonucleotide
tcccctcctacctctgaccattgtagggacagaaa

SEQ ID NO: 203850 - DNA, 35 bp, Artificial Sequence
  Synthetic oligonucleotide
agtggataaaccgccggaagatgctaacctcgtca

SEQ ID NO: 203851 - DNA, 35 bp, Artificial Sequence
  Synthetic oligonucleotide
ctacagcccctcagtaccgctagtggttcccggct

SEQ ID NO: 203852 - DNA, 36 bp, Artificial Sequence
  Synthetic oligonucleotide
tgtgtctggttcacgttaactcgtatcacctcttca

SEQ ID NO: 203853 - DNA, 35 bp, Artificial Sequence
  Synthetic oligonucleotide
ttactgtcttaaagccggcgttttaatgaatttag

SEQ ID NO: 203854 - DNA, 37 bp, Artificial Sequence
  Synthetic oligonucleotide
tccgcaagtctacggctcatcatagatactacattgt

SEQ ID NO: 203855 - DNA, 37 bp, Artificial Sequence
  Synthetic oligonucleotide
gtaccgggcgaggtgtacttgcgcgccccgagtccgt

SEQ ID NO: 203856 - DNA, 34 bp, Artificial Sequence
  Synthetic oligonucleotide
tcatcctactaacttggtatcctaacagtgtggt

SEQ ID NO: 203857 - DNA, 35 bp, Artificial Sequence
  Synthetic oligonucleotide
aactcagccgagtgtttcttttactcagtcttcag

SEQ ID NO: 203858 - DNA, 36 bp, Artificial Sequence
  Synthetic oligonucleotide
aatcgtagtgggccctcgcgacgtcaggccttagca

SEQ ID NO: 203859 - DNA, 36 bp, Artificial Sequence
  Synthetic oligonucleotide
aatgtcacccacatgtgcgcagtcttgacttaagaa

SEQ ID NO: 203860 - DNA, 35 bp, Artificial Sequence
  Synthetic oligonucleotide
cgttgctgttccactcactttcttctcacgacatg

SEQ ID NO: 203861 - DNA, 38 bp, Artificial Sequence
  Synthetic oligonucleotide
gcctcctaatgataggtttcccgtggacccgccgatga

SEQ ID NO: 203862 - DNA, 35 bp, Artificial Sequence
  Synthetic oligonucleotide
cgggaatacatcctattagtcccgatccttccgcc

SEQ ID NO: 203863 - DNA, 37 bp, Artificial Sequence
  Synthetic oligonucleotide
tgccaccaagtgaggtaacctctaggaatcttatgca

SEQ ID NO: 203864 - DNA, 37 bp, Artificial Sequence
  Synthetic oligonucleotide
ctatcatgaaggttcaccccactttgtcgtgcctggg

SEQ ID NO: 203865 - DNA, 37 bp, Artificial Sequence
  Synthetic oligonucleotide
tttagtcattacttcaagatttgtccgatcctcggca

SEQ ID NO: 203866 - DNA, 35 bp, Artificial Sequence
  Synthetic oligonucleotide
cctttcccactcgcccatccgtccagataatcata

SEQ ID NO: 203867 - DNA, 35 bp, Artificial Sequence
  Synthetic oligonucleotide
aggagtggtgctgcggccgagctctatgtctacca

SEQ ID NO: 203868 - DNA, 35 bp, Artificial Sequence
  Synthetic oligonucleotide
atactgcaggaaccattcctcggtttccatcacct

SEQ ID NO: 203869 - DNA, 35 bp, Artificial Sequence
  Synthetic oligonucleotide
gctagtcaatttaaacacttcattgcataacatag

SEQ ID NO: 203870 - DNA, 35 bp, Artificial Sequence
  Synthetic oligonucleotide
ttatcatttccattcttcagtctgatgccccaccg

SEQ ID NO: 203871 - DNA, 35 bp, Artificial Sequence
  Synthetic oligonucleotide
ccagtgggcgcacggcgtacctcgtggagtttagt

SEQ ID NO: 203872 - DNA, 37 bp, Artificial Sequence
  Synthetic oligonucleotide
ccgaaaagcctggaaggtgtaagtccctgctcttagt

SEQ ID NO: 203873 - DNA, 35 bp, Artificial Sequence
  Synthetic oligonucleotide
gctctccgtgatcatccacctccaaagctctcaag

SEQ ID NO: 203874 - DNA, 35 bp, Artificial Sequence
  Synthetic oligonucleotide
actctgtatacccagtgtgggctggttttcgccct

SEQ ID NO: 203875 - DNA, 35 bp, Artificial Sequence
  Synthetic oligonucleotide
cccggcgagccacgggctgtacgaggaagtcacac

SEQ ID NO: 203876 - DNA, 35 bp, Artificial Sequence
  Synthetic oligonucleotide
gcgtggagcaatgcgaggacatgtcttggtcatcc

SEQ ID NO: 203877 - DNA, 26 bp, Artificial Sequence
  Synthetic oligonucleotide
tccacctgtaagctgtttcgttaaat

SEQ ID NO: 203878 - DNA, 35 bp, Artificial Sequence
  Synthetic oligonucleotide
atgccctgctgcttattgctttatgagctagggac

SEQ ID NO: 203879 - DNA, 35 bp, Artificial Sequence
  Synthetic oligonucleotide
tggttcttaagttagggccttttacactgtgcctt

SEQ ID NO: 203880 - DNA, 34 bp, Artificial Sequence
  Synthetic oligonucleotide
ccgcaaaccgtacttagaccgctgtccgcctgcc

SEQ ID NO: 203881 - DNA, 35 bp, Artificial Sequence
  Synthetic oligonucleotide
gcctttcatccaattaccacagtatccgcttccca

SEQ ID NO: 203882 - DNA, 35 bp, Artificial Sequence
  Synthetic oligonucleotide
ggcgccgaaggcgatatattcactggcatccataa

SEQ ID NO: 203883 - DNA, 37 bp, Artificial Sequence
  Synthetic oligonucleotide
catgcgctcagaatgagaggccatgtgcttgccgcca

SEQ ID NO: 203884 - DNA, 36 bp, Artificial Sequence
  Synthetic oligonucleotide
gcatgtcatgatttcactgtcttttcgcgtgcccgt

SEQ ID NO: 203885 - DNA, 35 bp, Artificial Sequence
  Synthetic oligonucleotide
gctatcctcgcgcaccatggttcggtgcagaatct

SEQ ID NO: 203886 - DNA, 36 bp, Artificial Sequence
  Synthetic oligonucleotide
tagttgcatgttaaacggactgagttatgcgtctca

SEQ ID NO: 203887 - DNA, 37 bp, Artificial Sequence
  Synthetic oligonucleotide
ggcccaggacgcccgtttacccgcatagaacctctca

SEQ ID NO: 203888 - DNA, 36 bp, Artificial Sequence
  Synthetic oligonucleotide
cttagccagagagtgatgcgcccttattaaagttca

SEQ ID NO: 203889 - DNA, 37 bp, Artificial Sequence
  Synthetic oligonucleotide
ttggagcttaacgaactgttcactggttcagttttgt

SEQ ID NO: 203890 - DNA, 35 bp, Artificial Sequence
  Synthetic oligonucleotide
cccggcgagccacgggctgtaccagcaagtcacac

SEQ ID NO: 203891 - DNA, 35 bp, Artificial Sequence
  Synthetic oligonucleotide
gccaaaccctcagtgcgcgtatactcggtggctaa

SEQ ID NO: 203892 - DNA, 35 bp, Artificial Sequence
  Synthetic oligonucleotide
cgctcccttctgtttagttggttcgcttttaatat

SEQ ID NO: 203893 - DNA, 35 bp, Artificial Sequence
  Synthetic oligonucleotide
atacctatcctagaggtagaagtttttcggtcaac

SEQ ID NO: 203894 - DNA, 35 bp, Artificial Sequence
  Synthetic oligonucleotide
gccctggcaccaaattcgcacaatcaatcgtgtgc

SEQ ID NO: 203895 - DNA, 35 bp, Artificial Sequence
  Synthetic oligonucleotide
cgctccaactctccccaaacgggcgacgaccgaaa

SEQ ID NO: 203896 - DNA, 35 bp, Artificial Sequence
  Synthetic oligonucleotide
ctattcctaacagagcgtaattaatcaatctttct

SEQ ID NO: 203897 - DNA, 38 bp, Artificial Sequence
  Synthetic oligonucleotide
ctcgacccgtgaaatgttcgtgtcttctcgctctctca

SEQ ID NO: 203898 - DNA, 36 bp, Artificial Sequence
  Synthetic oligonucleotide
aacgtagtagaaatcacgtcgttactgttcggaact

SEQ ID NO: 203899 - DNA, 35 bp, Artificial Sequence
  Synthetic oligonucleotide
ccgcctttgtaacgttagattatggtgcggacact

SEQ ID NO: 203900 - DNA, 35 bp, Artificial Sequence
  Synthetic oligonucleotide
gtcatctcgtctccccataagatgcaaccatgtct

SEQ ID NO: 203901 - DNA, 36 bp, Artificial Sequence
  Synthetic oligonucleotide
tacgacctgtgattaaagcgttcaacaccactactt

SEQ ID NO: 203902 - DNA, 38 bp, Artificial Sequence
  Synthetic oligonucleotide
gactgagtctcgcgttatcttaaacgtttcccgtgtgt

SEQ ID NO: 203903 - DNA, 38 bp, Artificial Sequence
  Synthetic oligonucleotide
ataattacgttgttgttaggtcaagactaaacactggg

SEQ ID NO: 203904 - DNA, 35 bp, Artificial Sequence
  Synthetic oligonucleotide
gccttggtacattgtgcatagaacctactcatgtg

SEQ ID NO: 203905 - DNA, 37 bp, Artificial Sequence
  Synthetic oligonucleotide
ttgctgattttcttcggtcccgtgctagctatctaca

SEQ ID NO: 203906 - DNA, 26 bp, Artificial Sequence
  Synthetic oligonucleotide
tacattggtctccgttcgaagttcga

SEQ ID NO: 203907 - DNA, 35 bp, Artificial Sequence
  Synthetic oligonucleotide
atgataaaacaacctggcgtataactgtcattatt

SEQ ID NO: 203908 - DNA, 36 bp, Artificial Sequence
  Synthetic oligonucleotide
gctcgctcaacctcggtggtatcaaattcggttcca

SEQ ID NO: 203909 - DNA, 37 bp, Artificial Sequence
  Synthetic oligonucleotide
caatagctagtgctagccctcagttgtacttacccga

SEQ ID NO: 203910 - DNA, 36 bp, Artificial Sequence
  Synthetic oligonucleotide
aaagatcctctttttgtattttattacacccatgag

SEQ ID NO: 203911 - DNA, 35 bp, Artificial Sequence
  Synthetic oligonucleotide
ttgaacagaccgcgatctccaaggtctacgcgccc

SEQ ID NO: 203912 - DNA, 37 bp, Artificial Sequence
  Synthetic oligonucleotide
tacgcgctcgagacaaatacgaccagtgatggcatgt

SEQ ID NO: 203913 - DNA, 35 bp, Artificial Sequence
  Synthetic oligonucleotide
cacgcttactgacttgttccaggcacctctctgct

SEQ ID NO: 203914 - DNA, 38 bp, Artificial Sequence
  Synthetic oligonucleotide
gctgttcttcccgtgcactcggtaataagacctcgtca

SEQ ID NO: 203915 - DNA, 35 bp, Artificial Sequence
  Synthetic oligonucleotide
ttgaccctttaccatgggcacatgtgaacagggct

SEQ ID NO: 203916 - DNA, 36 bp, Artificial Sequence
  Synthetic oligonucleotide
ggggagtgcggcactatgacagtcaagctacctcct

SEQ ID NO: 203917 - DNA, 37 bp, Artificial Sequence
  Synthetic oligonucleotide
ctgctttacatgcctagtaatagttttgcatatgtgt

SEQ ID NO: 203918 - DNA, 38 bp, Artificial Sequence
  Synthetic oligonucleotide
tgacttgtctgctcattagccgatgtaatttgctttga

SEQ ID NO: 203919 - DNA, 37 bp, Artificial Sequence
  Synthetic oligonucleotide
gcgtcgcttccatattcactatcggaaaggtacccga

SEQ ID NO: 203920 - DNA, 37 bp, Artificial Sequence
  Synthetic oligonucleotide
tggctgtggggttctcattcattaaattatgtggcgt

SEQ ID NO: 203921 - DNA, 38 bp, Artificial Sequence
  Synthetic oligonucleotide
acgataagttgtacgcgaatgttcaggccaattgttca

SEQ ID NO: 203922 - DNA, 35 bp, Artificial Sequence
  Synthetic oligonucleotide
tacggtggattgccatagtgtcgtaaaacggtggt

SEQ ID NO: 203923 - DNA, 36 bp, Artificial Sequence
  Synthetic oligonucleotide
gggtccctaccttttggtgttccgctggttcgccga

SEQ ID NO: 203924 - DNA, 38 bp, Artificial Sequence
  Synthetic oligonucleotide
gaaattccctgcacgtgatacttacaacgaacgtttca

SEQ ID NO: 203925 - DNA, 35 bp, Artificial Sequence
  Synthetic oligonucleotide
atcattgggaagtcctttaactcacgtcccgacgc

SEQ ID NO: 203926 - DNA, 37 bp, Artificial Sequence
  Synthetic oligonucleotide
gccctcgcgccattttttgtctcctcatgaattcgca

SEQ ID NO: 203927 - DNA, 36 bp, Artificial Sequence
  Synthetic oligonucleotide
taaagacccatgctcgcttttagatatcccacagaa

SEQ ID NO: 203928 - DNA, 37 bp, Artificial Sequence
  Synthetic oligonucleotide
gacggcgcccgtcttctctcatgccggaaatcatgca

SEQ ID NO: 203929 - DNA, 36 bp, Artificial Sequence
  Synthetic oligonucleotide
ttgcattcacgaacgtttgacaggggttggtcttct

SEQ ID NO: 203930 - DNA, 35 bp, Artificial Sequence
  Synthetic oligonucleotide
tcgatcgtgcgtattctaacgcttgcccgtaggct

SEQ ID NO: 203931 - DNA, 35 bp, Artificial Sequence
  Synthetic oligonucleotide
ttagccacccactgattcgttgacgacctgtggct

SEQ ID NO: 203932 - DNA, 35 bp, Artificial Sequence
  Synthetic oligonucleotide
gcacatctaacgtctagtgcgcatgactcagttcg

SEQ ID NO: 203933 - DNA, 37 bp, Artificial Sequence
  Synthetic oligonucleotide
ccatgcttgctagtatcgttttctataagcccgccca

SEQ ID NO: 203934 - DNA, 35 bp, Artificial Sequence
  Synthetic oligonucleotide
gcatccgtgttacaaccacgtcctccgccaactcc

SEQ ID NO: 203935 - DNA, 36 bp, Artificial Sequence
  Synthetic oligonucleotide
tactaccatcgtattcgtctattgattgcgctgaaa

SEQ ID NO: 203936 - DNA, 35 bp, Artificial Sequence
  Synthetic oligonucleotide
gatctgcatccacacgtggtctcttggttggtaag

SEQ ID NO: 203937 - DNA, 36 bp, Artificial Sequence
  Synthetic oligonucleotide
gccggtcaattgtttctggtgaggtttagggacgat

SEQ ID NO: 203938 - DNA, 35 bp, Artificial Sequence
  Synthetic oligonucleotide
agccaggtctcctctacacctatacacctttctgt

SEQ ID NO: 203939 - DNA, 34 bp, Artificial Sequence
  Synthetic oligonucleotide
gcgtcttgagaatgcatgcatcacacttactgtt

SEQ ID NO: 203940 - DNA, 35 bp, Artificial Sequence
  Synthetic oligonucleotide
acagggtcctgggccagtacccttaaggtaattaa

SEQ ID NO: 203941 - DNA, 35 bp, Artificial Sequence
  Synthetic oligonucleotide
acgtccccattattaagtgctgactgtgtgcggtg

SEQ ID NO: 203942 - DNA, 35 bp, Artificial Sequence
  Synthetic oligonucleotide
tgtctgggttccagcaacggctccactatctcaca

SEQ ID NO: 203943 - DNA, 37 bp, Artificial Sequence
  Synthetic oligonucleotide
ttcccggtggtccattatttcgtggagtgttctctgt

SEQ ID NO: 203944 - DNA, 36 bp, Artificial Sequence
  Synthetic oligonucleotide
aattagctacggcctcttatttcccagtgctgcgtt

SEQ ID NO: 203945 - DNA, 36 bp, Artificial Sequence
  Synthetic oligonucleotide
cgtgtgttgactcgtagcatgcgatggtatgttgca

SEQ ID NO: 203946 - DNA, 36 bp, Artificial Sequence
  Synthetic oligonucleotide
ttgcttgcccggccataagcacgatcttgttctcta

SEQ ID NO: 203947 - DNA, 35 bp, Artificial Sequence
  Synthetic oligonucleotide
ctctttagtactaagatacttaaagcggggggagt

SEQ ID NO: 203948 - DNA, 37 bp, Artificial Sequence
  Synthetic oligonucleotide
tcctcgcttatcaagcatgacccaacacctactaaga

SEQ ID NO: 203949 - DNA, 35 bp, Artificial Sequence
  Synthetic oligonucleotide
ccagctgaatgttcagccatggaacaaaagatagt

SEQ ID NO: 203950 - DNA, 38 bp, Artificial Sequence
  Synthetic oligonucleotide
gtgtaccgatctattctggtctggcttggaaccgttca

SEQ ID NO: 203951 - DNA, 37 bp, Artificial Sequence
  Synthetic oligonucleotide
gttcattgactgtgtatagagcgttcgtaagcgctca

SEQ ID NO: 203952 - DNA, 35 bp, Artificial Sequence
  Synthetic oligonucleotide
tccccggtaccgcatttgggttttgcttttcgaag

SEQ ID NO: 203953 - DNA, 35 bp, Artificial Sequence
  Synthetic oligonucleotide
tcggtgctggatgcactcataatgtcactatcacc

SEQ ID NO: 203954 - DNA, 37 bp, Artificial Sequence
  Synthetic oligonucleotide
tgagcttccattgcgagcgtgtgagacgtacacctgt

SEQ ID NO: 203955 - DNA, 35 bp, Artificial Sequence
  Synthetic oligonucleotide
ttcactccacttttgttcatccgcgacttaccccg

SEQ ID NO: 203956 - DNA, 35 bp, Artificial Sequence
  Synthetic oligonucleotide
gctaatactgaatgaaggagggcctctttttgttc

SEQ ID NO: 203957 - DNA, 35 bp, Artificial Sequence
  Synthetic oligonucleotide
tgcgttcggactcagttgcccacttattttaccgc

SEQ ID NO: 203958 - DNA, 35 bp, Artificial Sequence
  Synthetic oligonucleotide
accgggtcgccggctatccagttcctttaggccag

SEQ ID NO: 203959 - DNA, 35 bp, Artificial Sequence
  Synthetic oligonucleotide
atagcacagttgcggatggcaaaacggatcaccag

SEQ ID NO: 203960 - DNA, 36 bp, Artificial Sequence
  Synthetic oligonucleotide
aggcccaggttatgaggtcatcatcttctctcagag

SEQ ID NO: 203961 - DNA, 38 bp, Artificial Sequence
  Synthetic oligonucleotide
aattcgtcactcgttgtgtgtagccggtgcccaattct

SEQ ID NO: 203962 - DNA, 35 bp, Artificial Sequence
  Synthetic oligonucleotide
atgcgggggcatcttacgtccagtcttagttttcg

SEQ ID NO: 203963 - DNA, 35 bp, Artificial Sequence
  Synthetic oligonucleotide
gccctggcaccaaagtcgcacaatcgatcgtgtgc

SEQ ID NO: 203964 - DNA, 35 bp, Artificial Sequence
  Synthetic oligonucleotide
taataccgcattaagctaactgtacgctcgtaacc

SEQ ID NO: 203965 - DNA, 36 bp, Artificial Sequence
  Synthetic oligonucleotide
aaggctttgtccaccgaagacgatttgacctcagca

SEQ ID NO: 203966 - DNA, 37 bp, Artificial Sequence
  Synthetic oligonucleotide
tgtcggactgtaatgatcgacctatcgatcatttaca

SEQ ID NO: 203967 - DNA, 35 bp, Artificial Sequence
  Synthetic oligonucleotide
tccctcgggcgactacctccaaaatgagagctagt

SEQ ID NO: 203968 - DNA, 38 bp, Artificial Sequence
  Synthetic oligonucleotide
tggtccataaagcgcttgggcaaggagtccggtgatca

SEQ ID NO: 203969 - DNA, 36 bp, Artificial Sequence
  Synthetic oligonucleotide
gcatgtcatgatttcactgtcttttcgcgtgcccca

SEQ ID NO: 203970 - DNA, 36 bp, Artificial Sequence
  Synthetic oligonucleotide
ctcctttataaaaaggacgctaggtagtctgttcca

SEQ ID NO: 203971 - DNA, 38 bp, Artificial Sequence
  Synthetic oligonucleotide
ccgtcccccgcgcctactagccacgctttggctactga

SEQ ID NO: 203972 - DNA, 35 bp, Artificial Sequence
  Synthetic oligonucleotide
ttcatactttgttgtagggcacgcaagtcatattt

SEQ ID NO: 203973 - DNA, 35 bp, Artificial Sequence
  Synthetic oligonucleotide
cctcgctttcgttttttctggatgccttaccggac

SEQ ID NO: 203974 - DNA, 35 bp, Artificial Sequence
  Synthetic oligonucleotide
tattcgcgttcatgaaggttcccacgtcctatgtt

SEQ ID NO: 203975 - DNA, 35 bp, Artificial Sequence
  Synthetic oligonucleotide
acaccccttccctatattttgttccacagggggtg

SEQ ID NO: 203976 - DNA, 37 bp, Artificial Sequence
  Synthetic oligonucleotide
acaggttgtaggcataaagccttccattccttgttca

SEQ ID NO: 203977 - DNA, 37 bp, Artificial Sequence
  Synthetic oligonucleotide
tcaccttagaagtctttccctgtgtgaccaatgatca

SEQ ID NO: 203978 - DNA, 35 bp, Artificial Sequence
  Synthetic oligonucleotide
attgccagggatgagggtaattcttgacgtgcgct

SEQ ID NO: 203979 - DNA, 35 bp, Artificial Sequence
  Synthetic oligonucleotide
tgctggggtacgcactatctaccagagtgctaaca

SEQ ID NO: 203980 - DNA, 35 bp, Artificial Sequence
  Synthetic oligonucleotide
ttggcgtacgaacgtcattttcttgattattttcg

SEQ ID NO: 203981 - DNA, 35 bp, Artificial Sequence
  Synthetic oligonucleotide
gttgtctgaaatgaatggacgatctgcggtcaatt

SEQ ID NO: 203982 - DNA, 38 bp, Artificial Sequence
  Synthetic oligonucleotide
attgcagtctggtgtgttttcccgctgtctgcccgtgt

SEQ ID NO: 203983 - DNA, 30 bp, Artificial Sequence
  Synthetic oligonucleotide
gagtcgacgtctctttaatagagaggctgt

SEQ ID NO: 203984 - DNA, 35 bp, Artificial Sequence
  Synthetic oligonucleotide
gcacctcacagcatatacgttgtatttttggtact

SEQ ID NO: 203985 - DNA, 34 bp, Artificial Sequence
  Synthetic oligonucleotide
ctacagctatcagcagtgatcttcatacccggcc

SEQ ID NO: 203986 - DNA, 36 bp, Artificial Sequence
  Synthetic oligonucleotide
gttacgctcggcacccggcttcaccttggcctggca

SEQ ID NO: 203987 - DNA, 31 bp, Artificial Sequence
  Synthetic oligonucleotide
gcagtctagatcatgccccgttgaccaatga

SEQ ID NO: 203988 - DNA, 35 bp, Artificial Sequence
  Synthetic oligonucleotide
gcatgcgcgctcttgaatcccgtatccactcagat

SEQ ID NO: 203989 - DNA, 35 bp, Artificial Sequence
  Synthetic oligonucleotide
gagtaagatcagttcagttattctagcttatcact

SEQ ID NO: 203990 - DNA, 35 bp, Artificial Sequence
  Synthetic oligonucleotide
gatttgggtccttcgttatgtggccaggaatctcg

SEQ ID NO: 203991 - DNA, 38 bp, Artificial Sequence
  Synthetic oligonucleotide
tccggagtaacccactttgccatgatctgcctaagtgg

SEQ ID NO: 203992 - DNA, 37 bp, Artificial Sequence
  Synthetic oligonucleotide
actccgcttttgccaacgctaggccagattacttagt

SEQ ID NO: 203993 - DNA, 35 bp, Artificial Sequence
  Synthetic oligonucleotide
ttaacgcttaaaggatccgaatgcatctttactct

SEQ ID NO: 203994 - DNA, 35 bp, Artificial Sequence
  Synthetic oligonucleotide
tcgttagaatctggttttggttataggccgagaat

SEQ ID NO: 203995 - DNA, 36 bp, Artificial Sequence
  Synthetic oligonucleotide
tatgacacgcccttacccgcatataccctgtacaca

SEQ ID NO: 203996 - DNA, 32 bp, Artificial Sequence
  Synthetic oligonucleotide
ggtacttattaccacgtatgtctccctcaaac

SEQ ID NO: 203997 - DNA, 35 bp, Artificial Sequence
  Synthetic oligonucleotide
tgcaactataaccttaagccataacgtgcgcccct

SEQ ID NO: 203998 - DNA, 35 bp, Artificial Sequence
  Synthetic oligonucleotide
gattacgtactaagttcgatgatcgttttagaagt

SEQ ID NO: 203999 - DNA, 35 bp, Artificial Sequence
  Synthetic oligonucleotide
attgcggctatattatcaagccctcggtgagctct

SEQ ID NO: 204000 - DNA, 36 bp, Artificial Sequence
  Synthetic oligonucleotide
tagcggtctcatcgaccgatttttggccccaccgca

SEQ ID NO: 204001 - DNA, 36 bp, Artificial Sequence
  Synthetic oligonucleotide
tgccgagtcctgattccctaggtgccaaccggttaa

SEQ ID NO: 204002 - DNA, 36 bp, Artificial Sequence
  Synthetic oligonucleotide
gtcgtcgagaatagcgtgtcacgtctgacccttcct

SEQ ID NO: 204003 - DNA, 36 bp, Artificial Sequence
  Synthetic oligonucleotide
atcacatcgatatgcaccgtattccggtttacagca

SEQ ID NO: 204004 - DNA, 36 bp, Artificial Sequence
  Synthetic oligonucleotide
gacaccgaatctcccgctcgtccgactataagacca

SEQ ID NO: 204005 - DNA, 35 bp, Artificial Sequence
  Synthetic oligonucleotide
gcttctacgaccgtacctccccggaaaggccaggc

SEQ ID NO: 204006 - DNA, 36 bp, Artificial Sequence
  Synthetic oligonucleotide
cgaaaacctttaccctgttcgtgtcatttcgatgca

SEQ ID NO: 204007 - DNA, 35 bp, Artificial Sequence
  Synthetic oligonucleotide
cgattaatggctgtaccatcctgttcgctcccgag

SEQ ID NO: 204008 - DNA, 38 bp, Artificial Sequence
  Synthetic oligonucleotide
atgggactgtaagtcttggcttcgttttacattcgtgt

SEQ ID NO: 204009 - DNA, 36 bp, Artificial Sequence
  Synthetic oligonucleotide
catatccatatcacctacctttcgctcaaccggcca

SEQ ID NO: 204010 - DNA, 36 bp, Artificial Sequence
  Synthetic oligonucleotide
ttggatcatctgtcttcgaccattcattgatcatca

SEQ ID NO: 204011 - DNA, 35 bp, Artificial Sequence
  Synthetic oligonucleotide
ggtccacggtaggccaacacaggcttacaggttaa

SEQ ID NO: 204012 - DNA, 36 bp, Artificial Sequence
  Synthetic oligonucleotide
tcttataaagtctataggtattggcactactttctt

SEQ ID NO: 204013 - DNA, 36 bp, Artificial Sequence
  Synthetic oligonucleotide
acagatctcatgcgggcagatactgctcacgattca

SEQ ID NO: 204014 - DNA, 38 bp, Artificial Sequence
  Synthetic oligonucleotide
atcgtcgccatgatatactatccgttacacagccgtgt

SEQ ID NO: 204015 - DNA, 35 bp, Artificial Sequence
  Synthetic oligonucleotide
tgcgaattgcaagtctatcgtagctgcacttcctt

SEQ ID NO: 204016 - DNA, 36 bp, Artificial Sequence
  Synthetic oligonucleotide
tgaggctacatgtggaaaacgttatgcctttcctaa

SEQ ID NO: 204017 - DNA, 36 bp, Artificial Sequence
  Synthetic oligonucleotide
agcgtacacgcaacgtacgtctcctccccaaatgtt

SEQ ID NO: 204018 - DNA, 37 bp, Artificial Sequence
  Synthetic oligonucleotide
tatggcgggctattagtatctgctataacgccttggt

SEQ ID NO: 204019 - DNA, 38 bp, Artificial Sequence
  Synthetic oligonucleotide
gagacctggaacacacagcgactagttgattgaattca

SEQ ID NO: 204020 - DNA, 37 bp, Artificial Sequence
  Synthetic oligonucleotide
ggtaaacttgcttgcgcgttgtttgaccccaaataga

SEQ ID NO: 204021 - DNA, 33 bp, Artificial Sequence
  Synthetic oligonucleotide
cccctcaaatggatgttttgatctcaccggcga

SEQ ID NO: 204022 - DNA, 37 bp, Artificial Sequence
  Synthetic oligonucleotide
agttattgacaccaagccctgattaatctccgctaga

SEQ ID NO: 204023 - DNA, 36 bp, Artificial Sequence
  Synthetic oligonucleotide
ccctgctcaggcttcacccgtacatctcctagcctt

SEQ ID NO: 204024 - DNA, 38 bp, Artificial Sequence
  Synthetic oligonucleotide
tgggcatactcatgacaatgcccactgggagtagttca

SEQ ID NO: 204025 - DNA, 36 bp, Artificial Sequence
  Synthetic oligonucleotide
ccctttcagccgtgtccgtgctaaacctgtatgtca

SEQ ID NO: 204026 - DNA, 36 bp, Artificial Sequence
  Synthetic oligonucleotide
cgagtgcacggatccatgctgatgggctctgatgat

SEQ ID NO: 204027 - DNA, 36 bp, Artificial Sequence
  Synthetic oligonucleotide
ggcaccccaatgcttcctctctaaatcattcagtgt

SEQ ID NO: 204028 - DNA, 36 bp, Artificial Sequence
  Synthetic oligonucleotide
accgctccctgcgaatgaagcggtggcttcctcgca

SEQ ID NO: 204029 - DNA, 35 bp, Artificial Sequence
  Synthetic oligonucleotide
gagagacctggcgtacacgaaaagatgccactgtt

SEQ ID NO: 204030 - DNA, 36 bp, Artificial Sequence
  Synthetic oligonucleotide
ggcccgctgcatttctatcatttcttgtcacggtca

SEQ ID NO: 204031 - DNA, 35 bp, Artificial Sequence
  Synthetic oligonucleotide
taataccagagcaaaagtaccatttgctttacgcg

SEQ ID NO: 204032 - DNA, 36 bp, Artificial Sequence
  Synthetic oligonucleotide
ggtttccgcactgggttcttctcgagaaaccgggca

SEQ ID NO: 204033 - DNA, 38 bp, Artificial Sequence
  Synthetic oligonucleotide
gccagacgacaatacttcttattcagataacgggttca

SEQ ID NO: 204034 - DNA, 37 bp, Artificial Sequence
  Synthetic oligonucleotide
tgatttttgagtttcgcatcatgtagggctctttgca

SEQ ID NO: 204035 - DNA, 36 bp, Artificial Sequence
  Synthetic oligonucleotide
ccgtatttatagtaacaacgtggaatagcgctgact

SEQ ID NO: 204036 - DNA, 26 bp, Artificial Sequence
  Synthetic oligonucleotide
ctatttcatggaatcccatctgctgc

SEQ ID NO: 204037 - DNA, 36 bp, Artificial Sequence
  Synthetic oligonucleotide
tttcggtaatgccatttaatgctttactaccgagaa

SEQ ID NO: 204038 - DNA, 35 bp, Artificial Sequence
  Synthetic oligonucleotide
aacccagcatagctccaatagaatgcgtccgcgct

SEQ ID NO: 204039 - DNA, 34 bp, Artificial Sequence
  Synthetic oligonucleotide
gttgagccgtctatcaagacaccctaccgtgaca

SEQ ID NO: 204040 - DNA, 35 bp, Artificial Sequence
  Synthetic oligonucleotide
tttccccgaccccacaaatggcgcccacagggcta

SEQ ID NO: 204041 - DNA, 37 bp, Artificial Sequence
  Synthetic oligonucleotide
gctgtgcagatatgaggcgataatcatgtcatgcaca

SEQ ID NO: 204042 - DNA, 38 bp, Artificial Sequence
  Synthetic oligonucleotide
ctgagccaatcccgtccctttgctgtgatttctagtca

SEQ ID NO: 204043 - DNA, 35 bp, Artificial Sequence
  Synthetic oligonucleotide
acgctagaaatagaaggttaatcatcgtcttgcac

SEQ ID NO: 204044 - DNA, 36 bp, Artificial Sequence
  Synthetic oligonucleotide
ccgtatttatagtaacaacgtggaatagcgctgaaa

SEQ ID NO: 204045 - DNA, 35 bp, Artificial Sequence
  Synthetic oligonucleotide
tgagggatcatttaggtaccttaggtgtacacgtt

SEQ ID NO: 204046 - DNA, 35 bp, Artificial Sequence
  Synthetic oligonucleotide
gctcggtgcgagggacgtaaattaactacgaacaa

SEQ ID NO: 204047 - DNA, 36 bp, Artificial Sequence
  Synthetic oligonucleotide
cactctttaataaagcagttttgcccggaatgacca

SEQ ID NO: 204048 - DNA, 38 bp, Artificial Sequence
  Synthetic oligonucleotide
gaccccgatcatcgcacgactcacaggtagtatgttgg

SEQ ID NO: 204049 - DNA, 35 bp, Artificial Sequence
  Synthetic oligonucleotide
ccatctagggtcagataccacgagatgccgctaac

SEQ ID NO: 204050 - DNA, 35 bp, Artificial Sequence
  Synthetic oligonucleotide
ttcgcgtatcattccccgtcataggcctgttttgt

SEQ ID NO: 204051 - DNA, 38 bp, Artificial Sequence
  Synthetic oligonucleotide
acatcttcttcaactgtctcgtccctcatcatgtctca

SEQ ID NO: 204052 - DNA, 35 bp, Artificial Sequence
  Synthetic oligonucleotide
agaccatttaaccgccctggctccggccccctctc

SEQ ID NO: 204053 - DNA, 35 bp, Artificial Sequence
  Synthetic oligonucleotide
tgcaatgtgatcattgcccctagcctcgaacacat

SEQ ID NO: 204054 - DNA, 34 bp, Artificial Sequence
  Synthetic oligonucleotide
atcacttggaagttgttttgtctcagtcacggcg

SEQ ID NO: 204055 - DNA, 25 bp, Artificial Sequence
  Synthetic oligonucleotide
tccatcatccttctttcgggactca

SEQ ID NO: 204056 - DNA, 35 bp, Artificial Sequence
  Synthetic oligonucleotide
gcatgcgcgctcttgaatcccgtatccactcagag

SEQ ID NO: 204057 - DNA, 38 bp, Artificial Sequence
  Synthetic oligonucleotide
ttgtatgacgcgaccgctttgctcaggcctatgattga

SEQ ID NO: 204058 - DNA, 36 bp, Artificial Sequence
  Synthetic oligonucleotide
tgtgcacatgggctcgactgcccctgcccttactca

SEQ ID NO: 204059 - DNA, 38 bp, Artificial Sequence
  Synthetic oligonucleotide
gagtgcattcagattaggcatacatagcttgaccttca

SEQ ID NO: 204060 - DNA, 38 bp, Artificial Sequence
  Synthetic oligonucleotide
atgtgccgtgtttcgctattcctccgcactaagactca

SEQ ID NO: 204061 - DNA, 38 bp, Artificial Sequence
  Synthetic oligonucleotide
tgattatcgctccgtagggttctctctccgaccgctga

SEQ ID NO: 204062 - DNA, 33 bp, Artificial Sequence
  Synthetic oligonucleotide
tacacgcgcgacctacgggttaggacatcgggt

SEQ ID NO: 204063 - DNA, 37 bp, Artificial Sequence
  Synthetic oligonucleotide
gtgttcgtgatactggttgcatcttcccccgagtcca

SEQ ID NO: 204064 - DNA, 35 bp, Artificial Sequence
  Synthetic oligonucleotide
tgcgttactggtgtcatttcatgctttcacgtgac

SEQ ID NO: 204065 - DNA, 35 bp, Artificial Sequence
  Synthetic oligonucleotide
tgacgggctcggttatagatccaggtcctatttcg

SEQ ID NO: 204066 - DNA, 37 bp, Artificial Sequence
  Synthetic oligonucleotide
gtcccgacccggtttgaatcgtttattaacgcacgca

SEQ ID NO: 204067 - DNA, 35 bp, Artificial Sequence
  Synthetic oligonucleotide
caacgatgttgatctagtcccattgtacccttggt

SEQ ID NO: 204068 - DNA, 35 bp, Artificial Sequence
  Synthetic oligonucleotide
tgcggtgtaggcacgaccgctcgtccttctcttca

SEQ ID NO: 204069 - DNA, 34 bp, Artificial Sequence
  Synthetic oligonucleotide
cccgggagccacgggctgtacgagcaagtcacat

SEQ ID NO: 204070 - DNA, 36 bp, Artificial Sequence
  Synthetic oligonucleotide
ggagttaccggttcgcttcgccctttcttgggacca

SEQ ID NO: 204071 - DNA, 35 bp, Artificial Sequence
  Synthetic oligonucleotide
actctgtatacccattgtgggctggttttcgccgt

SEQ ID NO: 204072 - DNA, 36 bp, Artificial Sequence
  Synthetic oligonucleotide
tgcagcatgcgatcgggatcagccgtatcttctcga

SEQ ID NO: 204073 - DNA, 35 bp, Artificial Sequence
  Synthetic oligonucleotide
tttgcaccatactatccttgtatagctagtatctc

SEQ ID NO: 204074 - DNA, 35 bp, Artificial Sequence
  Synthetic oligonucleotide
tccgcctgttcatacgatttttatgcggaatcggt

SEQ ID NO: 204075 - DNA, 35 bp, Artificial Sequence
  Synthetic oligonucleotide
gccacagggatgccgtcgattttggccctttatca

SEQ ID NO: 204076 - DNA, 36 bp, Artificial Sequence
  Synthetic oligonucleotide
gacaccgtacacgggtaaggggtagctctgctaaca

SEQ ID NO: 204077 - DNA, 35 bp, Artificial Sequence
  Synthetic oligonucleotide
caatgccctcggcacgcttatgctccaaattgtcc

SEQ ID NO: 204078 - DNA, 35 bp, Artificial Sequence
  Synthetic oligonucleotide
tcgccccatcaccgactccagaaattggaaacacg

SEQ ID NO: 204079 - DNA, 36 bp, Artificial Sequence
  Synthetic oligonucleotide
caagtactatgacactatttcctcttcgttctcgca

SEQ ID NO: 204080 - DNA, 36 bp, Artificial Sequence
  Synthetic oligonucleotide
acatggcatggctcgattgtcacctcaaattatcca

SEQ ID NO: 204081 - DNA, 34 bp, Artificial Sequence
  Synthetic oligonucleotide
acatgtcgatgtccgtcgacgcatctgatctaac

SEQ ID NO: 204082 - DNA, 35 bp, Artificial Sequence
  Synthetic oligonucleotide
gcacttatgttagcgtttggtgacgcttgcttcag

SEQ ID NO: 204083 - DNA, 35 bp, Artificial Sequence
  Synthetic oligonucleotide
gtggtgcggaccttccgacgatcacaattggctca

SEQ ID NO: 204084 - DNA, 37 bp, Artificial Sequence
  Synthetic oligonucleotide
ccagcggacaacggccgaagtcattgacatttcctca

SEQ ID NO: 204085 - DNA, 35 bp, Artificial Sequence
  Synthetic oligonucleotide
gacctccaacaccattgtctatccgtccttgcatc

SEQ ID NO: 204086 - DNA, 37 bp, Artificial Sequence
  Synthetic oligonucleotide
gcggactaattgagcggatcttaaccacagttgccca

SEQ ID NO: 204087 - DNA, 36 bp, Artificial Sequence
  Synthetic oligonucleotide
cgtgggttcgtccttgtacggacattcctcatttca

SEQ ID NO: 204088 - DNA, 38 bp, Artificial Sequence
  Synthetic oligonucleotide
ttcagacgcacatgtccctttggggctcatatagctca

SEQ ID NO: 204089 - DNA, 35 bp, Artificial Sequence
  Synthetic oligonucleotide
gatttgggtccttcgttatgttgccaggaatctgg

SEQ ID NO: 204090 - DNA, 35 bp, Artificial Sequence
  Synthetic oligonucleotide
ctcaagccactacagtgagttgtttattcctatct

SEQ ID NO: 204091 - DNA, 37 bp, Artificial Sequence
  Synthetic oligonucleotide
gcggtactcagcatccgactaatggcccattgctgga

SEQ ID NO: 204092 - DNA, 37 bp, Artificial Sequence
  Synthetic oligonucleotide
tttttgagcaaagctatgcgtctgcgtacaactgcca

SEQ ID NO: 204093 - DNA, 36 bp, Artificial Sequence
  Synthetic oligonucleotide
tggaacggaatgccttttgtaattcggccatgctca

SEQ ID NO: 204094 - DNA, 35 bp, Artificial Sequence
  Synthetic oligonucleotide
tctggcgccggtatccttttaatatggccatatag

SEQ ID NO: 204095 - DNA, 35 bp, Artificial Sequence
  Synthetic oligonucleotide
gttgatgttttcacaccccagataggccgtgggag

SEQ ID NO: 204096 - DNA, 38 bp, Artificial Sequence
  Synthetic oligonucleotide
agttttatggtgcgctctctttacctttcaaggcctca

SEQ ID NO: 204097 - DNA, 37 bp, Artificial Sequence
  Synthetic oligonucleotide
tcgccgccattctctcaatccgtttcatacatcggca

SEQ ID NO: 204098 - DNA, 37 bp, Artificial Sequence
  Synthetic oligonucleotide
gcctgtggcgccagtttgaatattagtgccaacagca

SEQ ID NO: 204099 - DNA, 38 bp, Artificial Sequence
  Synthetic oligonucleotide
gattcgatcagctgtgtgtgggtttcatgaccccttgt

SEQ ID NO: 204100 - DNA, 35 bp, Artificial Sequence
  Synthetic oligonucleotide
tgctatgggatcaccccccttatctattggcgcat

SEQ ID NO: 204101 - DNA, 38 bp, Artificial Sequence
  Synthetic oligonucleotide
atttatcctgtagttaagtcctccacctaactcgatca

SEQ ID NO: 204102 - DNA, 36 bp, Artificial Sequence
  Synthetic oligonucleotide
aattgtattgttcatgaagttttcattcggactgca

SEQ ID NO: 204103 - DNA, 36 bp, Artificial Sequence
  Synthetic oligonucleotide
ttcacaatcctcgctcccatttcacgatatgacgtt

SEQ ID NO: 204104 - DNA, 35 bp, Artificial Sequence
  Synthetic oligonucleotide
tgctgtcactcggagtagtatctgacgccacctca

SEQ ID NO: 204105 - DNA, 35 bp, Artificial Sequence
  Synthetic oligonucleotide
gttttgtgcaccaaagttgatggttattaatcgtc

SEQ ID NO: 204106 - DNA, 35 bp, Artificial Sequence
  Synthetic oligonucleotide
tcacttgaatggcgagactcttttccattgcctgt

SEQ ID NO: 204107 - DNA, 37 bp, Artificial Sequence
  Synthetic oligonucleotide
gctgagttactcccgaaaggatcaccccggtactcta

SEQ ID NO: 204108 - DNA, 35 bp, Artificial Sequence
  Synthetic oligonucleotide
gttcgattgcttctcttcccgtatgaccgctagcc

SEQ ID NO: 204109 - DNA, 35 bp, Artificial Sequence
  Synthetic oligonucleotide
ttgaactcttctatctcatgacagggatgtaggtt

SEQ ID NO: 204110 - DNA, 38 bp, Artificial Sequence
  Synthetic oligonucleotide
cgttagacggccagagaacgcatactgatatcatttgt

SEQ ID NO: 204111 - DNA, 37 bp, Artificial Sequence
  Synthetic oligonucleotide
ttctccactgaatctaacgcgacgttagatggtccta

SEQ ID NO: 204112 - DNA, 36 bp, Artificial Sequence
  Synthetic oligonucleotide
gcaacggttgaaagtcttgcggagttctttgaatca

SEQ ID NO: 204113 - DNA, 35 bp, Artificial Sequence
  Synthetic oligonucleotide
ttcatactttgttgtagggcacgcaagtcatatcc

SEQ ID NO: 204114 - DNA, 35 bp, Artificial Sequence
  Synthetic oligonucleotide
tgagtctctcactggctataacaggttgtatacca

SEQ ID NO: 204115 - DNA, 35 bp, Artificial Sequence
  Synthetic oligonucleotide
atgcgggggcatcttacttccagtcttagtttttg

SEQ ID NO: 204116 - DNA, 36 bp, Artificial Sequence
  Synthetic oligonucleotide
acacaccgctccatcacgtgtctatccattgaacca

SEQ ID NO: 204117 - DNA, 36 bp, Artificial Sequence
  Synthetic oligonucleotide
tgctacttcgattcaacgtacctacggaaaccacaa

SEQ ID NO: 204118 - DNA, 35 bp, Artificial Sequence
  Synthetic oligonucleotide
cgcagtcattttggtatctcgctttataacgtgat

SEQ ID NO: 204119 - DNA, 35 bp, Artificial Sequence
  Synthetic oligonucleotide
cctccacggccgtctctagcgtcaaactcagttcc

SEQ ID NO: 204120 - DNA, 35 bp, Artificial Sequence
  Synthetic oligonucleotide
cgggacttgggaagtgagcggtctttcgaatttag

SEQ ID NO: 204121 - DNA, 35 bp, Artificial Sequence
  Synthetic oligonucleotide
cgatcctgtgatcaatcccctaatcgtttgccggt

SEQ ID NO: 204122 - DNA, 36 bp, Artificial Sequence
  Synthetic oligonucleotide
gtctcatagtttggtgtcaatcgtgttccgtaatca

SEQ ID NO: 204123 - DNA, 35 bp, Artificial Sequence
  Synthetic oligonucleotide
ggtccttaccgggactccaccaagtatacccgtac

SEQ ID NO: 204124 - DNA, 36 bp, Artificial Sequence
  Synthetic oligonucleotide
ttgcttacccggccataaacacgatcttgttctcta

SEQ ID NO: 204125 - DNA, 36 bp, Artificial Sequence
  Synthetic oligonucleotide
tggcgttcacaagcactcaagggtccgctctaatca

SEQ ID NO: 204126 - DNA, 35 bp, Artificial Sequence
  Synthetic oligonucleotide
cccttaatgggggctgggctacgcataggtgtgag

SEQ ID NO: 204127 - DNA, 35 bp, Artificial Sequence
  Synthetic oligonucleotide
aacgttagcctataaattaaattccacagttttag

SEQ ID NO: 204128 - DNA, 35 bp, Artificial Sequence
  Synthetic oligonucleotide
taagacctcaccgcacagaacattgatactggcat

SEQ ID NO: 204129 - DNA, 36 bp, Artificial Sequence
  Synthetic oligonucleotide
tccggtatcgatggcctcatggcgcattattgtccg

SEQ ID NO: 204130 - DNA, 38 bp, Artificial Sequence
  Synthetic oligonucleotide
gagtgtgaactggttcgtacatagtcgctcggtgttca

SEQ ID NO: 204131 - DNA, 27 bp, Artificial Sequence
  Synthetic oligonucleotide
gtcgagcctctttcctagtgatacgct

SEQ ID NO: 204132 - DNA, 36 bp, Artificial Sequence
  Synthetic oligonucleotide
ctagcgattcttcactgtattgacgggctacttcta

SEQ ID NO: 204133 - DNA, 37 bp, Artificial Sequence
  Synthetic oligonucleotide
ccgttggctacctcccaagctgttactcgccgtgcca

SEQ ID NO: 204134 - DNA, 35 bp, Artificial Sequence
  Synthetic oligonucleotide
ctagctagcgacccattgagtgtttcggtgctacc

SEQ ID NO: 204135 - DNA, 36 bp, Artificial Sequence
  Synthetic oligonucleotide
ctagccacacccaatatgccccggttcaagatctca

SEQ ID NO: 204136 - DNA, 38 bp, Artificial Sequence
  Synthetic oligonucleotide
ttatagagttgttccgttctatacttagctgtgggtca

SEQ ID NO: 204137 - DNA, 37 bp, Artificial Sequence
  Synthetic oligonucleotide
tacacagggagttttttcagttatcctctctggcgca

SEQ ID NO: 204138 - DNA, 35 bp, Artificial Sequence
  Synthetic oligonucleotide
gccgttccatagattcgcggactaccattccctct

SEQ ID NO: 204139 - DNA, 35 bp, Artificial Sequence
  Synthetic oligonucleotide
tctagccaaccggccgatacggacctcacgtgtcg

SEQ ID NO: 204140 - DNA, 35 bp, Artificial Sequence
  Synthetic oligonucleotide
tcagttgtggcttctaccgtctcggggcattcaag

SEQ ID NO: 204141 - DNA, 35 bp, Artificial Sequence
  Synthetic oligonucleotide
atgtatcacatgcggttctggagagtttgttaggt

SEQ ID NO: 204142 - DNA, 35 bp, Artificial Sequence
  Synthetic oligonucleotide
agatcgccggtacgccaccggcgatacctattcag

SEQ ID NO: 204143 - DNA, 36 bp, Artificial Sequence
  Synthetic oligonucleotide
cgttggtcataccagcgacgcggtctcatacctaga

SEQ ID NO: 204144 - DNA, 36 bp, Artificial Sequence
  Synthetic oligonucleotide
gtcacctagtttggagccgtagccgatactcttgtg

SEQ ID NO: 204145 - DNA, 36 bp, Artificial Sequence
  Synthetic oligonucleotide
gagcaaggctcccaggacttgctagtaacacataca

SEQ ID NO: 204146 - DNA, 37 bp, Artificial Sequence
  Synthetic oligonucleotide
ccttttcagacttgcccatatcgggtctttatcacca

SEQ ID NO: 204147 - DNA, 38 bp, Artificial Sequence
  Synthetic oligonucleotide
gaacgggagttcaatgatcgttgctttaggttccctca

SEQ ID NO: 204148 - DNA, 36 bp, Artificial Sequence
  Synthetic oligonucleotide
gcggatatctaattgtcctctcgctgtgtatatgaa

SEQ ID NO: 204149 - DNA, 35 bp, Artificial Sequence
  Synthetic oligonucleotide
aatgtctctattcttgtgttgctaatcgttgcacg

SEQ ID NO: 204150 - DNA, 37 bp, Artificial Sequence
  Synthetic oligonucleotide
ttccagggtgttacgacccgcacacgctcgaccatca

SEQ ID NO: 204151 - DNA, 37 bp, Artificial Sequence
  Synthetic oligonucleotide
actcatcgtcactcacgctagcccttggtaaccacgt

SEQ ID NO: 204152 - DNA, 36 bp, Artificial Sequence
  Synthetic oligonucleotide
catttttgcttctacccacggactgaaagacagtca

SEQ ID NO: 204153 - DNA, 35 bp, Artificial Sequence
  Synthetic oligonucleotide
cttcttgctgtcagtctcactcgttcataacgacg

SEQ ID NO: 204154 - DNA, 33 bp, Artificial Sequence
  Synthetic oligonucleotide
agtacgacgcagggctagtgcgatgcttgacat

SEQ ID NO: 204155 - DNA, 36 bp, Artificial Sequence
  Synthetic oligonucleotide
tgaatagtggtgccccttgattacttcgctgcctca

SEQ ID NO: 204156 - DNA, 38 bp, Artificial Sequence
  Synthetic oligonucleotide
acgtcccagggccctctacggattgtttccgcgtgtca

SEQ ID NO: 204157 - DNA, 38 bp, Artificial Sequence
  Synthetic oligonucleotide
acagttcacgctgtttgaaaatgctgcctatcatgtca

SEQ ID NO: 204158 - DNA, 35 bp, Artificial Sequence
  Synthetic oligonucleotide
tactcccgagagtaggacactctccttgccctcca

SEQ ID NO: 204159 - DNA, 35 bp, Artificial Sequence
  Synthetic oligonucleotide
ttaatccctccccgttccgtcatgggttacccgca

SEQ ID NO: 204160 - DNA, 35 bp, Artificial Sequence
  Synthetic oligonucleotide
catgcattgaggtgcattgagtctttcttgagcaa

SEQ ID NO: 204161 - DNA, 36 bp, Artificial Sequence
  Synthetic oligonucleotide
tctgcggacagaatgtaccccatttttatgccgagt

SEQ ID NO: 204162 - DNA, 38 bp, Artificial Sequence
  Synthetic oligonucleotide
aattcgtcactcgttgtgtgtagcaggtgcccaattga

SEQ ID NO: 204163 - DNA, 36 bp, Artificial Sequence
  Synthetic oligonucleotide
caaccacggtaatatgctcttggagcgattgctaaa

SEQ ID NO: 204164 - DNA, 36 bp, Artificial Sequence
  Synthetic oligonucleotide
catcaactcgcggtaagccgcctgtctccttaggaa

SEQ ID NO: 204165 - DNA, 37 bp, Artificial Sequence
  Synthetic oligonucleotide
ggtcgtttggccgcgccaatctcggatattcccacca

SEQ ID NO: 204166 - DNA, 35 bp, Artificial Sequence
  Synthetic oligonucleotide
gctccgtctatccatcgagagagcacatggccaat

SEQ ID NO: 204167 - DNA, 37 bp, Artificial Sequence
  Synthetic oligonucleotide
ccaccccgatttcgttgcttgggccggagcacgccca

SEQ ID NO: 204168 - DNA, 35 bp, Artificial Sequence
  Synthetic oligonucleotide
tatggtgtccttccttgtttgaaatggttcctacg

SEQ ID NO: 204169 - DNA, 35 bp, Artificial Sequence
  Synthetic oligonucleotide
gtcacttgcttaccgtgtctagttgccacgcggct

SEQ ID NO: 204170 - DNA, 35 bp, Artificial Sequence
  Synthetic oligonucleotide
gtagtatgtcgctcttccgacctgtcggtattcat

SEQ ID NO: 204171 - DNA, 37 bp, Artificial Sequence
  Synthetic oligonucleotide
ggttcgtgacactctcaaccacccttatttgaatgaa

SEQ ID NO: 204172 - DNA, 35 bp, Artificial Sequence
  Synthetic oligonucleotide
aaaatcactggatcataaatctgtttattcgttcc

SEQ ID NO: 204173 - DNA, 35 bp, Artificial Sequence
  Synthetic oligonucleotide
tcatatgagcgcataaccgcaaagtgcattgcact

SEQ ID NO: 204174 - DNA, 38 bp, Artificial Sequence
  Synthetic oligonucleotide
cttacatttcatccatgcgaagttttttgggcccatca

SEQ ID NO: 204175 - DNA, 38 bp, Artificial Sequence
  Synthetic oligonucleotide
ggcctgtcgtaccaactaggcgttaacgctaataatca

SEQ ID NO: 204176 - DNA, 35 bp, Artificial Sequence
  Synthetic oligonucleotide
cgtgcgctgcgctctacatttgagtttctttcgca

SEQ ID NO: 204177 - DNA, 38 bp, Artificial Sequence
  Synthetic oligonucleotide
cctgccagcacatcacgctagaaggtgcccttcattca

SEQ ID NO: 204178 - DNA, 37 bp, Artificial Sequence
  Synthetic oligonucleotide
caggacatttaccctcgtttggtaccctgccccatca

SEQ ID NO: 204179 - DNA, 36 bp, Artificial Sequence
  Synthetic oligonucleotide
ttttaggccaacatagggtcaaaccttagaagctaa

SEQ ID NO: 204180 - DNA, 38 bp, Artificial Sequence
  Synthetic oligonucleotide
accgcctcaccgagcaaaagtatccaccgcgggtttgt

SEQ ID NO: 204181 - DNA, 35 bp, Artificial Sequence
  Synthetic oligonucleotide
atcccggtggcggtgggctccattggatccagtag

SEQ ID NO: 204182 - DNA, 36 bp, Artificial Sequence
  Synthetic oligonucleotide
ttgacttagaagcactttcgtcttttccaatcgatt

SEQ ID NO: 204183 - DNA, 38 bp, Artificial Sequence
  Synthetic oligonucleotide
ttgggtccattcgcctttatatcgacgaccctttgtga

SEQ ID NO: 204184 - DNA, 36 bp, Artificial Sequence
  Synthetic oligonucleotide
gaccgggttccgtccccaacagtctctcaagcccca

SEQ ID NO: 204185 - DNA, 35 bp, Artificial Sequence
  Synthetic oligonucleotide
atagctggactcacgcgcacgtactgtgagatggt

SEQ ID NO: 204186 - DNA, 38 bp, Artificial Sequence
  Synthetic oligonucleotide
ccaattcggatgtacgcaccgccgattgattccggtca

SEQ ID NO: 204187 - DNA, 38 bp, Artificial Sequence
  Synthetic oligonucleotide
cctaccccgaatggtgattctctatatgcccaggtcga

SEQ ID NO: 204188 - DNA, 37 bp, Artificial Sequence
  Synthetic oligonucleotide
cacttactcacgcagttatcgcctgaaagctccccga

SEQ ID NO: 204189 - DNA, 37 bp, Artificial Sequence
  Synthetic oligonucleotide
gtccgaccgccttaaatgatcgtcacctccaggcggt

SEQ ID NO: 204190 - DNA, 37 bp, Artificial Sequence
  Synthetic oligonucleotide
aatcctatccgccgcccgtctcatcgctccggtgcca

SEQ ID NO: 204191 - DNA, 37 bp, Artificial Sequence
  Synthetic oligonucleotide
gcgcattggtcagtagaacaatttagatttatcttca

SEQ ID NO: 204192 - DNA, 35 bp, Artificial Sequence
  Synthetic oligonucleotide
cgtcttgcctggttggtgacgtttaggccggctaa

SEQ ID NO: 204193 - DNA, 35 bp, Artificial Sequence
  Synthetic oligonucleotide
ccaccgtcgtcgataaagacatcctagtaagccag

SEQ ID NO: 204194 - DNA, 35 bp, Artificial Sequence
  Synthetic oligonucleotide
gttagctacctgcgtatcacgagttatctacttcg

SEQ ID NO: 204195 - DNA, 36 bp, Artificial Sequence
  Synthetic oligonucleotide
tcggtatttaccttccattattcgctagcttgacaa

SEQ ID NO: 204196 - DNA, 36 bp, Artificial Sequence
  Synthetic oligonucleotide
ggtccgcctccggatagtctgtttccccgagtttca

SEQ ID NO: 204197 - DNA, 35 bp, Artificial Sequence
  Synthetic oligonucleotide
tttttcgtcctctccgctcgcattttatgctagca

SEQ ID NO: 204198 - DNA, 35 bp, Artificial Sequence
  Synthetic oligonucleotide
cgaatctagaacctcacccacgcgccccatcatct

SEQ ID NO: 204199 - DNA, 37 bp, Artificial Sequence
  Synthetic oligonucleotide
accgcggccataagccacacttagggacggaatccca

SEQ ID NO: 204200 - DNA, 36 bp, Artificial Sequence
  Synthetic oligonucleotide
actacatcggcctgacatttgagtgtggcctatcct

SEQ ID NO: 204201 - DNA, 38 bp, Artificial Sequence
  Synthetic oligonucleotide
ggtgcatcctgcacgtactttcattctctgccgggtca

SEQ ID NO: 204202 - DNA, 35 bp, Artificial Sequence
  Synthetic oligonucleotide
gttcagcttctctatcgcacattctaagctgctcg

SEQ ID NO: 204203 - DNA, 34 bp, Artificial Sequence
  Synthetic oligonucleotide
gctgaaactcgccttcccgaggtctcgcgggaaa

SEQ ID NO: 204204 - DNA, 27 bp, Artificial Sequence
  Synthetic oligonucleotide
gtctctccatcccgttttaattgtgga

SEQ ID NO: 204205 - DNA, 38 bp, Artificial Sequence
  Synthetic oligonucleotide
gaccttggttctggctcagtaacaggtatgcgctttgt

SEQ ID NO: 204206 - DNA, 35 bp, Artificial Sequence
  Synthetic oligonucleotide
acgtagtgagtgtcaccacaatggcttacccgcca

SEQ ID NO: 204207 - DNA, 36 bp, Artificial Sequence
  Synthetic oligonucleotide
agtggactccaaagtagagtttatcgaatcgtacaa

SEQ ID NO: 204208 - DNA, 35 bp, Artificial Sequence
  Synthetic oligonucleotide
gtctattctgatgtgggcgcacgccctcccctaaa

SEQ ID NO: 204209 - DNA, 38 bp, Artificial Sequence
  Synthetic oligonucleotide
atttcgaacgttacgcgaactcagcctaactctcttgg

SEQ ID NO: 204210 - DNA, 37 bp, Artificial Sequence
  Synthetic oligonucleotide
actttacggtctgtccttttgctctacgcggtattgt

SEQ ID NO: 204211 - DNA, 36 bp, Artificial Sequence
  Synthetic oligonucleotide
taatccttacagcggtaaggtactgaaatcacactt

SEQ ID NO: 204212 - DNA, 37 bp, Artificial Sequence
  Synthetic oligonucleotide
tttagtcattacttcaagatttgtccgatcctcgggt

SEQ ID NO: 204213 - DNA, 37 bp, Artificial Sequence
  Synthetic oligonucleotide
ctcaatcacgccggctgtttgtcactggacatagtca

SEQ ID NO: 204214 - DNA, 35 bp, Artificial Sequence
  Synthetic oligonucleotide
gcttggcatggcatacgcaccaccccgcccaggct

SEQ ID NO: 204215 - DNA, 36 bp, Artificial Sequence
  Synthetic oligonucleotide
gccctggaaaacctcgcgttccgctacgcctctgca

SEQ ID NO: 204216 - DNA, 35 bp, Artificial Sequence
  Synthetic oligonucleotide
cgcggcgagccacgggctgtacgagcaagtcacac

SEQ ID NO: 204217 - DNA, 35 bp, Artificial Sequence
  Synthetic oligonucleotide
ttactccagtactggccccgccggctttaggcacc

SEQ ID NO: 204218 - DNA, 35 bp, Artificial Sequence
  Synthetic oligonucleotide
gtctaccggtaatgagtatctcatgtcacgtccca

SEQ ID NO: 204219 - DNA, 37 bp, Artificial Sequence
  Synthetic oligonucleotide
tctgcgtgatcgtctctggagtggatcgaatgtccca

SEQ ID NO: 204220 - DNA, 35 bp, Artificial Sequence
  Synthetic oligonucleotide
ccgctcagcagtgctacgttactttgagtgttcca

SEQ ID NO: 204221 - DNA, 35 bp, Artificial Sequence
  Synthetic oligonucleotide
cccgctgagaacaattcgacgaactattcacccca

SEQ ID NO: 204222 - DNA, 36 bp, Artificial Sequence
  Synthetic oligonucleotide
cctggcatatgagttgccccctggtttcgcccgtca

SEQ ID NO: 204223 - DNA, 35 bp, Artificial Sequence
  Synthetic oligonucleotide
aacgctcgccttgcactgggatgctatgtttccca

SEQ ID NO: 204224 - DNA, 35 bp, Artificial Sequence
  Synthetic oligonucleotide
atctttcatagtgatatattctaaattgccggtcc

SEQ ID NO: 204225 - DNA, 35 bp, Artificial Sequence
  Synthetic oligonucleotide
accctttactcaaggactatttcaatggtggcata

SEQ ID NO: 204226 - DNA, 36 bp, Artificial Sequence
  Synthetic oligonucleotide
gagcccctagcgctaggaatcgtgcctccctctgca

SEQ ID NO: 204227 - DNA, 36 bp, Artificial Sequence
  Synthetic oligonucleotide
gtaccgagccatttcattgccccgccatccaaatca

SEQ ID NO: 204228 - DNA, 35 bp, Artificial Sequence
  Synthetic oligonucleotide
cctccaccgacaacgggacacagactttacatggg

SEQ ID NO: 204229 - DNA, 36 bp, Artificial Sequence
  Synthetic oligonucleotide
atctcgcacattccctatgacacggcgacatcctca

SEQ ID NO: 204230 - DNA, 35 bp, Artificial Sequence
  Synthetic oligonucleotide
ctattgtaaacccgttgcggactgatcatccatcc

SEQ ID NO: 204231 - DNA, 35 bp, Artificial Sequence
  Synthetic oligonucleotide
acatagtcgcatagttgtttaccttctaggataag

SEQ ID NO: 204232 - DNA, 33 bp, Artificial Sequence
  Synthetic oligonucleotide
tcaccacgtcctaattctcataccgaattcaat

SEQ ID NO: 204233 - DNA, 36 bp, Artificial Sequence
  Synthetic oligonucleotide
tccgatttttcacctccttcaatatcggaacctgca

SEQ ID NO: 204234 - DNA, 36 bp, Artificial Sequence
  Synthetic oligonucleotide
cggacgtccctaccgtatccccacacttctagccca

SEQ ID NO: 204235 - DNA, 35 bp, Artificial Sequence
  Synthetic oligonucleotide
agtccacgaatggggtattttaattacgttctgat

SEQ ID NO: 204236 - DNA, 35 bp, Artificial Sequence
  Synthetic oligonucleotide
gggaggacgctatcgggttttttcttatttggtcg

SEQ ID NO: 204237 - DNA, 35 bp, Artificial Sequence
  Synthetic oligonucleotide
gctcacccggttcggcttcccattgtgattctgcc

SEQ ID NO: 204238 - DNA, 38 bp, Artificial Sequence
  Synthetic oligonucleotide
gccccgatccggccccccaggttgtccagcatagctca

SEQ ID NO: 204239 - DNA, 35 bp, Artificial Sequence
  Synthetic oligonucleotide
tggttgtggcaatctcgctttgttctctctccgcc

SEQ ID NO: 204240 - DNA, 35 bp, Artificial Sequence
  Synthetic oligonucleotide
gtcttgttgcttgcttctgtttctcgatgtccacg

SEQ ID NO: 204241 - DNA, 35 bp, Artificial Sequence
  Synthetic oligonucleotide
gggctcatttgatattgccaggtatctgacattcc

SEQ ID NO: 204242 - DNA, 37 bp, Artificial Sequence
  Synthetic oligonucleotide
atgcgcccacatgcacctcgttaacctacctctagga

SEQ ID NO: 204243 - DNA, 36 bp, Artificial Sequence
  Synthetic oligonucleotide
gctcattcgtcaacgaattgcgccgcctacgtttct

SEQ ID NO: 204244 - DNA, 35 bp, Artificial Sequence
  Synthetic oligonucleotide
catcgcgtaatgtttcatacatacctatcagcccg

SEQ ID NO: 204245 - DNA, 34 bp, Artificial Sequence
  Synthetic oligonucleotide
taactcgaagcatgtctcccaatcgaatctccat

SEQ ID NO: 204246 - DNA, 35 bp, Artificial Sequence
  Synthetic oligonucleotide
gtcgagtaatgtgaaatgtgtctctcatttggact

SEQ ID NO: 204247 - DNA, 35 bp, Artificial Sequence
  Synthetic oligonucleotide
ccaccgttgtcgttcccaggtgggcgttatagacg

SEQ ID NO: 204248 - DNA, 37 bp, Artificial Sequence
  Synthetic oligonucleotide
tatgtccacaacttcgttataacggtcaacccttggg

SEQ ID NO: 204249 - DNA, 35 bp, Artificial Sequence
  Synthetic oligonucleotide
agcccctggggtcacgtcaacttcccgtcgacaag

SEQ ID NO: 204250 - DNA, 38 bp, Artificial Sequence
  Synthetic oligonucleotide
gtggtctgcgttcaactcgcgtcatctaagcttgttct

SEQ ID NO: 204251 - DNA, 36 bp, Artificial Sequence
  Synthetic oligonucleotide
acttcacctatgcgggttaagatacccgaacctcaa

SEQ ID NO: 204252 - DNA, 35 bp, Artificial Sequence
  Synthetic oligonucleotide
cggggcatcggcacattcaagcgtaataccacctt

SEQ ID NO: 204253 - DNA, 35 bp, Artificial Sequence
  Synthetic oligonucleotide
agaagtcatcctacatacgacttcctctggtgacc

SEQ ID NO: 204254 - DNA, 35 bp, Artificial Sequence
  Synthetic oligonucleotide
agccaggtctccgctacacctatacacctttctct

SEQ ID NO: 204255 - DNA, 37 bp, Artificial Sequence
  Synthetic oligonucleotide
acgcggatccggtttattcgcccacgtgatcgaaaca

SEQ ID NO: 204256 - DNA, 38 bp, Artificial Sequence
  Synthetic oligonucleotide
tgcattctgcaaggacgggtctcctcgaaataaaatca

SEQ ID NO: 204257 - DNA, 35 bp, Artificial Sequence
  Synthetic oligonucleotide
tgttagaattttcgtatctctgtatctgaatggtg

SEQ ID NO: 204258 - DNA, 36 bp, Artificial Sequence
  Synthetic oligonucleotide
aaatcgcaaggttcatacgcatcaccttccatttgg

SEQ ID NO: 204259 - DNA, 37 bp, Artificial Sequence
  Synthetic oligonucleotide
taggacgctctcacggcctcttcatagcatctcgtca

SEQ ID NO: 204260 - DNA, 35 bp, Artificial Sequence
  Synthetic oligonucleotide
caattgatctctccggacttagtacgatcgtcccg

SEQ ID NO: 204261 - DNA, 37 bp, Artificial Sequence
  Synthetic oligonucleotide
aagccatgattgttatatcggatccccgatttatggt

SEQ ID NO: 204262 - DNA, 36 bp, Artificial Sequence
  Synthetic oligonucleotide
gtgtccgttacgttccttcctgctgagcgaccgttt

SEQ ID NO: 204263 - DNA, 35 bp, Artificial Sequence
  Synthetic oligonucleotide
agggctgttttcacttccgttatataagtcgcctt

SEQ ID NO: 204264 - DNA, 35 bp, Artificial Sequence
  Synthetic oligonucleotide
actcgggcatgcagcaactcgtaatcttgcctcca

SEQ ID NO: 204265 - DNA, 35 bp, Artificial Sequence
  Synthetic oligonucleotide
actaccccgtccgcgcagagacgtgtcatgcggcg

SEQ ID NO: 204266 - DNA, 37 bp, Artificial Sequence
  Synthetic oligonucleotide
gttccgtagatcttcattagatccctatcacgtatca

SEQ ID NO: 204267 - DNA, 36 bp, Artificial Sequence
  Synthetic oligonucleotide
gttggcctcccttaactgataagcattatactctca

SEQ ID NO: 204268 - DNA, 35 bp, Artificial Sequence
  Synthetic oligonucleotide
catataccccaagctgtatgcagatgtcgcttccc

SEQ ID NO: 204269 - DNA, 34 bp, Artificial Sequence
  Synthetic oligonucleotide
ttctgactccatccccgagcgtacatgtgtgtca

SEQ ID NO: 204270 - DNA, 36 bp, Artificial Sequence
  Synthetic oligonucleotide
ttcgctcgccagttgtcatcctcacaaccccaaaca

SEQ ID NO: 204271 - DNA, 36 bp, Artificial Sequence
  Synthetic oligonucleotide
aagggtgcattggtttacacctacttgctacggtca

SEQ ID NO: 204272 - DNA, 36 bp, Artificial Sequence
  Synthetic oligonucleotide
ataattagccacgggaattgcacacagccacctcct

SEQ ID NO: 204273 - DNA, 37 bp, Artificial Sequence
  Synthetic oligonucleotide
acattttgcgttagcactactgtaatctcctttggca

SEQ ID NO: 204274 - DNA, 32 bp, Artificial Sequence
  Synthetic oligonucleotide
ctacgcactacaggtactattttcgccacata

SEQ ID NO: 204275 - DNA, 36 bp, Artificial Sequence
  Synthetic oligonucleotide
tttcaggaacaggtatataattcgccagcatatgca

SEQ ID NO: 204276 - DNA, 35 bp, Artificial Sequence
  Synthetic oligonucleotide
gaaaaggaggtctatgggctatttacaaccccaac

SEQ ID NO: 204277 - DNA, 36 bp, Artificial Sequence
  Synthetic oligonucleotide
attgcttgagcaagcccattgctcgaacttgtttca

SEQ ID NO: 204278 - DNA, 36 bp, Artificial Sequence
  Synthetic oligonucleotide
cgttcctaccatcgggatgcaaggcttattagtgta

SEQ ID NO: 204279 - DNA, 37 bp, Artificial Sequence
  Synthetic oligonucleotide
cacgacgtaactctcgtctaggagccccacacgccca

SEQ ID NO: 204280 - DNA, 36 bp, Artificial Sequence
  Synthetic oligonucleotide
catgaacaaggatctttaataaccgcgcggaaacaa

SEQ ID NO: 204281 - DNA, 37 bp, Artificial Sequence
  Synthetic oligonucleotide
gacttgcatcaggtttgtcctcccgtcgtgttctcca

SEQ ID NO: 204282 - DNA, 38 bp, Artificial Sequence
  Synthetic oligonucleotide
catgcgcgatccgcatcagggtcctactcctccgctca

SEQ ID NO: 204283 - DNA, 35 bp, Artificial Sequence
  Synthetic oligonucleotide
ttcgaccccgccccggatactgtggctctcaatcg

SEQ ID NO: 204284 - DNA, 35 bp, Artificial Sequence
  Synthetic oligonucleotide
caacgaggttgatctagtcccattgtacccttgcg

SEQ ID NO: 204285 - DNA, 36 bp, Artificial Sequence
  Synthetic oligonucleotide
tgactttgcgcggaatggtcatttatctggtgttca

SEQ ID NO: 204286 - DNA, 37 bp, Artificial Sequence
  Synthetic oligonucleotide
gagtgctagcgcttacttcctctatctcgtactgaca

SEQ ID NO: 204287 - DNA, 37 bp, Artificial Sequence
  Synthetic oligonucleotide
tggttcctgcactatccgacgctcacattcgctctgg

SEQ ID NO: 204288 - DNA, 35 bp, Artificial Sequence
  Synthetic oligonucleotide
gcacgtttctatccactgcccacacttctcgcgtg

SEQ ID NO: 204289 - DNA, 36 bp, Artificial Sequence
  Synthetic oligonucleotide
ctaccaactcttcctcgcgctggcccacatatactg

SEQ ID NO: 204290 - DNA, 35 bp, Artificial Sequence
  Synthetic oligonucleotide
ccaacagacaaacgcttactatccggatcgcgacc

SEQ ID NO: 204291 - DNA, 35 bp, Artificial Sequence
  Synthetic oligonucleotide
atcactgctcggcctcaccttaagccccacattag

SEQ ID NO: 204292 - DNA, 35 bp, Artificial Sequence
  Synthetic oligonucleotide
ttgtgagcttaaaaatggagtatgctggatcgaat

SEQ ID NO: 204293 - DNA, 35 bp, Artificial Sequence
  Synthetic oligonucleotide
gtcggtgtcttaggttccttccggtttttccgact

SEQ ID NO: 204294 - DNA, 37 bp, Artificial Sequence
  Synthetic oligonucleotide
cttcttccactgatctttcatatccagctattgtgca

SEQ ID NO: 204295 - DNA, 35 bp, Artificial Sequence
  Synthetic oligonucleotide
tcaactatgtacatatcggctccatgtaccctgcc

SEQ ID NO: 204296 - DNA, 36 bp, Artificial Sequence
  Synthetic oligonucleotide
tcttgacggcatgcctgccttcctttgctgggactg

SEQ ID NO: 204297 - DNA, 37 bp, Artificial Sequence
  Synthetic oligonucleotide
acatgggcctggatatagggcgattttatctccgtca

SEQ ID NO: 204298 - DNA, 36 bp, Artificial Sequence
  Synthetic oligonucleotide
tcctcgaaggagcgtggcattcgaagcctagattct

SEQ ID NO: 204299 - DNA, 37 bp, Artificial Sequence
  Synthetic oligonucleotide
aatcttgcggtaaagattcgttcactgtaaggtatgt

SEQ ID NO: 204300 - DNA, 36 bp, Artificial Sequence
  Synthetic oligonucleotide
gatgcaatccaatcctgatcttctctgtgatagcca

SEQ ID NO: 204301 - DNA, 36 bp, Artificial Sequence
  Synthetic oligonucleotide
tgcgctctctaccttctaacgcgttgcaggttactt

SEQ ID NO: 204302 - DNA, 37 bp, Artificial Sequence
  Synthetic oligonucleotide
actggagctaagtagtagtcccttgcgatacattcta

SEQ ID NO: 204303 - DNA, 35 bp, Artificial Sequence
  Synthetic oligonucleotide
tccattgaccgtgttcatccaggcgtgtcatggca

SEQ ID NO: 204304 - DNA, 36 bp, Artificial Sequence
  Synthetic oligonucleotide
acgtttgtctcaaatcaccgcggaaccgagagccca

SEQ ID NO: 204305 - DNA, 35 bp, Artificial Sequence
  Synthetic oligonucleotide
ccaccgtcgtcgataaagacatcctagtaagccat

SEQ ID NO: 204306 - DNA, 29 bp, Artificial Sequence
  Synthetic oligonucleotide
accggctagaggtcgtctcccgttcgacc

SEQ ID NO: 204307 - DNA, 37 bp, Artificial Sequence
  Synthetic oligonucleotide
cttaactccggatccagatcgatagatcgctcggtgt

SEQ ID NO: 204308 - DNA, 36 bp, Artificial Sequence
  Synthetic oligonucleotide
aggccgccttgccgtggctaattagtttgactacaa

SEQ ID NO: 204309 - DNA, 37 bp, Artificial Sequence
  Synthetic oligonucleotide
cttttttgcctagaatgccatggattttacgggacca

SEQ ID NO: 204310 - DNA, 36 bp, Artificial Sequence
  Synthetic oligonucleotide
agctgtctggagtcaacccctctttccgtcatggca

SEQ ID NO: 204311 - DNA, 37 bp, Artificial Sequence
  Synthetic oligonucleotide
atacactcattgttgcttccccggcatgtttatgggt

SEQ ID NO: 204312 - DNA, 37 bp, Artificial Sequence
  Synthetic oligonucleotide
gtagcctacgccagttaccgcaatgcgtatttcctca

SEQ ID NO: 204313 - DNA, 35 bp, Artificial Sequence
  Synthetic oligonucleotide
gagtgcttcgtttagcattgaccatctctaccggt

SEQ ID NO: 204314 - DNA, 36 bp, Artificial Sequence
  Synthetic oligonucleotide
cctacatcttggggcacagtgcttttagataagcca

SEQ ID NO: 204315 - DNA, 36 bp, Artificial Sequence
  Synthetic oligonucleotide
gtagccaatcacacatcattggacccccccttcgca

SEQ ID NO: 204316 - DNA, 35 bp, Artificial Sequence
  Synthetic oligonucleotide
tcacggcctatccgacgcaccgacaggtacgctta

SEQ ID NO: 204317 - DNA, 36 bp, Artificial Sequence
  Synthetic oligonucleotide
tgttgtgttacacactcaacggactcccatccggag

SEQ ID NO: 204318 - DNA, 36 bp, Artificial Sequence
  Synthetic oligonucleotide
gcgagtaatctttaacacgagtccattttaaaatca

SEQ ID NO: 204319 - DNA, 37 bp, Artificial Sequence
  Synthetic oligonucleotide
ccgagcgtaccaacgttatccctattgggtatgacca

SEQ ID NO: 204320 - DNA, 35 bp, Artificial Sequence
  Synthetic oligonucleotide
acccgatttcagggagtccctcctgtcataactgg

SEQ ID NO: 204321 - DNA, 35 bp, Artificial Sequence
  Synthetic oligonucleotide
ccttgcgttaggctctgattctcctctagccattg

SEQ ID NO: 204322 - DNA, 36 bp, Artificial Sequence
  Synthetic oligonucleotide
tagatcgtccgttgactactacgtgctcctttgaca

SEQ ID NO: 204323 - DNA, 38 bp, Artificial Sequence
  Synthetic oligonucleotide
catgctgtctatgatggtaatccttgcaatacgtatgt

SEQ ID NO: 204324 - DNA, 37 bp, Artificial Sequence
  Synthetic oligonucleotide
ggtgccaccccactttgaacctctgccttaagtacgg

SEQ ID NO: 204325 - DNA, 36 bp, Artificial Sequence
  Synthetic oligonucleotide
tacgctagctagcttcgccatgtagtgacatggcca

SEQ ID NO: 204326 - DNA, 35 bp, Artificial Sequence
  Synthetic oligonucleotide
caaataacacacatatgtacactgattccctgtcg

SEQ ID NO: 204327 - DNA, 36 bp, Artificial Sequence
  Synthetic oligonucleotide
tcatacgacgttgtacagataggagtgggggactca

SEQ ID NO: 204328 - DNA, 38 bp, Artificial Sequence
  Synthetic oligonucleotide
gcattctaaaacttagcgaacgcacgataagcccgtca

SEQ ID NO: 204329 - DNA, 35 bp, Artificial Sequence
  Synthetic oligonucleotide
acagtatttgagcagatactacgttcctctcaact

SEQ ID NO: 204330 - DNA, 36 bp, Artificial Sequence
  Synthetic oligonucleotide
ggctacaacttttgccggtttataggttaccctcca

SEQ ID NO: 204331 - DNA, 35 bp, Artificial Sequence
  Synthetic oligonucleotide
tctcgatccttctctctaggtcggcccatgcaaag

SEQ ID NO: 204332 - DNA, 35 bp, Artificial Sequence
  Synthetic oligonucleotide
tagccggcgatttacgagggttctcagtcacctct

SEQ ID NO: 204333 - DNA, 38 bp, Artificial Sequence
  Synthetic oligonucleotide
gagagctcgccttatcctgggagtcataaagcacttca

SEQ ID NO: 204334 - DNA, 38 bp, Artificial Sequence
  Synthetic oligonucleotide
tagtcagtcgctgacctcctgtgggctaccgtgcctgt

SEQ ID NO: 204335 - DNA, 35 bp, Artificial Sequence
  Synthetic oligonucleotide
ttatgtattgtaaactccatttcgagcacaagtcg

SEQ ID NO: 204336 - DNA, 35 bp, Artificial Sequence
  Synthetic oligonucleotide
gtcaccgtgggcgacatgctaaattcttctctctt

SEQ ID NO: 204337 - DNA, 36 bp, Artificial Sequence
  Synthetic oligonucleotide
acgcaattgaatccttccggtcgacgccgcactgtg

SEQ ID NO: 204338 - DNA, 38 bp, Artificial Sequence
  Synthetic oligonucleotide
atgttggcctccaattatcactggcaattggtccttca

SEQ ID NO: 204339 - DNA, 35 bp, Artificial Sequence
  Synthetic oligonucleotide
tgttaccagagctatcccggcactatatcaaatct

SEQ ID NO: 204340 - DNA, 35 bp, Artificial Sequence
  Synthetic oligonucleotide
ccctgctcagatctcactcgtacctgctcgccaat

SEQ ID NO: 204341 - DNA, 37 bp, Artificial Sequence
  Synthetic oligonucleotide
cactaagatccccttcaccttcttcactacatgcgca

SEQ ID NO: 204342 - DNA, 35 bp, Artificial Sequence
  Synthetic oligonucleotide
gcgcagtatttctaatgcaaccggtaactatttgt

SEQ ID NO: 204343 - DNA, 35 bp, Artificial Sequence
  Synthetic oligonucleotide
ccaccccctgagttgagaggcactctccgaagctt

SEQ ID NO: 204344 - DNA, 36 bp, Artificial Sequence
  Synthetic oligonucleotide
cctcaccccgattacggaggtttagtcgtgacacga

SEQ ID NO: 204345 - DNA, 35 bp, Artificial Sequence
  Synthetic oligonucleotide
gccctggcaccaaactcgcacaatcaatcgtgtgc

SEQ ID NO: 204346 - DNA, 36 bp, Artificial Sequence
  Synthetic oligonucleotide
ttgatctgagggagcccgctccacccgcccttgaca

SEQ ID NO: 204347 - DNA, 35 bp, Artificial Sequence
  Synthetic oligonucleotide
ggtctaagccgtagctccaatctgagtgccccctc

SEQ ID NO: 204348 - DNA, 38 bp, Artificial Sequence
  Synthetic oligonucleotide
agtctcttctcagccagcatccctcccttctcatctgg

SEQ ID NO: 204349 - DNA, 36 bp, Artificial Sequence
  Synthetic oligonucleotide
catctcagtagtactattactggtccccccgccgaa

SEQ ID NO: 204350 - DNA, 37 bp, Artificial Sequence
  Synthetic oligonucleotide
gactcgcgccagccggaggtgtggcgtacctgcctgt

SEQ ID NO: 204351 - DNA, 37 bp, Artificial Sequence
  Synthetic oligonucleotide
tttacgctggtgagactccttcccggaagtctgttga

SEQ ID NO: 204352 - DNA, 32 bp, Artificial Sequence
  Synthetic oligonucleotide
acgacacccgtttccacctggtgtatccatag

SEQ ID NO: 204353 - DNA, 35 bp, Artificial Sequence
  Synthetic oligonucleotide
attagctgtcttacgcttcagatgtcgattccgcg

SEQ ID NO: 204354 - DNA, 35 bp, Artificial Sequence
  Synthetic oligonucleotide
cccggcgagccacgcgctgtacgagcaagtcacac

SEQ ID NO: 204355 - DNA, 37 bp, Artificial Sequence
  Synthetic oligonucleotide
atttgaggcttcccgtcccgtttttctttaatatgga

SEQ ID NO: 204356 - DNA, 35 bp, Artificial Sequence
  Synthetic oligonucleotide
tgggtctggcatcgagctctattcctttttcacct

SEQ ID NO: 204357 - DNA, 36 bp, Artificial Sequence
  Synthetic oligonucleotide
agtatcagtcgaagcggatattgaccctcctctact

SEQ ID NO: 204358 - DNA, 35 bp, Artificial Sequence
  Synthetic oligonucleotide
ccagtacctgcctcccatcgagtgtgtgattgtct

SEQ ID NO: 204359 - DNA, 36 bp, Artificial Sequence
  Synthetic oligonucleotide
taggtcctgcgattgctatatgctatttaatctact

SEQ ID NO: 204360 - DNA, 35 bp, Artificial Sequence
  Synthetic oligonucleotide
gcgacaaataatcgggtttgctttgtcttgtttct

SEQ ID NO: 204361 - DNA, 37 bp, Artificial Sequence
  Synthetic oligonucleotide
gagtgctagcgcttacgtcctctatctcgtactgact

SEQ ID NO: 204362 - DNA, 35 bp, Artificial Sequence
  Synthetic oligonucleotide
tcgctaaccataggtaggtatccattggctcttag

SEQ ID NO: 204363 - DNA, 36 bp, Artificial Sequence
  Synthetic oligonucleotide
ataccctaaagggtctcctcatcaggtctcgccata

SEQ ID NO: 204364 - DNA, 35 bp, Artificial Sequence
  Synthetic oligonucleotide
agcccacgcgcgcttaatccgattgttatgttgtg

SEQ ID NO: 204365 - DNA, 35 bp, Artificial Sequence
  Synthetic oligonucleotide
aacaacttcggttatctgtgcaagtattcacgcca

SEQ ID NO: 204366 - DNA, 35 bp, Artificial Sequence
  Synthetic oligonucleotide
atgcttccatggatcgttagtatcgtgtgccatca

SEQ ID NO: 204367 - DNA, 35 bp, Artificial Sequence
  Synthetic oligonucleotide
catctttatctgatccttgctctgccacccactcg

SEQ ID NO: 204368 - DNA, 35 bp, Artificial Sequence
  Synthetic oligonucleotide
ggtccgtgcgaactcatcgaacgggaccttagctg

SEQ ID NO: 204369 - DNA, 36 bp, Artificial Sequence
  Synthetic oligonucleotide
tgtctaccctccatcctctatgccgcaagtgcactg

SEQ ID NO: 204370 - DNA, 35 bp, Artificial Sequence
  Synthetic oligonucleotide
atagctcctaccggaaccctagcgctctaccggca

SEQ ID NO: 204371 - DNA, 36 bp, Artificial Sequence
  Synthetic oligonucleotide
cacgcggtggacaaccgcgacgggttcgtcccaatt

SEQ ID NO: 204372 - DNA, 36 bp, Artificial Sequence
  Synthetic oligonucleotide
atcgacagttatcgttcatgtttttgcccccttgga

SEQ ID NO: 204373 - DNA, 35 bp, Artificial Sequence
  Synthetic oligonucleotide
gtgtgaacaagacctcgggtgacctgtgactatcg

SEQ ID NO: 204374 - DNA, 37 bp, Artificial Sequence
  Synthetic oligonucleotide
gcctcgggactccggctatgtgcttcgattcctcaca

SEQ ID NO: 204375 - DNA, 35 bp, Artificial Sequence
  Synthetic oligonucleotide
cgctccaactctccccaaacgggcgacgaccgact

SEQ ID NO: 204376 - DNA, 38 bp, Artificial Sequence
  Synthetic oligonucleotide
taggtagtatcctgctaacgcttgttataatcaactga

SEQ ID NO: 204377 - DNA, 36 bp, Artificial Sequence
  Synthetic oligonucleotide
tgacacatcgtcgcggaaacctagatggttagagaa

SEQ ID NO: 204378 - DNA, 36 bp, Artificial Sequence
  Synthetic oligonucleotide
gtaaaagtttgcatcccacaacctccccattcaagg

SEQ ID NO: 204379 - DNA, 36 bp, Artificial Sequence
  Synthetic oligonucleotide
taaagcgtgcttagtgttattctggtcttcctcatg

SEQ ID NO: 204380 - DNA, 37 bp, Artificial Sequence
  Synthetic oligonucleotide
cccgggaacacgacgctagtattgtttaaatgttcca

SEQ ID NO: 204381 - DNA, 36 bp, Artificial Sequence
  Synthetic oligonucleotide
gttgctccaatctttgccaacgagctctatgtaagt

SEQ ID NO: 204382 - DNA, 38 bp, Artificial Sequence
  Synthetic oligonucleotide
gctcataactcgagcgatcgcctcatgtgacggggtgt

SEQ ID NO: 204383 - DNA, 35 bp, Artificial Sequence
  Synthetic oligonucleotide
cccggcgagccacgggctgtacgagcaagtcatac

SEQ ID NO: 204384 - DNA, 35 bp, Artificial Sequence
  Synthetic oligonucleotide
gtggtcacgtaatgttgagccatatgcctctcata

SEQ ID NO: 204385 - DNA, 34 bp, Artificial Sequence
  Synthetic oligonucleotide
cctagtctttaagggcctttgaccctacgccaca

SEQ ID NO: 204386 - DNA, 35 bp, Artificial Sequence
  Synthetic oligonucleotide
gggggggatgtgggctaaaggttattgtccccttt

SEQ ID NO: 204387 - DNA, 37 bp, Artificial Sequence
  Synthetic oligonucleotide
gcggtctgtgtccgtttaccatttcggcttttatcga

SEQ ID NO: 204388 - DNA, 35 bp, Artificial Sequence
  Synthetic oligonucleotide
accaacatttttcacaggtggaaacaagcccgcct

SEQ ID NO: 204389 - DNA, 36 bp, Artificial Sequence
  Synthetic oligonucleotide
ctaccaactcttcctcgcgctggcccacatatacca

SEQ ID NO: 204390 - DNA, 35 bp, Artificial Sequence
  Synthetic oligonucleotide
gaaccccaaacctccgggtatgagacagcttcgtt

SEQ ID NO: 204391 - DNA, 35 bp, Artificial Sequence
  Synthetic oligonucleotide
tagttcccggaaggctttcataccatgcccagggt

SEQ ID NO: 204392 - DNA, 36 bp, Artificial Sequence
  Synthetic oligonucleotide
acgcacttccttaccttttttggtcttccttgacga

SEQ ID NO: 204393 - DNA, 38 bp, Artificial Sequence
  Synthetic oligonucleotide
atgcccccaagtcgctatttgcattatcgcccgaatca

SEQ ID NO: 204394 - DNA, 38 bp, Artificial Sequence
  Synthetic oligonucleotide
ccagttaactccggggtctacatttacgcataccttca

SEQ ID NO: 204395 - DNA, 30 bp, Artificial Sequence
  Synthetic oligonucleotide
tccactttggatctcaatgggcctggcaca

SEQ ID NO: 204396 - DNA, 35 bp, Artificial Sequence
  Synthetic oligonucleotide
tgcatatctggtacgaccctcagccgttgttcatc

SEQ ID NO: 204397 - DNA, 36 bp, Artificial Sequence
  Synthetic oligonucleotide
gcagtagtgcttttaacaggggttttgtgcgtccaa

SEQ ID NO: 204398 - DNA, 35 bp, Artificial Sequence
  Synthetic oligonucleotide
gacttctatcaggttcggccgtgagaaaccgttct

SEQ ID NO: 204399 - DNA, 35 bp, Artificial Sequence
  Synthetic oligonucleotide
cttccttgaagacctacctcatcaggtaaataata

SEQ ID NO: 204400 - DNA, 35 bp, Artificial Sequence
  Synthetic oligonucleotide
cgccgtaacctccgcttaatcgaccccccattaca

SEQ ID NO: 204401 - DNA, 36 bp, Artificial Sequence
  Synthetic oligonucleotide
gttcatcctgcaaagcacttcatcatctctagtcct

SEQ ID NO: 204402 - DNA, 38 bp, Artificial Sequence
  Synthetic oligonucleotide
tcttccatattagcccgccgatggtagttcaccagtga

SEQ ID NO: 204403 - DNA, 38 bp, Artificial Sequence
  Synthetic oligonucleotide
aattcgtcactcgttgtgtgtagacggtgcccaattga

SEQ ID NO: 204404 - DNA, 38 bp, Artificial Sequence
  Synthetic oligonucleotide
cattacttaaggtcaatgcgcttctcacttatccttca

SEQ ID NO: 204405 - DNA, 36 bp, Artificial Sequence
  Synthetic oligonucleotide
tatcttcggcgcaactattctggaggttaacaagaa

SEQ ID NO: 204406 - DNA, 36 bp, Artificial Sequence
  Synthetic oligonucleotide
tcttgttagcgtggcctaactaaaggttgaaggatt

SEQ ID NO: 204407 - DNA, 36 bp, Artificial Sequence
  Synthetic oligonucleotide
tctgttccgcctaagacatcatatgactacgcccat

SEQ ID NO: 204408 - DNA, 36 bp, Artificial Sequence
  Synthetic oligonucleotide
cgcggaacacgaaccggagctcgctatactaaactt

SEQ ID NO: 204409 - DNA, 31 bp, Artificial Sequence
  Synthetic oligonucleotide
ttgcgttgcagtctactaccttgtcattccg

SEQ ID NO: 204410 - DNA, 35 bp, Artificial Sequence
  Synthetic oligonucleotide
aaatcgcgaccgggacagttccgatatttttcagg

SEQ ID NO: 204411 - DNA, 35 bp, Artificial Sequence
  Synthetic oligonucleotide
tctctcgctcactcgtatcgcctgctaaacatgtg

SEQ ID NO: 204412 - DNA, 36 bp, Artificial Sequence
  Synthetic oligonucleotide
ttatgaatatatggtcaattctcggtcggacagtca

SEQ ID NO: 204413 - DNA, 35 bp, Artificial Sequence
  Synthetic oligonucleotide
agtatgcttagctccttatgttaccgatccacgct

SEQ ID NO: 204414 - DNA, 35 bp, Artificial Sequence
  Synthetic oligonucleotide
gtctcagtgatctatctttggtccctcatcgcttc

SEQ ID NO: 204415 - DNA, 36 bp, Artificial Sequence
  Synthetic oligonucleotide
gtgatacagcccgtacattacagcgctcgacgtcca

SEQ ID NO: 204416 - DNA, 37 bp, Artificial Sequence
  Synthetic oligonucleotide
actccatcggtctttaatcctatgtcgggccttttca

SEQ ID NO: 204417 - DNA, 36 bp, Artificial Sequence
  Synthetic oligonucleotide
catacccgccccggttaaggggccctgctttcgcca

SEQ ID NO: 204418 - DNA, 35 bp, Artificial Sequence
  Synthetic oligonucleotide
cgttgattagttcttaatgctacctcaacgtcaat

SEQ ID NO: 204419 - DNA, 35 bp, Artificial Sequence
  Synthetic oligonucleotide
ccggttcaggcctcacgcgacgttcccttactcct

SEQ ID NO: 204420 - DNA, 38 bp, Artificial Sequence
  Synthetic oligonucleotide
gcggaaatacgcagaaggccccccacatagtgccctgg

SEQ ID NO: 204421 - DNA, 38 bp, Artificial Sequence
  Synthetic oligonucleotide
aattcgtcactcgttgtgtgtagccggtgctcaattga

SEQ ID NO: 204422 - DNA, 25 bp, Artificial Sequence
  Synthetic oligonucleotide
tccctcaaaaaggtctctagcatca

SEQ ID NO: 204423 - DNA, 35 bp, Artificial Sequence
  Synthetic oligonucleotide
gaccatagcaaaattaacacctggttagcttttct

SEQ ID NO: 204424 - DNA, 37 bp, Artificial Sequence
  Synthetic oligonucleotide
gtctcggccattctaaccgttactttgaggggaccca

SEQ ID NO: 204425 - DNA, 35 bp, Artificial Sequence
  Synthetic oligonucleotide
gcgtcgtcaagcccgggctctcccccatcgcctat

SEQ ID NO: 204426 - DNA, 36 bp, Artificial Sequence
  Synthetic oligonucleotide
gattggggatttgtgcgaggatgatgctaggtgtca

SEQ ID NO: 204427 - DNA, 35 bp, Artificial Sequence
  Synthetic oligonucleotide
gcttgacaggtgaataccgccttcgccttacttgt

SEQ ID NO: 204428 - DNA, 36 bp, Artificial Sequence
  Synthetic oligonucleotide
gggtcgcaacactccatccatgtaggtcctaaatca

SEQ ID NO: 204429 - DNA, 36 bp, Artificial Sequence
  Synthetic oligonucleotide
catccgcacaacccaatgaatatatcgcgccacgca

SEQ ID NO: 204430 - DNA, 35 bp, Artificial Sequence
  Synthetic oligonucleotide
tgcgaattgcaagtctaacgtagctgcacttcctc

SEQ ID NO: 204431 - DNA, 35 bp, Artificial Sequence
  Synthetic oligonucleotide
tgcccgctagcaaagagtccctaactgagtaatct

SEQ ID NO: 204432 - DNA, 37 bp, Artificial Sequence
  Synthetic oligonucleotide
atggcttcgacgtcctcatctagacctatcctcctga

SEQ ID NO: 204433 - DNA, 36 bp, Artificial Sequence
  Synthetic oligonucleotide
gttacgctcggcacccggcttcaccttggcctgtta

SEQ ID NO: 204434 - DNA, 36 bp, Artificial Sequence
  Synthetic oligonucleotide
tagttgcatgttaaacggactgagttatgcgtctat

SEQ ID NO: 204435 - DNA, 35 bp, Artificial Sequence
  Synthetic oligonucleotide
ttcgcgtatcattccccgtcataggcctgttttca

SEQ ID NO: 204436 - DNA, 36 bp, Artificial Sequence
  Synthetic oligonucleotide
tcgctacaggcgaccatgagcctggtagccgaaaag

SEQ ID NO: 204437 - DNA, 35 bp, Artificial Sequence
  Synthetic oligonucleotide
gttcgctatgcaacccgcgggactctgcctcctgt

SEQ ID NO: 204438 - DNA, 36 bp, Artificial Sequence
  Synthetic oligonucleotide
cggacgtccctaccgtatccccacacttctagccgt

SEQ ID NO: 204439 - DNA, 37 bp, Artificial Sequence
  Synthetic oligonucleotide
actgggtccccgatataacgataatatgctctgttca

SEQ ID NO: 204440 - DNA, 37 bp, Artificial Sequence
  Synthetic oligonucleotide
atggctccaaccggacacaatgtatgttgcctggtta

SEQ ID NO: 204441 - DNA, 35 bp, Artificial Sequence
  Synthetic oligonucleotide
caaccgggaatcatatatgtgcgtccatgtcctct

SEQ ID NO: 204442 - DNA, 35 bp, Artificial Sequence
  Synthetic oligonucleotide
ttcaaccccaagcgccgtccttgacacgagcaacg

SEQ ID NO: 204443 - DNA, 35 bp, Artificial Sequence
  Synthetic oligonucleotide
gttctcattgcacggaacctgacgagtttgttgat

SEQ ID NO: 204444 - DNA, 38 bp, Artificial Sequence
  Synthetic oligonucleotide
atcaagagagaaatgacgcgtccggaactcctacttca

SEQ ID NO: 204445 - DNA, 37 bp, Artificial Sequence
  Synthetic oligonucleotide
gtctgtagctgtccttcatccaccacctctcactaga

SEQ ID NO: 204446 - DNA, 38 bp, Artificial Sequence
  Synthetic oligonucleotide
accaagcgaatattttggctaggggtttcctaccatga

SEQ ID NO: 204447 - DNA, 36 bp, Artificial Sequence
  Synthetic oligonucleotide
cgttccgcgattagaccggggtaggtctcctctgca

SEQ ID NO: 204448 - DNA, 36 bp, Artificial Sequence
  Synthetic oligonucleotide
tctgagattactttcttggattggttatcttgtgca

SEQ ID NO: 204449 - DNA, 35 bp, Artificial Sequence
  Synthetic oligonucleotide
gcctacccgcggcttactgagcaaccatcggctct

SEQ ID NO: 204450 - DNA, 35 bp, Artificial Sequence
  Synthetic oligonucleotide
gagtatagtcggtttggtagatcttacatcgtgcc

SEQ ID NO: 204451 - DNA, 37 bp, Artificial Sequence
  Synthetic oligonucleotide
gtgtcactggagtgtctgccgtcttgttctcgctgga

SEQ ID NO: 204452 - DNA, 35 bp, Artificial Sequence
  Synthetic oligonucleotide
cagtcgccgtcgtgccttagttcgcccatgattat

SEQ ID NO: 204453 - DNA, 35 bp, Artificial Sequence
  Synthetic oligonucleotide
ctttgtaacgacgaccttaatctcctggacttcag

SEQ ID NO: 204454 - DNA, 37 bp, Artificial Sequence
  Synthetic oligonucleotide
gtaactgctgcttgataagtgggtctcttaattctgt

SEQ ID NO: 204455 - DNA, 37 bp, Artificial Sequence
  Synthetic oligonucleotide
tccggccgcctacgttcgaaccgttatacggtattca

SEQ ID NO: 204456 - DNA, 36 bp, Artificial Sequence
  Synthetic oligonucleotide
ggggttacaatttacagccacccgtcgcgttccggt

SEQ ID NO: 204457 - DNA, 35 bp, Artificial Sequence
  Synthetic oligonucleotide
agactgcggtttctggacgaccatctcatgccagg

SEQ ID NO: 204458 - DNA, 36 bp, Artificial Sequence
  Synthetic oligonucleotide
tgtaccgtcccgcgatgcaacactcatgtcatccca

SEQ ID NO: 204459 - DNA, 35 bp, Artificial Sequence
  Synthetic oligonucleotide
tgtaatggcgtgtttaaagcactgcatagctttgt

SEQ ID NO: 204460 - DNA, 35 bp, Artificial Sequence
  Synthetic oligonucleotide
gttgccggggggaatcattcgaatacacattgaat

SEQ ID NO: 204461 - DNA, 36 bp, Artificial Sequence
  Synthetic oligonucleotide
ccctcctaccttcaaattacggacagggcttgacca

SEQ ID NO: 204462 - DNA, 36 bp, Artificial Sequence
  Synthetic oligonucleotide
tgctacgtcgcacttgctcgtcacctgacttgggaa

SEQ ID NO: 204463 - DNA, 38 bp, Artificial Sequence
  Synthetic oligonucleotide
tgccagaagtctcatagttacggccagtcctgtcttca

SEQ ID NO: 204464 - DNA, 35 bp, Artificial Sequence
  Synthetic oligonucleotide
cccggcgagccaagggctgtacgagcaagtcacac

SEQ ID NO: 204465 - DNA, 36 bp, Artificial Sequence
  Synthetic oligonucleotide
gttgcaggtcgcgctgactatgcatgggtgtttata

SEQ ID NO: 204466 - DNA, 35 bp, Artificial Sequence
  Synthetic oligonucleotide
gtacatggacacgtatcggacctatgcttaacgct

SEQ ID NO: 204467 - DNA, 35 bp, Artificial Sequence
  Synthetic oligonucleotide
tcaacgagagatcagataccttgttcatgtaccct

SEQ ID NO: 204468 - DNA, 35 bp, Artificial Sequence
  Synthetic oligonucleotide
gactcacgctctgcgcacctgccgcacttatagca

SEQ ID NO: 204469 - DNA, 35 bp, Artificial Sequence
  Synthetic oligonucleotide
tgcatccggtgtagtaattaatttggttaattgct

SEQ ID NO: 204470 - DNA, 36 bp, Artificial Sequence
  Synthetic oligonucleotide
ctcatatcggcctgttgagtattccataacaacgtt

SEQ ID NO: 204471 - DNA, 35 bp, Artificial Sequence
  Synthetic oligonucleotide
tctctcatagatcacgctttctgcaaaagagtgct

SEQ ID NO: 204472 - DNA, 38 bp, Artificial Sequence
  Synthetic oligonucleotide
catttgctcgttacccgaggtatctttacgtaacctca

SEQ ID NO: 204473 - DNA, 38 bp, Artificial Sequence
  Synthetic oligonucleotide
tgcgctattggagcttaacgaccttacattttgcttca

SEQ ID NO: 204474 - DNA, 37 bp, Artificial Sequence
  Synthetic oligonucleotide
gcaacactttagtcccgattattcacgtttgtgatgt

SEQ ID NO: 204475 - DNA, 35 bp, Artificial Sequence
  Synthetic oligonucleotide
tcaacgccagacgttccccatccttttctatagcg

SEQ ID NO: 204476 - DNA, 35 bp, Artificial Sequence
  Synthetic oligonucleotide
tgctatgggatcaccccccttatctattggcgcag

SEQ ID NO: 204477 - DNA, 35 bp, Artificial Sequence
  Synthetic oligonucleotide
gcgtgttgttgtgctgtctctgcgaggcgactgcc

SEQ ID NO: 204478 - DNA, 37 bp, Artificial Sequence
  Synthetic oligonucleotide
atccggacgtgcccgcgaggttatggatcccgcatca

SEQ ID NO: 204479 - DNA, 36 bp, Artificial Sequence
  Synthetic oligonucleotide
cgctgccagttcaatcacctgatgtaatggctccta

SEQ ID NO: 204480 - DNA, 35 bp, Artificial Sequence
  Synthetic oligonucleotide
cctttacgaagcacttcataatccgtttcacgact

SEQ ID NO: 204481 - DNA, 38 bp, Artificial Sequence
  Synthetic oligonucleotide
aggggataacctgtcactcacatgacatacaatcctgt

SEQ ID NO: 204482 - DNA, 34 bp, Artificial Sequence
  Synthetic oligonucleotide
agtgggttgtcgttcaacacactttaatagcccc

SEQ ID NO: 204483 - DNA, 38 bp, Artificial Sequence
  Synthetic oligonucleotide
tgcacgtcgtccctggatggctttttcacgtttcttca

SEQ ID NO: 204484 - DNA, 36 bp, Artificial Sequence
  Synthetic oligonucleotide
gacgcggtattcgtcacttcgctttgttatccacgg

SEQ ID NO: 204485 - DNA, 37 bp, Artificial Sequence
  Synthetic oligonucleotide
tgcacactatcgcgaactatttcttcaggcattatgt

SEQ ID NO: 204486 - DNA, 36 bp, Artificial Sequence
  Synthetic oligonucleotide
gcgcccagtattcggattcgttatgcgacttgccaa

SEQ ID NO: 204487 - DNA, 35 bp, Artificial Sequence
  Synthetic oligonucleotide
ttctgaacgttcttgtgccctgccttatgggtgct

SEQ ID NO: 204488 - DNA, 35 bp, Artificial Sequence
  Synthetic oligonucleotide
tctgcaaccaatcaatgacgtctagcttacctcaa

SEQ ID NO: 204489 - DNA, 36 bp, Artificial Sequence
  Synthetic oligonucleotide
tctatgccttccacccaacgactcctcggtgctgaa

SEQ ID NO: 204490 - DNA, 35 bp, Artificial Sequence
  Synthetic oligonucleotide
tcaagtgcatcaagcacaaacctcacgggtatacc

SEQ ID NO: 204491 - DNA, 35 bp, Artificial Sequence
  Synthetic oligonucleotide
ttagttcgattgtgttaaaatggcctcccaccaaa

SEQ ID NO: 204492 - DNA, 37 bp, Artificial Sequence
  Synthetic oligonucleotide
gcaatgtctcccggaaagggtctctcagcccgcgagt

SEQ ID NO: 204493 - DNA, 35 bp, Artificial Sequence
  Synthetic oligonucleotide
atgactgacatgtaaagcgcgccttcatcatttac

SEQ ID NO: 204494 - DNA, 38 bp, Artificial Sequence
  Synthetic oligonucleotide
ggccttggtttgagtcgcgccgcaatcgtaccctctga

SEQ ID NO: 204495 - DNA, 35 bp, Artificial Sequence
  Synthetic oligonucleotide
ccgcccgcttccgacaattcaccgtttttttctaa

SEQ ID NO: 204496 - DNA, 36 bp, Artificial Sequence
  Synthetic oligonucleotide
ttgacttagaagcactttcgtcttttccaatcgaca

SEQ ID NO: 204497 - DNA, 35 bp, Artificial Sequence
  Synthetic oligonucleotide
agcctaggcgcgcaaccatcatccgttatggctca

SEQ ID NO: 204498 - DNA, 35 bp, Artificial Sequence
  Synthetic oligonucleotide
taatgtatttgtcttatctcagccaattgtagcaa

SEQ ID NO: 204499 - DNA, 36 bp, Artificial Sequence
  Synthetic oligonucleotide
gaatggtcaagtattgcatgccagggcccccctcct

SEQ ID NO: 204500 - DNA, 37 bp, Artificial Sequence
  Synthetic oligonucleotide
tggttccttatctgcttctccggcctccccagtatca

SEQ ID NO: 204501 - DNA, 37 bp, Artificial Sequence
  Synthetic oligonucleotide
tatggcgggctattagtatctgctataacgcctttga

SEQ ID NO: 204502 - DNA, 36 bp, Artificial Sequence
  Synthetic oligonucleotide
tgccatgtaactgttcttagtccttgatatcatgaa

SEQ ID NO: 204503 - DNA, 36 bp, Artificial Sequence
  Synthetic oligonucleotide
atgccaggctagaaagtcacctaattctatgttgca

SEQ ID NO: 204504 - DNA, 35 bp, Artificial Sequence
  Synthetic oligonucleotide
ttctgatatgaataaataaccgtatccgcccatag

SEQ ID NO: 204505 - DNA, 35 bp, Artificial Sequence
  Synthetic oligonucleotide
ccggttcaggcctcacgcgacgttcccgtactccc

SEQ ID NO: 204506 - DNA, 37 bp, Artificial Sequence
  Synthetic oligonucleotide
gctatgggtaccctgagctatgtggctcagttttcgt

SEQ ID NO: 204507 - DNA, 35 bp, Artificial Sequence
  Synthetic oligonucleotide
tacccatctgtaaggagtgtctcccacgagttaag

SEQ ID NO: 204508 - DNA, 35 bp, Artificial Sequence
  Synthetic oligonucleotide
atagcgtccgcagcatgaaccgcatctcgtgtcct

SEQ ID NO: 204509 - DNA, 38 bp, Artificial Sequence
  Synthetic oligonucleotide
tcctgtaattgcgaaatggagcctgacgtgtctcttca

SEQ ID NO: 204510 - DNA, 38 bp, Artificial Sequence
  Synthetic oligonucleotide
tgttcttagctccctacttcttcttttagtcgttctgt

SEQ ID NO: 204511 - DNA, 37 bp, Artificial Sequence
  Synthetic oligonucleotide
acagcaacttggtgctgtacgaaccctcactccgtgg

SEQ ID NO: 204512 - DNA, 35 bp, Artificial Sequence
  Synthetic oligonucleotide
gttgcctgctccgacggatctaagacccgctcttc

SEQ ID NO: 204513 - DNA, 37 bp, Artificial Sequence
  Synthetic oligonucleotide
cctactgatcacactagttgtctaatcataacaccca

SEQ ID NO: 204514 - DNA, 37 bp, Artificial Sequence
  Synthetic oligonucleotide
taagtagcccgtgcctgtgtttcttcctgttaacgca

SEQ ID NO: 204515 - DNA, 35 bp, Artificial Sequence
  Synthetic oligonucleotide
ctcaccaccttttttaccatcgaactgctcctgga

SEQ ID NO: 204516 - DNA, 35 bp, Artificial Sequence
  Synthetic oligonucleotide
ttttcgatgcccctctccgagtgactcaaggtgat

SEQ ID NO: 204517 - DNA, 35 bp, Artificial Sequence
  Synthetic oligonucleotide
tctgccgtctcatgccacatcgacacgtacgcccc

SEQ ID NO: 204518 - DNA, 29 bp, Artificial Sequence
  Synthetic oligonucleotide
gcttgtctacattgcgttgcggtctaccc

SEQ ID NO: 204519 - DNA, 35 bp, Artificial Sequence
  Synthetic oligonucleotide
gctgagtcgatttatgtcgaatctggtcgctttcg

SEQ ID NO: 204520 - DNA, 35 bp, Artificial Sequence
  Synthetic oligonucleotide
gactcgtccaacttataacgtctttacctgtggcc

SEQ ID NO: 204521 - DNA, 35 bp, Artificial Sequence
  Synthetic oligonucleotide
tcgaaacgagtttatttccgtcgcctatccgtccc

SEQ ID NO: 204522 - DNA, 37 bp, Artificial Sequence
  Synthetic oligonucleotide
agcccggtctaatcgaacaacagcaaaactacgggca

SEQ ID NO: 204523 - DNA, 35 bp, Artificial Sequence
  Synthetic oligonucleotide
ctctatggtgccgaaattaaaattggtgccttaac

SEQ ID NO: 204524 - DNA, 35 bp, Artificial Sequence
  Synthetic oligonucleotide
tcacgtcctatccgacgcaccgacaggtacgcttg

SEQ ID NO: 204525 - DNA, 36 bp, Artificial Sequence
  Synthetic oligonucleotide
atttgccgccggggcaaaccgccctgttgtcccatg

SEQ ID NO: 204526 - DNA, 36 bp, Artificial Sequence
  Synthetic oligonucleotide
gacgaccagggtgagcctgcgttcattgggtatgca

SEQ ID NO: 204527 - DNA, 37 bp, Artificial Sequence
  Synthetic oligonucleotide
cttaactccggatccagatcgatagatcgctcggtca

SEQ ID NO: 204528 - DNA, 35 bp, Artificial Sequence
  Synthetic oligonucleotide
tagtcgcttgacccatcttctgcatcatgtatccc

SEQ ID NO: 204529 - DNA, 35 bp, Artificial Sequence
  Synthetic oligonucleotide
acctacctgcggaatcaaagaacatgcacaaaggt

SEQ ID NO: 204530 - DNA, 36 bp, Artificial Sequence
  Synthetic oligonucleotide
gctcgctcaacctcggtggtatcaaattcggttctt

SEQ ID NO: 204531 - DNA, 37 bp, Artificial Sequence
  Synthetic oligonucleotide
gccgtcatttattactttggtaatctctatacctcga

SEQ ID NO: 204532 - DNA, 35 bp, Artificial Sequence
  Synthetic oligonucleotide
gtcgtcgatttaccatcttctaacaccaatgtcag

SEQ ID NO: 204533 - DNA, 38 bp, Artificial Sequence
  Synthetic oligonucleotide
ttctggacaaccacatccttcactgcttaatgctctca

SEQ ID NO: 204534 - DNA, 36 bp, Artificial Sequence
  Synthetic oligonucleotide
gccgcgttgggcacggccactcacaatcagtataat

SEQ ID NO: 204535 - DNA, 38 bp, Artificial Sequence
  Synthetic oligonucleotide
tactcgaagtttaatgcactttcggtccctctccagca

SEQ ID NO: 204536 - DNA, 36 bp, Artificial Sequence
  Synthetic oligonucleotide
ggtacgatacccatttcttggttgaaggggtctcgt

SEQ ID NO: 204537 - DNA, 36 bp, Artificial Sequence
  Synthetic oligonucleotide
cgtcacggtcgatcactcccgtcacgctatctctca

SEQ ID NO: 204538 - DNA, 37 bp, Artificial Sequence
  Synthetic oligonucleotide
atctgagttgttcatcatgtacgcctctcttgtgtga

SEQ ID NO: 204539 - DNA, 37 bp, Artificial Sequence
  Synthetic oligonucleotide
gcgtacagtcccgtctaccgagtctcattgtgatcca

SEQ ID NO: 204540 - DNA, 35 bp, Artificial Sequence
  Synthetic oligonucleotide
gctccaacttgctgccagaataaatgctaactgcc

SEQ ID NO: 204541 - DNA, 35 bp, Artificial Sequence
  Synthetic oligonucleotide
ttgatgcgatacccgtaccccgtcgttagttgcct

SEQ ID NO: 204542 - DNA, 37 bp, Artificial Sequence
  Synthetic oligonucleotide
gacatccgggttgcaccgcatcggccactccacactt

SEQ ID NO: 204543 - DNA, 35 bp, Artificial Sequence
  Synthetic oligonucleotide
tgtcatctcaccttacagatggatttcgtgcaact

SEQ ID NO: 204544 - DNA, 35 bp, Artificial Sequence
  Synthetic oligonucleotide
ctcatctacatcgaactctattttagtttagtgct

SEQ ID NO: 204545 - DNA, 35 bp, Artificial Sequence
  Synthetic oligonucleotide
ggtttaactggttatgcttttcatagggaccccaa

SEQ ID NO: 204546 - DNA, 38 bp, Artificial Sequence
  Synthetic oligonucleotide
aactgtaccggggctccttgctgatcaccgcttaatga

SEQ ID NO: 204547 - DNA, 33 bp, Artificial Sequence
  Synthetic oligonucleotide
gctcgcgccctacagtgctatctactagcgtct

SEQ ID NO: 204548 - DNA, 36 bp, Artificial Sequence
  Synthetic oligonucleotide
cgtcttattcttggacggcccctgactgtatgggaa

SEQ ID NO: 204549 - DNA, 35 bp, Artificial Sequence
  Synthetic oligonucleotide
gactaagttcatcaagccccataatgtggggtcaa

SEQ ID NO: 204550 - DNA, 34 bp, Artificial Sequence
  Synthetic oligonucleotide
gcggctcacctgagttacaaacccgattttgact

SEQ ID NO: 204551 - DNA, 35 bp, Artificial Sequence
  Synthetic oligonucleotide
cccattgcaggccttcgtatgcaaccactctggcc

SEQ ID NO: 204552 - DNA, 36 bp, Artificial Sequence
  Synthetic oligonucleotide
tgttgatccggggggggacgataaatcctgcacaac

SEQ ID NO: 204553 - DNA, 28 bp, Artificial Sequence
  Synthetic oligonucleotide
aatgccgcgacgtatggaaggttactca

SEQ ID NO: 204554 - DNA, 35 bp, Artificial Sequence
  Synthetic oligonucleotide
gtcgcaaaaatggcttgcgacattgctgcgtactt

SEQ ID NO: 204555 - DNA, 35 bp, Artificial Sequence
  Synthetic oligonucleotide
cgccaggatcttgggggcaacttttccgtaggcta

SEQ ID NO: 204556 - DNA, 34 bp, Artificial Sequence
  Synthetic oligonucleotide
tgcctccattctttttgtatattaacacgtgcct

SEQ ID NO: 204557 - DNA, 38 bp, Artificial Sequence
  Synthetic oligonucleotide
agggcctaaacggttatgtaggattaggtttgggttca

SEQ ID NO: 204558 - DNA, 35 bp, Artificial Sequence
  Synthetic oligonucleotide
gaccccatcgaccttggaatttacatcgcttagac

SEQ ID NO: 204559 - DNA, 36 bp, Artificial Sequence
  Synthetic oligonucleotide
aagcctaacattacgttatcgggctccctggctaca

SEQ ID NO: 204560 - DNA, 35 bp, Artificial Sequence
  Synthetic oligonucleotide
gcgcatgcgacaccccctgaaatgtcaccatatca

SEQ ID NO: 204561 - DNA, 33 bp, Artificial Sequence
  Synthetic oligonucleotide
acctatcttccaactggattcacatgactacct

SEQ ID NO: 204562 - DNA, 35 bp, Artificial Sequence
  Synthetic oligonucleotide
aggcacactggttcatttggtccttgttctttcgt

SEQ ID NO: 204563 - DNA, 36 bp, Artificial Sequence
  Synthetic oligonucleotide
ccctttgcacagggtccccgggaggacttggagaca

SEQ ID NO: 204564 - DNA, 36 bp, Artificial Sequence
  Synthetic oligonucleotide
ttatcttaggtgtattgttaaccaccgcatatctca

SEQ ID NO: 204565 - DNA, 36 bp, Artificial Sequence
  Synthetic oligonucleotide
ggtcatcttcgttcccacagttttacgtgggaacca

SEQ ID NO: 204566 - DNA, 38 bp, Artificial Sequence
  Synthetic oligonucleotide
gctttccaatgttgggtggcaacaccgcccgcttttta

SEQ ID NO: 204567 - DNA, 35 bp, Artificial Sequence
  Synthetic oligonucleotide
gtctattgtcgtagtattcttcctacgctgcctgt

SEQ ID NO: 204568 - DNA, 35 bp, Artificial Sequence
  Synthetic oligonucleotide
atcccccgcctcccctggtggacgcttttagctac

SEQ ID NO: 204569 - DNA, 36 bp, Artificial Sequence
  Synthetic oligonucleotide
ggcctgaccccacactcctttataggttaaccaggt

SEQ ID NO: 204570 - DNA, 35 bp, Artificial Sequence
  Synthetic oligonucleotide
cgttactcccggagctagtggtctgtgacgataac

SEQ ID NO: 204571 - DNA, 35 bp, Artificial Sequence
  Synthetic oligonucleotide
cccggcgagcctcgggctgtacgagcaagtcacac

SEQ ID NO: 204572 - DNA, 36 bp, Artificial Sequence
  Synthetic oligonucleotide
gatatcttacgacttaagaggacgccactattcagg

SEQ ID NO: 204573 - DNA, 36 bp, Artificial Sequence
  Synthetic oligonucleotide
actaccctgtttgtatacaggtctttctaacaatgt

SEQ ID NO: 204574 - DNA, 36 bp, Artificial Sequence
  Synthetic oligonucleotide
gaacgagtacgttttcgccctcttattcggagtttg

SEQ ID NO: 204575 - DNA, 37 bp, Artificial Sequence
  Synthetic oligonucleotide
tcgcctccgcccttttatgccaccgcaaataagtgta

SEQ ID NO: 204576 - DNA, 37 bp, Artificial Sequence
  Synthetic oligonucleotide
agtgactgtaccctaatcgcttgcccgctagctgtca

SEQ ID NO: 204577 - DNA, 36 bp, Artificial Sequence
  Synthetic oligonucleotide
tgtcaattcgcccattagtcttcaactaagagacga

SEQ ID NO: 204578 - DNA, 35 bp, Artificial Sequence
  Synthetic oligonucleotide
acctaccacccgcaatgttgcggtgttgtctatcg

SEQ ID NO: 204579 - DNA, 38 bp, Artificial Sequence
  Synthetic oligonucleotide
gtactgctggtgcttatcccctgggctagttttcttca

SEQ ID NO: 204580 - DNA, 36 bp, Artificial Sequence
  Synthetic oligonucleotide
tcctgggtttgtccgtattagctatcattggtggca

SEQ ID NO: 204581 - DNA, 36 bp, Artificial Sequence
  Synthetic oligonucleotide
gccatcggtagttctatgttatcagttcacttccaa

SEQ ID NO: 204582 - DNA, 38 bp, Artificial Sequence
  Synthetic oligonucleotide
tttcaggacgtttacccttgtcacggtgtttgacttga

SEQ ID NO: 204583 - DNA, 35 bp, Artificial Sequence
  Synthetic oligonucleotide
ggcaccacgttttttgattgcctatcctaggggag

SEQ ID NO: 204584 - DNA, 38 bp, Artificial Sequence
  Synthetic oligonucleotide
gggggtttggccgagcccttagtggctccataatatca

SEQ ID NO: 204585 - DNA, 37 bp, Artificial Sequence
  Synthetic oligonucleotide
ggcgacacgggggcctgttgttgaagtaaccatctca

SEQ ID NO: 204586 - DNA, 37 bp, Artificial Sequence
  Synthetic oligonucleotide
tgaaaagctcaagctttattgtgcgggttatcgctga

SEQ ID NO: 204587 - DNA, 35 bp, Artificial Sequence
  Synthetic oligonucleotide
tcctcgaaaagtaatgggtctgcactgggtcttaa

SEQ ID NO: 204588 - DNA, 35 bp, Artificial Sequence
  Synthetic oligonucleotide
ttacggatttacgtgcatgctctctccgtccttct

SEQ ID NO: 204589 - DNA, 35 bp, Artificial Sequence
  Synthetic oligonucleotide
gcttatacgttacctctatacatgtgcgccttccc

SEQ ID NO: 204590 - DNA, 35 bp, Artificial Sequence
  Synthetic oligonucleotide
attgattaatacgccggtttgattacgacctatgt

SEQ ID NO: 204591 - DNA, 36 bp, Artificial Sequence
  Synthetic oligonucleotide
ttctaccgccatacaacagattcatcgtagcgcaca

SEQ ID NO: 204592 - DNA, 36 bp, Artificial Sequence
  Synthetic oligonucleotide
gccacaaatgtcgttgttaacaggttgatccgggca

SEQ ID NO: 204593 - DNA, 35 bp, Artificial Sequence
  Synthetic oligonucleotide
catgtcgagggtctcatcttccggtgttgcttcag

SEQ ID NO: 204594 - DNA, 38 bp, Artificial Sequence
  Synthetic oligonucleotide
gcttttgcgacacattgtcaggcgtgggctccacgtca

SEQ ID NO: 204595 - DNA, 35 bp, Artificial Sequence
  Synthetic oligonucleotide
tggctgttcccatttcaattgttccctcccgtcca

SEQ ID NO: 204596 - DNA, 35 bp, Artificial Sequence
  Synthetic oligonucleotide
ccatcaatctggcttagttaccctgattagcgagt

SEQ ID NO: 204597 - DNA, 35 bp, Artificial Sequence
  Synthetic oligonucleotide
gcatgtcgccccggccgcctaacatgtctgcctct

SEQ ID NO: 204598 - DNA, 35 bp, Artificial Sequence
  Synthetic oligonucleotide
ggattccctcatgagctttttgcaagcccatggtt

SEQ ID NO: 204599 - DNA, 35 bp, Artificial Sequence
  Synthetic oligonucleotide
cgtcaatcccttcttttgctgctatgagactaact

SEQ ID NO: 204600 - DNA, 35 bp, Artificial Sequence
  Synthetic oligonucleotide
tgtcaccgtttagctcccagaagccgacctgagcg

SEQ ID NO: 204601 - DNA, 36 bp, Artificial Sequence
  Synthetic oligonucleotide
cgagcttcatcttatatcgttttgggacggttcgct

SEQ ID NO: 204602 - DNA, 36 bp, Artificial Sequence
  Synthetic oligonucleotide
atctcatcttcatcagattcaaatgagccggcgcaa

SEQ ID NO: 204603 - DNA, 35 bp, Artificial Sequence
  Synthetic oligonucleotide
tactgcatgctagttaactaaacaagcaccgacat

SEQ ID NO: 204604 - DNA, 38 bp, Artificial Sequence
  Synthetic oligonucleotide
acgcttgctttaccccacgccatgcgacgcgtgggtgg

SEQ ID NO: 204605 - DNA, 35 bp, Artificial Sequence
  Synthetic oligonucleotide
gctgggctaatccccttttttagtttttactatcc

SEQ ID NO: 204606 - DNA, 35 bp, Artificial Sequence
  Synthetic oligonucleotide
tattcactcttggtctgtctgaggtcaactcaggg

SEQ ID NO: 204607 - DNA, 38 bp, Artificial Sequence
  Synthetic oligonucleotide
gcggatttcgctgtctctagagacctctcagctattca

SEQ ID NO: 204608 - DNA, 38 bp, Artificial Sequence
  Synthetic oligonucleotide
gagggtcggtctcttggtcttctggaaggttgtactca

SEQ ID NO: 204609 - DNA, 35 bp, Artificial Sequence
  Synthetic oligonucleotide
atcataccggacgtctacttcattttcttcccact

SEQ ID NO: 204610 - DNA, 37 bp, Artificial Sequence
  Synthetic oligonucleotide
ggttctttcatcgagccatgggttgtatccgccacga

SEQ ID NO: 204611 - DNA, 35 bp, Artificial Sequence
  Synthetic oligonucleotide
agcagtatagaagatttcacaccctcgccaaagcc

SEQ ID NO: 204612 - DNA, 35 bp, Artificial Sequence
  Synthetic oligonucleotide
gtcagaatacaaagtagcctcatgaaaaccatatg

SEQ ID NO: 204613 - DNA, 35 bp, Artificial Sequence
  Synthetic oligonucleotide
acgtaatctctagtgcgtggtaccttttcagcaag

SEQ ID NO: 204614 - DNA, 35 bp, Artificial Sequence
  Synthetic oligonucleotide
tggacttctcctccttcttccttatgcatggacgt

SEQ ID NO: 204615 - DNA, 37 bp, Artificial Sequence
  Synthetic oligonucleotide
agccgcacatctgtctatctctcaaactcctcgtggg

SEQ ID NO: 204616 - DNA, 36 bp, Artificial Sequence
  Synthetic oligonucleotide
tcgaggactgcgagactacaacgtttttggctgtca

SEQ ID NO: 204617 - DNA, 36 bp, Artificial Sequence
  Synthetic oligonucleotide
gttgtggaggactgcactcgaatgcttgctgcctct

SEQ ID NO: 204618 - DNA, 34 bp, Artificial Sequence
  Synthetic oligonucleotide
cccttcttccgattgctgatacacaaggctatta

SEQ ID NO: 204619 - DNA, 36 bp, Artificial Sequence
  Synthetic oligonucleotide
tgtccattgcacacacttatacagttcgcggacggg

SEQ ID NO: 204620 - DNA, 37 bp, Artificial Sequence
  Synthetic oligonucleotide
ttacgtgtctgtcccggagatggagcctccgtaacgt

SEQ ID NO: 204621 - DNA, 36 bp, Artificial Sequence
  Synthetic oligonucleotide
tcgccgtcgttcgtgctttagcgatcctttgccgca

SEQ ID NO: 204622 - DNA, 35 bp, Artificial Sequence
  Synthetic oligonucleotide
acttgcgctggccttccaatctcgttaactgtcgc

SEQ ID NO: 204623 - DNA, 35 bp, Artificial Sequence
  Synthetic oligonucleotide
gccctggcaccaaagtcgcacaatctatcgtgtgc

SEQ ID NO: 204624 - DNA, 36 bp, Artificial Sequence
  Synthetic oligonucleotide
gaaattggtgaaccgtgcatatcgctttatgtcttt

SEQ ID NO: 204625 - DNA, 37 bp, Artificial Sequence
  Synthetic oligonucleotide
gcaatgtctcccggaaagggtctctcagcccgcgaca

SEQ ID NO: 204626 - DNA, 33 bp, Artificial Sequence
  Synthetic oligonucleotide
tacattggcacgtggtttcatccggttcttgca

SEQ ID NO: 204627 - DNA, 37 bp, Artificial Sequence
  Synthetic oligonucleotide
aacgcaatcatgagctctacgagtatagtaaataggt

SEQ ID NO: 204628 - DNA, 35 bp, Artificial Sequence
  Synthetic oligonucleotide
aacgcctccaattgctattcgactaggtgcattag

SEQ ID NO: 204629 - DNA, 35 bp, Artificial Sequence
  Synthetic oligonucleotide
gttatgtacaacggccaattagcactcctgaatct

SEQ ID NO: 204630 - DNA, 35 bp, Artificial Sequence
  Synthetic oligonucleotide
gtccgcttctaaacgctattgcaagaccgtcataa

SEQ ID NO: 204631 - DNA, 36 bp, Artificial Sequence
  Synthetic oligonucleotide
tcggcggataccgccaaccatccggtctgttcttca

SEQ ID NO: 204632 - DNA, 35 bp, Artificial Sequence
  Synthetic oligonucleotide
aagggccttgttacatgtatcgtgacgagttgtaa

SEQ ID NO: 204633 - DNA, 35 bp, Artificial Sequence
  Synthetic oligonucleotide
ctccccaagcatttcatatcgtctcggtactgttc

SEQ ID NO: 204634 - DNA, 36 bp, Artificial Sequence
  Synthetic oligonucleotide
ggtgttttcgactcgcgttgcacagtggatttaact

SEQ ID NO: 204635 - DNA, 36 bp, Artificial Sequence
  Synthetic oligonucleotide
aatggcgttatcaccagggtaaaattccgtccggca

SEQ ID NO: 204636 - DNA, 35 bp, Artificial Sequence
  Synthetic oligonucleotide
ggcgctggctcggaaaaccttgtacacatgtgtag

SEQ ID NO: 204637 - DNA, 36 bp, Artificial Sequence
  Synthetic oligonucleotide
acccgacacccttctctgatgtaagagagcgctcca

SEQ ID NO: 204638 - DNA, 35 bp, Artificial Sequence
  Synthetic oligonucleotide
atcgcgtcgcccccgtatattattgtttcttgttc

SEQ ID NO: 204639 - DNA, 36 bp, Artificial Sequence
  Synthetic oligonucleotide
ccacaacctggtaataaggttattgccaatttgcca

SEQ ID NO: 204640 - DNA, 35 bp, Artificial Sequence
  Synthetic oligonucleotide
agatcgccggtacgccaccggcgataccgattcaa

SEQ ID NO: 204641 - DNA, 35 bp, Artificial Sequence
  Synthetic oligonucleotide
gcgccgccccggatttcataacgaaccagatgggt

SEQ ID NO: 204642 - DNA, 37 bp, Artificial Sequence
  Synthetic oligonucleotide
gccagtccctacattgccctaggggtctattaaaaca

SEQ ID NO: 204643 - DNA, 35 bp, Artificial Sequence
  Synthetic oligonucleotide
taaaagatttccttaggtccgccatcttaagaatt

SEQ ID NO: 204644 - DNA, 34 bp, Artificial Sequence
  Synthetic oligonucleotide
attactgcacgcccaatgtcctcctactcgtcca

SEQ ID NO: 204645 - DNA, 37 bp, Artificial Sequence
  Synthetic oligonucleotide
ttgcaatccttgggacatctctgtctgatccgcgcca

SEQ ID NO: 204646 - DNA, 35 bp, Artificial Sequence
  Synthetic oligonucleotide
gatcctttcctgtgactattttgaccaccggctta

SEQ ID NO: 204647 - DNA, 38 bp, Artificial Sequence
  Synthetic oligonucleotide
gcagacaaggggggttttggcctgattctgagggatgt

SEQ ID NO: 204648 - DNA, 37 bp, Artificial Sequence
  Synthetic oligonucleotide
ttacccagagaaacattgagtctggcctcccttgtca

SEQ ID NO: 204649 - DNA, 38 bp, Artificial Sequence
  Synthetic oligonucleotide
aattcatcactcgttgtgtgtagccggtgcccaattga

SEQ ID NO: 204650 - DNA, 36 bp, Artificial Sequence
  Synthetic oligonucleotide
cttagccagagagtgatgcgcccttattaaagtttt

SEQ ID NO: 204651 - DNA, 35 bp, Artificial Sequence
  Synthetic oligonucleotide
tagtcaggatgcgcagttgtactgcctgcaaaact

SEQ ID NO: 204652 - DNA, 37 bp, Artificial Sequence
  Synthetic oligonucleotide
aaattggaccagctggcctttgggatgattctgttca

SEQ ID NO: 204653 - DNA, 35 bp, Artificial Sequence
  Synthetic oligonucleotide
tcattatcagtaactaccagagttgcctcccaccg

SEQ ID NO: 204654 - DNA, 35 bp, Artificial Sequence
  Synthetic oligonucleotide
gctgagttgttcctatgctttacgttggccttctt

SEQ ID NO: 204655 - DNA, 36 bp, Artificial Sequence
  Synthetic oligonucleotide
attgtcgcccgctaatctgtggagctacctagggca

SEQ ID NO: 204656 - DNA, 36 bp, Artificial Sequence
  Synthetic oligonucleotide
actcgtcagagtttcaagggtcgttaacctcgcgga

SEQ ID NO: 204657 - DNA, 36 bp, Artificial Sequence
  Synthetic oligonucleotide
aggacaggcttaacttacgcatccaggaactgcgct

SEQ ID NO: 204658 - DNA, 36 bp, Artificial Sequence
  Synthetic oligonucleotide
aaactcatgagacctcccacttcgtccactttgtcg

SEQ ID NO: 204659 - DNA, 35 bp, Artificial Sequence
  Synthetic oligonucleotide
acttctgcttagtaagctttgtgcagattactcct

SEQ ID NO: 204660 - DNA, 35 bp, Artificial Sequence
  Synthetic oligonucleotide
atgggacacgtagaaccctgaggggaggcaattac

SEQ ID NO: 204661 - DNA, 34 bp, Artificial Sequence
  Synthetic oligonucleotide
tatttaatggggggggggattctgttttgtctct

SEQ ID NO: 204662 - DNA, 35 bp, Artificial Sequence
  Synthetic oligonucleotide
cccagcgagccacgggctgtacgagcaagtcacac

SEQ ID NO: 204663 - DNA, 36 bp, Artificial Sequence
  Synthetic oligonucleotide
ccaccatacaaagtcgcgtatgtattttctcccctg

SEQ ID NO: 204664 - DNA, 35 bp, Artificial Sequence
  Synthetic oligonucleotide
accgaagacaccgtaccgcatgtgccccactgctt

SEQ ID NO: 204665 - DNA, 37 bp, Artificial Sequence
  Synthetic oligonucleotide
tctagccgcacgtcgcctctgaccagttcccccgtca

SEQ ID NO: 204666 - DNA, 35 bp, Artificial Sequence
  Synthetic oligonucleotide
tgttcggcaaggcatctcaaacatatccttcgacc

SEQ ID NO: 204667 - DNA, 36 bp, Artificial Sequence
  Synthetic oligonucleotide
tgctacgtcgattcaacgtacctacggaaaccacca

SEQ ID NO: 204668 - DNA, 37 bp, Artificial Sequence
  Synthetic oligonucleotide
agccgcacatctgtctatctctcaaactcctcgtgca

SEQ ID NO: 204669 - DNA, 36 bp, Artificial Sequence
  Synthetic oligonucleotide
catttcgtgcttgcatgctaaccgctttgctaccaa

SEQ ID NO: 204670 - DNA, 35 bp, Artificial Sequence
  Synthetic oligonucleotide
ccccaggaagtgaactaccattgatttgcctctct

SEQ ID NO: 204671 - DNA, 37 bp, Artificial Sequence
  Synthetic oligonucleotide
gctatgggtaccctgagctatgtggctcagttttcca

SEQ ID NO: 204672 - DNA, 36 bp, Artificial Sequence
  Synthetic oligonucleotide
tgaagctgtcttatctatcgcgacactcctcccaca

SEQ ID NO: 204673 - DNA, 37 bp, Artificial Sequence
  Synthetic oligonucleotide
ttccgaggcctcactgagtactttgattgttagagca

SEQ ID NO: 204674 - DNA, 36 bp, Artificial Sequence
  Synthetic oligonucleotide
aagtccgcgggatgcagatgtatcgtttagttttaa

SEQ ID NO: 204675 - DNA, 35 bp, Artificial Sequence
  Synthetic oligonucleotide
tcacgtacattgaatgttgcttggccccttcgtct

SEQ ID NO: 204676 - DNA, 37 bp, Artificial Sequence
  Synthetic oligonucleotide
gtgtgcccgcgttgcacctcccttcccgatacgtgga

SEQ ID NO: 204677 - DNA, 35 bp, Artificial Sequence
  Synthetic oligonucleotide
acggtggctgccgttacagaaattcattcgtgaaa

SEQ ID NO: 204678 - DNA, 37 bp, Artificial Sequence
  Synthetic oligonucleotide
tgcctgtgtcgcgcccgactttgtttgactcatatgt

SEQ ID NO: 204679 - DNA, 35 bp, Artificial Sequence
  Synthetic oligonucleotide
gtcgtcaactgaaccaatacggcatatttcctacc

SEQ ID NO: 204680 - DNA, 37 bp, Artificial Sequence
  Synthetic oligonucleotide
tcatctaggaattgaatgtaggcccccgtctttaaca

SEQ ID NO: 204681 - DNA, 35 bp, Artificial Sequence
  Synthetic oligonucleotide
tgtttgcttcaggatacccgttaatttttgggaca

SEQ ID NO: 204682 - DNA, 35 bp, Artificial Sequence
  Synthetic oligonucleotide
ttccagtaattggcgctcccctgtacctgtgacaa

SEQ ID NO: 204683 - DNA, 36 bp, Artificial Sequence
  Synthetic oligonucleotide
catttcgtgcttgcatgcgaaccgctttgctaccag

SEQ ID NO: 204684 - DNA, 36 bp, Artificial Sequence
  Synthetic oligonucleotide
caagttcggccagactcgccaagtaatcgggggtaa

SEQ ID NO: 204685 - DNA, 35 bp, Artificial Sequence
  Synthetic oligonucleotide
gtccgccccgtggccccattgttgtaccttagggc

SEQ ID NO: 204686 - DNA, 37 bp, Artificial Sequence
  Synthetic oligonucleotide
ctccactcatcccatccaccgacgtaagggcacacga

SEQ ID NO: 204687 - DNA, 34 bp, Artificial Sequence
  Synthetic oligonucleotide
gacaatcgtagtagatagttcccggctcctctgg

SEQ ID NO: 204688 - DNA, 38 bp, Artificial Sequence
  Synthetic oligonucleotide
cgactggggacaacatcgcgcattaaattacaggttgt

SEQ ID NO: 204689 - DNA, 37 bp, Artificial Sequence
  Synthetic oligonucleotide
gatccgcatcccactccgtctgagatctaaacccaca

SEQ ID NO: 204690 - DNA, 35 bp, Artificial Sequence
  Synthetic oligonucleotide
gcgtgcccaccttggcaacaggagttttttatgct

SEQ ID NO: 204691 - DNA, 37 bp, Artificial Sequence
  Synthetic oligonucleotide
cactccttgcgaaagataagtactcattgcgatccca

SEQ ID NO: 204692 - DNA, 37 bp, Artificial Sequence
  Synthetic oligonucleotide
gccatcggacgtccctaaccccccattgtccgacagg

SEQ ID NO: 204693 - DNA, 35 bp, Artificial Sequence
  Synthetic oligonucleotide
gtttcgcatttaatcttttcaactgacaattgagg

SEQ ID NO: 204694 - DNA, 35 bp, Artificial Sequence
  Synthetic oligonucleotide
tgacgtgggatattatctttcgaagtttctgctag

SEQ ID NO: 204695 - DNA, 38 bp, Artificial Sequence
  Synthetic oligonucleotide
cctcggacacgctctgatggattcgttcccggctttca

SEQ ID NO: 204696 - DNA, 36 bp, Artificial Sequence
  Synthetic oligonucleotide
ttgcttcctacttccccccgcagatgttcggcttgt

SEQ ID NO: 204697 - DNA, 35 bp, Artificial Sequence
  Synthetic oligonucleotide
catgttccaaccacaagcttcaggtttagaccgat

SEQ ID NO: 204698 - DNA, 37 bp, Artificial Sequence
  Synthetic oligonucleotide
gttgctgggggttctgaggaatcgtttaccccccaca

SEQ ID NO: 204699 - DNA, 37 bp, Artificial Sequence
  Synthetic oligonucleotide
gcgattcacgatctattgtcaccacgtggtcatacca

SEQ ID NO: 204700 - DNA, 37 bp, Artificial Sequence
  Synthetic oligonucleotide
gttcagtttaccccggggattcaatgtgtacgcctga

SEQ ID NO: 204701 - DNA, 36 bp, Artificial Sequence
  Synthetic oligonucleotide
gcgctctctacaaggggccgggcttagctttccata

SEQ ID NO: 204702 - DNA, 38 bp, Artificial Sequence
  Synthetic oligonucleotide
atttatcctgtagttaagtcctccacctaactcgatgt

SEQ ID NO: 204703 - DNA, 37 bp, Artificial Sequence
  Synthetic oligonucleotide
ttgcaatgccgttgcgtggtgatccaaccgctcgtca

SEQ ID NO: 204704 - DNA, 35 bp, Artificial Sequence
  Synthetic oligonucleotide
ttttctttacccgcctgtaagatgcgcttacacgg

SEQ ID NO: 204705 - DNA, 38 bp, Artificial Sequence
  Synthetic oligonucleotide
ctctcagtcattgtctacataaacggtactctacctgt

SEQ ID NO: 204706 - DNA, 35 bp, Artificial Sequence
  Synthetic oligonucleotide
ttaaagtcgtcatgtaacgcgcgtatacctccgcg

SEQ ID NO: 204707 - DNA, 35 bp, Artificial Sequence
  Synthetic oligonucleotide
tgacgtcgcgcacgtagcaagacatgcacgtatcc

SEQ ID NO: 204708 - DNA, 35 bp, Artificial Sequence
  Synthetic oligonucleotide
ttcagcattacgcagtggagaatattcacaagttg

SEQ ID NO: 204709 - DNA, 37 bp, Artificial Sequence
  Synthetic oligonucleotide
gctctgaggtctagtatttccacaacacgtaatttca

SEQ ID NO: 204710 - DNA, 37 bp, Artificial Sequence
  Synthetic oligonucleotide
aaggtacgaacactgggcccaattggcgtctttagca

SEQ ID NO: 204711 - DNA, 35 bp, Artificial Sequence
  Synthetic oligonucleotide
cgtcaggtgtcttccagctcaactctctacgccct

SEQ ID NO: 204712 - DNA, 38 bp, Artificial Sequence
  Synthetic oligonucleotide
aatatcgaagttgcagatcatgcgtcgtgccaccttca

SEQ ID NO: 204713 - DNA, 35 bp, Artificial Sequence
  Synthetic oligonucleotide
actttgatggcgttctatacagcgggtgcctctag

SEQ ID NO: 204714 - DNA, 35 bp, Artificial Sequence
  Synthetic oligonucleotide
accagcttacctgcatcagacaattacgttattag

SEQ ID NO: 204715 - DNA, 35 bp, Artificial Sequence
  Synthetic oligonucleotide
tatttcggtgcatacaatacatagatagtgccgcg

SEQ ID NO: 204716 - DNA, 37 bp, Artificial Sequence
  Synthetic oligonucleotide
tgagcttccattgcgagcgtgtgagacgtacacctca

SEQ ID NO: 204717 - DNA, 36 bp, Artificial Sequence
  Synthetic oligonucleotide
cacgcggtggacaaccgcgacgggttcgtcccaatg

SEQ ID NO: 204718 - DNA, 35 bp, Artificial Sequence
  Synthetic oligonucleotide
cgtcaggtgtcttccagctcaactctctacgccaa

SEQ ID NO: 204719 - DNA, 35 bp, Artificial Sequence
  Synthetic oligonucleotide
cccggtctgttctacggcctgtgaagcccttccaa

SEQ ID NO: 204720 - DNA, 36 bp, Artificial Sequence
  Synthetic oligonucleotide
tgtaccgtcccgcgatgcaacactcatgtcatccgt

SEQ ID NO: 204721 - DNA, 36 bp, Artificial Sequence
  Synthetic oligonucleotide
agagacccgctaagagcgtaattcacgcgtacgtca

SEQ ID NO: 204722 - DNA, 37 bp, Artificial Sequence
  Synthetic oligonucleotide
ccgaacatcccattcgtgctgcctgctcataggacca

SEQ ID NO: 204723 - DNA, 37 bp, Artificial Sequence
  Synthetic oligonucleotide
gatctccagccctgcgtactactgtattcacctaaga

SEQ ID NO: 204724 - DNA, 38 bp, Artificial Sequence
  Synthetic oligonucleotide
ttcaacacggctgatcccgcaaatgtttgtcgtcaagt

SEQ ID NO: 204725 - DNA, 35 bp, Artificial Sequence
  Synthetic oligonucleotide
tttgtccgtctccgatgggctcgtacggggtcgac

SEQ ID NO: 204726 - DNA, 35 bp, Artificial Sequence
  Synthetic oligonucleotide
cgtctattctgacagcttcttcatcgttctgggtg

SEQ ID NO: 204727 - DNA, 36 bp, Artificial Sequence
  Synthetic oligonucleotide
aactgcaggctccttacgtaatctttcgggttaaca

SEQ ID NO: 204728 - DNA, 35 bp, Artificial Sequence
  Synthetic oligonucleotide
taaagggtaacgataggcactctctgcttggctat

SEQ ID NO: 204729 - DNA, 38 bp, Artificial Sequence
  Synthetic oligonucleotide
accaagcgcatattttggctaggggtttcctaccatta

SEQ ID NO: 204730 - DNA, 38 bp, Artificial Sequence
  Synthetic oligonucleotide
acgtaggccagttcgccactgcggggccccacctgtta

SEQ ID NO: 204731 - DNA, 37 bp, Artificial Sequence
  Synthetic oligonucleotide
gtctccgttagatttctcgttttgataacagtggtta

SEQ ID NO: 204732 - DNA, 36 bp, Artificial Sequence
  Synthetic oligonucleotide
gtgccaagctatgacttcgctaacgaagtacgttaa

SEQ ID NO: 204733 - DNA, 35 bp, Artificial Sequence
  Synthetic oligonucleotide
cctaaccgctgagacttcgtcttggagattgctac

SEQ ID NO: 204734 - DNA, 35 bp, Artificial Sequence
  Synthetic oligonucleotide
acgcaggcgtacatgcttggataaccgaccgtgcc

SEQ ID NO: 204735 - DNA, 35 bp, Artificial Sequence
  Synthetic oligonucleotide
ctcgaacaatcgcttacaggcgtatctgttttgag

SEQ ID NO: 204736 - DNA, 37 bp, Artificial Sequence
  Synthetic oligonucleotide
ttcgccgacactggatggtactaatgtttcgtgtgca

SEQ ID NO: 204737 - DNA, 37 bp, Artificial Sequence
  Synthetic oligonucleotide
ccgccgaaggtagattgtactgtgcctaaccaacagt

SEQ ID NO: 204738 - DNA, 35 bp, Artificial Sequence
  Synthetic oligonucleotide
cgtaggtccacgccttgcactctttagcgtattct

SEQ ID NO: 204739 - DNA, 35 bp, Artificial Sequence
  Synthetic oligonucleotide
taagtcacctccgtgttaaattttttgttaccaat

SEQ ID NO: 204740 - DNA, 36 bp, Artificial Sequence
  Synthetic oligonucleotide
ttgcattcacgaacgtttgacaggggttggtcttcg

SEQ ID NO: 204741 - DNA, 38 bp, Artificial Sequence
  Synthetic oligonucleotide
gattcgtcactcgttgtgtgtagccggtgcccaattga

SEQ ID NO: 204742 - DNA, 34 bp, Artificial Sequence
  Synthetic oligonucleotide
gggtagaccacctctatggatttcctcatgtcaa

SEQ ID NO: 204743 - DNA, 36 bp, Artificial Sequence
  Synthetic oligonucleotide
cgagtgctggttgtctaatcctccattttaaagcca

SEQ ID NO: 204744 - DNA, 38 bp, Artificial Sequence
  Synthetic oligonucleotide
gctcgtagtgtagctatccagcgccacacgattcttca

SEQ ID NO: 204745 - DNA, 36 bp, Artificial Sequence
  Synthetic oligonucleotide
ttccgaacgccacgactatcggttccatccgggcca

SEQ ID NO: 204746 - DNA, 37 bp, Artificial Sequence
  Synthetic oligonucleotide
tatctttggtccaccaagcgcggatcgcaacgaacgt

SEQ ID NO: 204747 - DNA, 35 bp, Artificial Sequence
  Synthetic oligonucleotide
tatcttctaagtcgactccatggagggtcatccca

SEQ ID NO: 204748 - DNA, 35 bp, Artificial Sequence
  Synthetic oligonucleotide
atgaatccgtactggcgactaggccgatcctggcg

SEQ ID NO: 204749 - DNA, 37 bp, Artificial Sequence
  Synthetic oligonucleotide
ggaggtggcttccaccccccgtccctcactgagggga

SEQ ID NO: 204750 - DNA, 36 bp, Artificial Sequence
  Synthetic oligonucleotide
gacgcccttgaatacctgctcgtcaggttcccgtca

SEQ ID NO: 204751 - DNA, 37 bp, Artificial Sequence
  Synthetic oligonucleotide
aaagttacgcgcaccaaggttattacctggtgttcgg

SEQ ID NO: 204752 - DNA, 38 bp, Artificial Sequence
  Synthetic oligonucleotide
ccactcctattgattctcccttccgcggtcgattctca

SEQ ID NO: 204753 - DNA, 37 bp, Artificial Sequence
  Synthetic oligonucleotide
gctcagccacaggggctgtactttattgggttatcca

SEQ ID NO: 204754 - DNA, 35 bp, Artificial Sequence
  Synthetic oligonucleotide
gattgtcaaggtttgttcggtcttcccgccccact

SEQ ID NO: 204755 - DNA, 38 bp, Artificial Sequence
  Synthetic oligonucleotide
tccccatcagggtttaccccgttaactatgccacctgg

SEQ ID NO: 204756 - DNA, 36 bp, Artificial Sequence
  Synthetic oligonucleotide
gatctcctgttctcttcaccgcagtttcacgttcat

SEQ ID NO: 204757 - DNA, 38 bp, Artificial Sequence
  Synthetic oligonucleotide
tcgtcgctgcaacatccagacgaacaattgacgattca

SEQ ID NO: 204758 - DNA, 35 bp, Artificial Sequence
  Synthetic oligonucleotide
gcgtacattatggcatcctcccgaacggaaggtca

SEQ ID NO: 204759 - DNA, 36 bp, Artificial Sequence
  Synthetic oligonucleotide
acccttcgtaaagggtatggtagagctcttaatcca

SEQ ID NO: 204760 - DNA, 38 bp, Artificial Sequence
  Synthetic oligonucleotide
gtctcctgttactcgctgtatacctgggctccgattca

SEQ ID NO: 204761 - DNA, 35 bp, Artificial Sequence
  Synthetic oligonucleotide
tgcgagttcgtgtctagggttcgttcctatcccct

SEQ ID NO: 204762 - DNA, 36 bp, Artificial Sequence
  Synthetic oligonucleotide
attgttccctgatcgttcgaatgtaacgcaaaaaat

SEQ ID NO: 204763 - DNA, 37 bp, Artificial Sequence
  Synthetic oligonucleotide
atccgctttgactaagcctgtgcgcttttaagactca

SEQ ID NO: 204764 - DNA, 37 bp, Artificial Sequence
  Synthetic oligonucleotide
aacttgaagtacggacgtttggtaactccacgggaca

SEQ ID NO: 204765 - DNA, 36 bp, Artificial Sequence
  Synthetic oligonucleotide
tgcctacggatttctctagtgtcgacttcttagtat

SEQ ID NO: 204766 - DNA, 37 bp, Artificial Sequence
  Synthetic oligonucleotide
ccgttacaggtacattgctatcacttgtgcttgatgt

SEQ ID NO: 204767 - DNA, 35 bp, Artificial Sequence
  Synthetic oligonucleotide
gagacccgcatacctgtgatttcgtccaacaccca

SEQ ID NO: 204768 - DNA, 36 bp, Artificial Sequence
  Synthetic oligonucleotide
aattattgcacctctacggctcccttgtgagcttaa

SEQ ID NO: 204769 - DNA, 35 bp, Artificial Sequence
  Synthetic oligonucleotide
ttttccctcggatgaggttgatactgcttctagca

SEQ ID NO: 204770 - DNA, 26 bp, Artificial Sequence
  Synthetic oligonucleotide
catttctaggcgttattgattcccgt

SEQ ID NO: 204771 - DNA, 36 bp, Artificial Sequence
  Synthetic oligonucleotide
taactctagagcgtcgcgtgcacgcaactgctcgca

SEQ ID NO: 204772 - DNA, 38 bp, Artificial Sequence
  Synthetic oligonucleotide
ttgtatgacgcgaccgcgttgctcaggcctatgattca

SEQ ID NO: 204773 - DNA, 34 bp, Artificial Sequence
  Synthetic oligonucleotide
ttttgcgggtcatcaatacgagctaactcggacc

SEQ ID NO: 204774 - DNA, 35 bp, Artificial Sequence
  Synthetic oligonucleotide
tgaaggtccatgggaaccgtcacgaattctctgtt

SEQ ID NO: 204775 - DNA, 36 bp, Artificial Sequence
  Synthetic oligonucleotide
ttgctgttacactgctgcatactttacttacttgca

SEQ ID NO: 204776 - DNA, 35 bp, Artificial Sequence
  Synthetic oligonucleotide
gtagcttatacttgacccttgactcgccatgtatt

SEQ ID NO: 204777 - DNA, 36 bp, Artificial Sequence
  Synthetic oligonucleotide
aatacgtaatctgccacgcccggactgttttccata

SEQ ID NO: 204778 - DNA, 35 bp, Artificial Sequence
  Synthetic oligonucleotide
acagctgggttagatctcccatacgaatggttccg

SEQ ID NO: 204779 - DNA, 35 bp, Artificial Sequence
  Synthetic oligonucleotide
gacccatcctgatatgacaggttactggtagtacc

SEQ ID NO: 204780 - DNA, 36 bp, Artificial Sequence
  Synthetic oligonucleotide
tcactagtaaccacgcctttcatgacaagttttaca

SEQ ID NO: 204781 - DNA, 36 bp, Artificial Sequence
  Synthetic oligonucleotide
gttcgacttgttgaattctgctttgcattaaggtca

SEQ ID NO: 204782 - DNA, 36 bp, Artificial Sequence
  Synthetic oligonucleotide
cacaacggctactcacgggttcccgcccgggcggca

SEQ ID NO: 204783 - DNA, 38 bp, Artificial Sequence
  Synthetic oligonucleotide
gctcataactcgagcgatcgcctcatgtgacggggtca

SEQ ID NO: 204784 - DNA, 37 bp, Artificial Sequence
  Synthetic oligonucleotide
aattgattgatgcccactcttgatataagaatatcgt

SEQ ID NO: 204785 - DNA, 37 bp, Artificial Sequence
  Synthetic oligonucleotide
acgcggatccggtttattcgcccacgtgatcgaaagt

SEQ ID NO: 204786 - DNA, 35 bp, Artificial Sequence
  Synthetic oligonucleotide
ctcgcgagtcttatggaaacgttacaacccacaca

SEQ ID NO: 204787 - DNA, 37 bp, Artificial Sequence
  Synthetic oligonucleotide
gcaccaacgccgagtgccgatcgtctagtaattatgt

SEQ ID NO: 204788 - DNA, 32 bp, Artificial Sequence
  Synthetic oligonucleotide
gtatttacatccatgttcgtcccgcactcact

SEQ ID NO: 204789 - DNA, 35 bp, Artificial Sequence
  Synthetic oligonucleotide
agtgctatcgatctttccttccatgcttttgggag

SEQ ID NO: 204790 - DNA, 37 bp, Artificial Sequence
  Synthetic oligonucleotide
gagcatactactgtgtccggtatcgtttggtcggaca

SEQ ID NO: 204791 - DNA, 38 bp, Artificial Sequence
  Synthetic oligonucleotide
tacccagtagggctcaccgccctatctgtcaatcttgt

SEQ ID NO: 204792 - DNA, 35 bp, Artificial Sequence
  Synthetic oligonucleotide
acagtctcttgctacaccggttatcggtactgact

SEQ ID NO: 204793 - DNA, 35 bp, Artificial Sequence
  Synthetic oligonucleotide
gtccctgatatgggcttcgactccacaggcctgac

SEQ ID NO: 204794 - DNA, 35 bp, Artificial Sequence
  Synthetic oligonucleotide
cacaagcctccttcattcactagcacatactatga

SEQ ID NO: 204795 - DNA, 35 bp, Artificial Sequence
  Synthetic oligonucleotide
gccggcgagccacgggctgtacgagcaagtcacac

SEQ ID NO: 204796 - DNA, 36 bp, Artificial Sequence
  Synthetic oligonucleotide
gctcgtctgttgttgattctgggtattcaccgcaca

SEQ ID NO: 204797 - DNA, 35 bp, Artificial Sequence
  Synthetic oligonucleotide
ttcttggagggggtctccgtttgctgcctcgtacg

SEQ ID NO: 204798 - DNA, 38 bp, Artificial Sequence
  Synthetic oligonucleotide
tattttcgagggaaaggtacgtgcatgccacccattca

SEQ ID NO: 204799 - DNA, 36 bp, Artificial Sequence
  Synthetic oligonucleotide
gccgaggataggcgcatcttattatggtatgtctaa

SEQ ID NO: 204800 - DNA, 36 bp, Artificial Sequence
  Synthetic oligonucleotide
gcccgccgctaattgtccaacatgagtactattgat

SEQ ID NO: 204801 - DNA, 38 bp, Artificial Sequence
  Synthetic oligonucleotide
tcaaattcctgccccttgaatttattggacgagattca

SEQ ID NO: 204802 - DNA, 29 bp, Artificial Sequence
  Synthetic oligonucleotide
cgccctaggttcacataatgttgctctgg

SEQ ID NO: 204803 - DNA, 32 bp, Artificial Sequence
  Synthetic oligonucleotide
gctgcctctgcgcccggttattcgatccgaga

SEQ ID NO: 204804 - DNA, 36 bp, Artificial Sequence
  Synthetic oligonucleotide
cgcgactattccatggcattcgctccggcctggcca

SEQ ID NO: 204805 - DNA, 37 bp, Artificial Sequence
  Synthetic oligonucleotide
acgttccccacctcgtcagtgcacgggccatggttgg

SEQ ID NO: 204806 - DNA, 35 bp, Artificial Sequence
  Synthetic oligonucleotide
ttgcgatagctctggcgactatggtgagaccaacg

SEQ ID NO: 204807 - DNA, 38 bp, Artificial Sequence
  Synthetic oligonucleotide
gcaacatctgtatcccggttcgaggtttctaatactgg

SEQ ID NO: 204808 - DNA, 35 bp, Artificial Sequence
  Synthetic oligonucleotide
ctcgcctctggtggtcactgtctgcactgccgtcc

SEQ ID NO: 204809 - DNA, 37 bp, Artificial Sequence
  Synthetic oligonucleotide
ccatgtggttctctacctccctttagtgctgcctcgt

SEQ ID NO: 204810 - DNA, 36 bp, Artificial Sequence
  Synthetic oligonucleotide
tcgggcacaacacttttatacgcatgcaatacttcg

SEQ ID NO: 204811 - DNA, 36 bp, Artificial Sequence
  Synthetic oligonucleotide
acgcttggcctgactagactttttttcgctcccgaa

SEQ ID NO: 204812 - DNA, 38 bp, Artificial Sequence
  Synthetic oligonucleotide
aacgctctcgtgcgcactttcgcgtaagaccctcctca

SEQ ID NO: 204813 - DNA, 36 bp, Artificial Sequence
  Synthetic oligonucleotide
gcagtttgacccctcaagctcctacctgggggatgt

SEQ ID NO: 204814 - DNA, 35 bp, Artificial Sequence
  Synthetic oligonucleotide
acgagtttatattccctgtgatattcaggtttgcg

SEQ ID NO: 204815 - DNA, 35 bp, Artificial Sequence
  Synthetic oligonucleotide
gcgctaagctttaataggctttttcgactccgtca

SEQ ID NO: 204816 - DNA, 35 bp, Artificial Sequence
  Synthetic oligonucleotide
gccggtgaaaggttttccctggtgtttatgacgcc

SEQ ID NO: 204817 - DNA, 29 bp, Artificial Sequence
  Synthetic oligonucleotide
gcttggctacactgcgttgcggtctaccc

SEQ ID NO: 204818 - DNA, 35 bp, Artificial Sequence
  Synthetic oligonucleotide
tgcgcacaactcgcgtacgacagtccgcttagtca

SEQ ID NO: 204819 - DNA, 37 bp, Artificial Sequence
  Synthetic oligonucleotide
tgagtagccgtaatacacatttgccctgggctttgca

SEQ ID NO: 204820 - DNA, 36 bp, Artificial Sequence
  Synthetic oligonucleotide
gctatcgagcgtttcgattatacctgactcctccca

SEQ ID NO: 204821 - DNA, 35 bp, Artificial Sequence
  Synthetic oligonucleotide
ttcgagatcttgccggagccagaatgagcgaactt

SEQ ID NO: 204822 - DNA, 35 bp, Artificial Sequence
  Synthetic oligonucleotide
cctcgtaggaaacttggacgccgtgagttcacccc

SEQ ID NO: 204823 - DNA, 37 bp, Artificial Sequence
  Synthetic oligonucleotide
gcccacacaagtaacctggggggtatttgctggttca

SEQ ID NO: 204824 - DNA, 36 bp, Artificial Sequence
  Synthetic oligonucleotide
gacccccgtaaccctattctcttcagacgatgggta

SEQ ID NO: 204825 - DNA, 35 bp, Artificial Sequence
  Synthetic oligonucleotide
ccttctgctcagacctaatataccttcctccctag

SEQ ID NO: 204826 - DNA, 36 bp, Artificial Sequence
  Synthetic oligonucleotide
tgctacgtcgattcaacgtacctacggaaaccacat

SEQ ID NO: 204827 - DNA, 38 bp, Artificial Sequence
  Synthetic oligonucleotide
atctcttgtcgggtccgggaccagctctgcattattgg

SEQ ID NO: 204828 - DNA, 38 bp, Artificial Sequence
  Synthetic oligonucleotide
tctaagtctggcattgcctcgtcactacaatctaccca

SEQ ID NO: 204829 - DNA, 36 bp, Artificial Sequence
  Synthetic oligonucleotide
gtttgccgtaacctactccaagggccgtgattttaa

SEQ ID NO: 204830 - DNA, 37 bp, Artificial Sequence
  Synthetic oligonucleotide
accggtccttccgctgttctgtggccgaggcctcaca

SEQ ID NO: 204831 - DNA, 38 bp, Artificial Sequence
  Synthetic oligonucleotide
ccactcagtttaatcctctttcaggcacaaatccttca

SEQ ID NO: 204832 - DNA, 36 bp, Artificial Sequence
  Synthetic oligonucleotide
gccttcagaatgttgattcagaatggatctactaaa

SEQ ID NO: 204833 - DNA, 35 bp, Artificial Sequence
  Synthetic oligonucleotide
cgtcacatctgtccatattatggcaaaacctcctg

SEQ ID NO: 204834 - DNA, 36 bp, Artificial Sequence
  Synthetic oligonucleotide
gccacagacgtgaatctgttccttagactagctgca

SEQ ID NO: 204835 - DNA, 37 bp, Artificial Sequence
  Synthetic oligonucleotide
tcgacatgcttagtattcataagcaataccaacatgt

SEQ ID NO: 204836 - DNA, 38 bp, Artificial Sequence
  Synthetic oligonucleotide
cctaccccgaatggtgattcgctatatgcccaggtcca

SEQ ID NO: 204837 - DNA, 36 bp, Artificial Sequence
  Synthetic oligonucleotide
aagacccaagcagggagtacggggtcaaacgttttt

SEQ ID NO: 204838 - DNA, 37 bp, Artificial Sequence
  Synthetic oligonucleotide
tctgctgtagatgcatactccccggtgttgataggca

SEQ ID NO: 204839 - DNA, 35 bp, Artificial Sequence
  Synthetic oligonucleotide
atcattggagcctattagtatcttaaagcccttct

SEQ ID NO: 204840 - DNA, 36 bp, Artificial Sequence
  Synthetic oligonucleotide
tattgctgatgttctgccccgacctaccaccgtgaa

SEQ ID NO: 204841 - DNA, 35 bp, Artificial Sequence
  Synthetic oligonucleotide
tgcccccacctcgtagaatggcgacccactggccg

SEQ ID NO: 204842 - DNA, 37 bp, Artificial Sequence
  Synthetic oligonucleotide
cgataacgacaagccccgcttcctttcatgcactaca

SEQ ID NO: 204843 - DNA, 36 bp, Artificial Sequence
  Synthetic oligonucleotide
aagacccaagcagggagtacggggtcaaacgtttca

SEQ ID NO: 204844 - DNA, 36 bp, Artificial Sequence
  Synthetic oligonucleotide
ggttcgattagcgcgtatggggtgggggttaatgaa

SEQ ID NO: 204845 - DNA, 35 bp, Artificial Sequence
  Synthetic oligonucleotide
gacttctatcaggttcggccgtgagaaaccgttta

SEQ ID NO: 204846 - DNA, 35 bp, Artificial Sequence
  Synthetic oligonucleotide
tggtctggtcgtaactgtccaaggccctctgtatg

SEQ ID NO: 204847 - DNA, 38 bp, Artificial Sequence
  Synthetic oligonucleotide
tgggttgcccaatgtcgttactcggttcctgttcttga

SEQ ID NO: 204848 - DNA, 36 bp, Artificial Sequence
  Synthetic oligonucleotide
gccctaagctctcactgtcacggactacgtgtccca

SEQ ID NO: 204849 - DNA, 35 bp, Artificial Sequence
  Synthetic oligonucleotide
tcatgattgcatatgctgttacgttacgttgcccc

SEQ ID NO: 204850 - DNA, 35 bp, Artificial Sequence
  Synthetic oligonucleotide
attttcactccgttggtgcgtactgcctcctgttt

SEQ ID NO: 204851 - DNA, 36 bp, Artificial Sequence
  Synthetic oligonucleotide
acgccgtgcgcgtaccataaggacaaagggttccca

SEQ ID NO: 204852 - DNA, 35 bp, Artificial Sequence
  Synthetic oligonucleotide
ccatggtattgatcctttgaatcatgtcgctccca

SEQ ID NO: 204853 - DNA, 35 bp, Artificial Sequence
  Synthetic oligonucleotide
gtattgcgtccttaatcgatgctctcttacgtgca

SEQ ID NO: 204854 - DNA, 36 bp, Artificial Sequence
  Synthetic oligonucleotide
cccctacttagccaacgacaggcgacgccggtataa

SEQ ID NO: 204855 - DNA, 37 bp, Artificial Sequence
  Synthetic oligonucleotide
ggtagtaccgccagtctcgtattatttcgctacatgg

SEQ ID NO: 204856 - DNA, 35 bp, Artificial Sequence
  Synthetic oligonucleotide
cgcaacctgctctccattgagaggagccccgcctt

SEQ ID NO: 204857 - DNA, 35 bp, Artificial Sequence
  Synthetic oligonucleotide
catcgactttctggcaattgtacgagcgctgggcg

SEQ ID NO: 204858 - DNA, 35 bp, Artificial Sequence
  Synthetic oligonucleotide
gggtgccctttggagctatcgcgctggacgaaccg

SEQ ID NO: 204859 - DNA, 36 bp, Artificial Sequence
  Synthetic oligonucleotide
aaacatacggttacatccgcagttcgcctgacggat

SEQ ID NO: 204860 - DNA, 38 bp, Artificial Sequence
  Synthetic oligonucleotide
gctatgggccctgtttacagatcataagctgagattca

SEQ ID NO: 204861 - DNA, 35 bp, Artificial Sequence
  Synthetic oligonucleotide
tcttgtagtcacgccggacccggggagaaccagaa

SEQ ID NO: 204862 - DNA, 36 bp, Artificial Sequence
  Synthetic oligonucleotide
ccccgtgcttcctcccttggcactctatctgtcaca

SEQ ID NO: 204863 - DNA, 27 bp, Artificial Sequence
  Synthetic oligonucleotide
cgtgcgtgaatcatgtcatttcacttt

SEQ ID NO: 204864 - DNA, 36 bp, Artificial Sequence
  Synthetic oligonucleotide
ctgtattcgagtcattgctccttcagctatcccaca

SEQ ID NO: 204865 - DNA, 35 bp, Artificial Sequence
  Synthetic oligonucleotide
ctgtaacttgcttatcttgatactttggcgcttct

SEQ ID NO: 204866 - DNA, 38 bp, Artificial Sequence
  Synthetic oligonucleotide
aacatctcgctccatgggttctaagaaacgaagtctca

SEQ ID NO: 204867 - DNA, 35 bp, Artificial Sequence
  Synthetic oligonucleotide
tttgggtcacacgtgtctaacatatgtctacgtcg

SEQ ID NO: 204868 - DNA, 35 bp, Artificial Sequence
  Synthetic oligonucleotide
gtacatggacacgtatctgacctatgcttaacgtt

SEQ ID NO: 204869 - DNA, 35 bp, Artificial Sequence
  Synthetic oligonucleotide
gaccaccccgttcatctggctcgatgtaccgtgca

SEQ ID NO: 204870 - DNA, 37 bp, Artificial Sequence
  Synthetic oligonucleotide
gtgaggtacctcggaaactaccatacccccgacccgg

SEQ ID NO: 204871 - DNA, 36 bp, Artificial Sequence
  Synthetic oligonucleotide
gcatctacactgttgtctccttggcgtaatacgacg

SEQ ID NO: 204872 - DNA, 32 bp, Artificial Sequence
  Synthetic oligonucleotide
taaaagactttcaagtcccgagggtaaggggg

SEQ ID NO: 204873 - DNA, 36 bp, Artificial Sequence
  Synthetic oligonucleotide
agggtactgtcacctctgcttatatttccctcgttt

SEQ ID NO: 204874 - DNA, 35 bp, Artificial Sequence
  Synthetic oligonucleotide
catgcgatggaatacattcgtttaacggggaactg

SEQ ID NO: 204875 - DNA, 36 bp, Artificial Sequence
  Synthetic oligonucleotide
ttcggagcactcgcaccatatggttgtacccttcat

SEQ ID NO: 204876 - DNA, 36 bp, Artificial Sequence
  Synthetic oligonucleotide
tcacgtggggactatgctcttctacgcactattaca

SEQ ID NO: 204877 - DNA, 37 bp, Artificial Sequence
  Synthetic oligonucleotide
tcaccttagaagtctttccctgtgtgaccaatgatgt

SEQ ID NO: 204878 - DNA, 37 bp, Artificial Sequence
  Synthetic oligonucleotide
ggccccaaacttaagggtcaatcgcgaaaagtattgt

SEQ ID NO: 204879 - DNA, 35 bp, Artificial Sequence
  Synthetic oligonucleotide
cgccatcatggtactacggtgttggaggcgacaaa

SEQ ID NO: 204880 - DNA, 38 bp, Artificial Sequence
  Synthetic oligonucleotide
gcagacaaggggggttttggcctgattctgagggatca

SEQ ID NO: 204881 - DNA, 35 bp, Artificial Sequence
  Synthetic oligonucleotide
tctgatttctacgttagtgtaaacattgtagcgcc

SEQ ID NO: 204882 - DNA, 38 bp, Artificial Sequence
  Synthetic oligonucleotide
gcaggtcgatcccacctttaacttcatcaccttcgtgt

SEQ ID NO: 204883 - DNA, 36 bp, Artificial Sequence
  Synthetic oligonucleotide
gtcggccacttgcactctgggatattctttgtagtg

SEQ ID NO: 204884 - DNA, 36 bp, Artificial Sequence
  Synthetic oligonucleotide
tttacgctaccttttgagctatatacccattcatat

SEQ ID NO: 204885 - DNA, 35 bp, Artificial Sequence
  Synthetic oligonucleotide
aggggttgcactgccgatcctaagactccctggag

SEQ ID NO: 204886 - DNA, 35 bp, Artificial Sequence
  Synthetic oligonucleotide
tctgcggacttccggcccgaacagtcatacactct

SEQ ID NO: 204887 - DNA, 36 bp, Artificial Sequence
  Synthetic oligonucleotide
gtcgcaaacaattaaagaaactaattcggtttggca

SEQ ID NO: 204888 - DNA, 37 bp, Artificial Sequence
  Synthetic oligonucleotide
agtcgtatgcttggtggatcaatcttcttacgctggt

SEQ ID NO: 204889 - DNA, 36 bp, Artificial Sequence
  Synthetic oligonucleotide
cttgatggttaggggaaccgtcacctcaactcgtaa

SEQ ID NO: 204890 - DNA, 36 bp, Artificial Sequence
  Synthetic oligonucleotide
gatcgccggtgaatgatcattactttaaggcataga

SEQ ID NO: 204891 - DNA, 35 bp, Artificial Sequence
  Synthetic oligonucleotide
aaaccagctttattcatggcccgaccagtgtgcct

SEQ ID NO: 204892 - DNA, 35 bp, Artificial Sequence
  Synthetic oligonucleotide
tccgggtccgaagtatcccgttggtagggccgcat

SEQ ID NO: 204893 - DNA, 37 bp, Artificial Sequence
  Synthetic oligonucleotide
ttgcaacgggccctgtgaacgcttacctttcctacca

SEQ ID NO: 204894 - DNA, 36 bp, Artificial Sequence
  Synthetic oligonucleotide
ttcgagggttgagtgctaattggcattctctggaca

SEQ ID NO: 204895 - DNA, 28 bp, Artificial Sequence
  Synthetic oligonucleotide
gtttcacaaactgtactaccaacattct

SEQ ID NO: 204896 - DNA, 35 bp, Artificial Sequence
  Synthetic oligonucleotide
atcgtaatgattccccggtcactttttagacgcat

SEQ ID NO: 204897 - DNA, 35 bp, Artificial Sequence
  Synthetic oligonucleotide
ctacagagcgtttcccggttcggttcgttccttac

SEQ ID NO: 204898 - DNA, 35 bp, Artificial Sequence
  Synthetic oligonucleotide
tctctgactcaatccgtgagtagtttcgaactcac

SEQ ID NO: 204899 - DNA, 36 bp, Artificial Sequence
  Synthetic oligonucleotide
acgtcaataactcaagttcgcttgccaccgctcgca

SEQ ID NO: 204900 - DNA, 34 bp, Artificial Sequence
  Synthetic oligonucleotide
ccaccgagctcatatgctcttgctgcctattaca

SEQ ID NO: 204901 - DNA, 35 bp, Artificial Sequence
  Synthetic oligonucleotide
tttgagggtgacctcgaagctgtcgtaccgtggct

SEQ ID NO: 204902 - DNA, 37 bp, Artificial Sequence
  Synthetic oligonucleotide
tcgaggacttgtgacactatgagccattgcccggcca

SEQ ID NO: 204903 - DNA, 29 bp, Artificial Sequence
  Synthetic oligonucleotide
gcttggctacattgctttgcggtctaccc

SEQ ID NO: 204904 - DNA, 35 bp, Artificial Sequence
  Synthetic oligonucleotide
gagttgcttctgttctactgatacacctgtcccca

SEQ ID NO: 204905 - DNA, 35 bp, Artificial Sequence
  Synthetic oligonucleotide
tgctgactttagaaacgccccaggtcccgacttca

SEQ ID NO: 204906 - DNA, 38 bp, Artificial Sequence
  Synthetic oligonucleotide
ctagtatctttactctacattcccgctgcctgccatca

SEQ ID NO: 204907 - DNA, 36 bp, Artificial Sequence
  Synthetic oligonucleotide
ggttctgcacgagggaatgacggtttcctatccttt

SEQ ID NO: 204908 - DNA, 35 bp, Artificial Sequence
  Synthetic oligonucleotide
agtgtccacgatggaccttgggcgtccggctacat

SEQ ID NO: 204909 - DNA, 26 bp, Artificial Sequence
  Synthetic oligonucleotide
ctattgcatggaatcccatctgctgt

SEQ ID NO: 204910 - DNA, 35 bp, Artificial Sequence
  Synthetic oligonucleotide
acacattagccggtctgcgcatttaccgagtctcc

SEQ ID NO: 204911 - DNA, 35 bp, Artificial Sequence
  Synthetic oligonucleotide
tcactcgccctgcccggcgctcttgtatcttatat

SEQ ID NO: 204912 - DNA, 34 bp, Artificial Sequence
  Synthetic oligonucleotide
gacatccgggcattgctatatcgccattacagaa

SEQ ID NO: 204913 - DNA, 36 bp, Artificial Sequence
  Synthetic oligonucleotide
acacaagcgctatgtctggcgtgaacagttctcaca

SEQ ID NO: 204914 - DNA, 35 bp, Artificial Sequence
  Synthetic oligonucleotide
ttgcaccgatactgtgtcttgttctctcgtgccag

SEQ ID NO: 204915 - DNA, 36 bp, Artificial Sequence
  Synthetic oligonucleotide
tctagttctcaagaagccgggtagcctgccagggat

SEQ ID NO: 204916 - DNA, 36 bp, Artificial Sequence
  Synthetic oligonucleotide
accccatgctgaagaatctagttctaagcctctcca

SEQ ID NO: 204917 - DNA, 36 bp, Artificial Sequence
  Synthetic oligonucleotide
agtgggcgtctcaggataccttttttacgtcgtaca

SEQ ID NO: 204918 - DNA, 38 bp, Artificial Sequence
  Synthetic oligonucleotide
agaacagttattgtagggttgcccaacttaccgggtca

SEQ ID NO: 204919 - DNA, 36 bp, Artificial Sequence
  Synthetic oligonucleotide
tttccagtgtctacgggtagacctgttgatctggca

SEQ ID NO: 204920 - DNA, 38 bp, Artificial Sequence
  Synthetic oligonucleotide
gcccacgtcggtacgactatcaccacctgcttccttgg

SEQ ID NO: 204921 - DNA, 38 bp, Artificial Sequence
  Synthetic oligonucleotide
cataccacagattcccaggccggttgcaagatatctca

SEQ ID NO: 204922 - DNA, 37 bp, Artificial Sequence
  Synthetic oligonucleotide
tcacgcggctgttagtagattacgccatcatcccgca

SEQ ID NO: 204923 - DNA, 37 bp, Artificial Sequence
  Synthetic oligonucleotide
tactgcggcctaaccctagcaaccgtcctggaactca

SEQ ID NO: 204924 - DNA, 35 bp, Artificial Sequence
  Synthetic oligonucleotide
tgactggctccccaatccgttccatcaatttacgg

SEQ ID NO: 204925 - DNA, 35 bp, Artificial Sequence
  Synthetic oligonucleotide
ggtttttcgcgccgtgtcgttgcaggaaactaacc

SEQ ID NO: 204926 - DNA, 35 bp, Artificial Sequence
  Synthetic oligonucleotide
aggagtacagtatcggaacgccctaccgcctcgct

SEQ ID NO: 204927 - DNA, 35 bp, Artificial Sequence
  Synthetic oligonucleotide
tagccgacctacaggcaacagggacgtggccccag

SEQ ID NO: 204928 - DNA, 37 bp, Artificial Sequence
  Synthetic oligonucleotide
acttcgtctgccaacgtagccccgtggcctggctcgg

SEQ ID NO: 204929 - DNA, 35 bp, Artificial Sequence
  Synthetic oligonucleotide
taagaacggaccgtagcaaattatcttttaaagtt

SEQ ID NO: 204930 - DNA, 38 bp, Artificial Sequence
  Synthetic oligonucleotide
ccgccttccatctgatggaaagttttcctctggtttca

SEQ ID NO: 204931 - DNA, 36 bp, Artificial Sequence
  Synthetic oligonucleotide
ccatcttgagatggatcaatttaccttagtgcgaat

SEQ ID NO: 204932 - DNA, 35 bp, Artificial Sequence
  Synthetic oligonucleotide
aggccttaaaaccccggttctctccttaccacgcg

SEQ ID NO: 204933 - DNA, 35 bp, Artificial Sequence
  Synthetic oligonucleotide
cggccatagggcccccactcaacgtctgtaactag

SEQ ID NO: 204934 - DNA, 35 bp, Artificial Sequence
  Synthetic oligonucleotide
cgaacaactactagcgtatcaaaacgcccgtaaat

SEQ ID NO: 204935 - DNA, 38 bp, Artificial Sequence
  Synthetic oligonucleotide
gctgtcctaccgccatttttacatcactcatcccctca

SEQ ID NO: 204936 - DNA, 36 bp, Artificial Sequence
  Synthetic oligonucleotide
gagacttttattcacatctaagtgtgtatgtcgtat

SEQ ID NO: 204937 - DNA, 35 bp, Artificial Sequence
  Synthetic oligonucleotide
caagtacgactgcccatccagtcttctttaataag

SEQ ID NO: 204938 - DNA, 35 bp, Artificial Sequence
  Synthetic oligonucleotide
cgtgctaagctctacaatcattgcgatcccgtaag

SEQ ID NO: 204939 - DNA, 35 bp, Artificial Sequence
  Synthetic oligonucleotide
tattcaagagtattccttcaggtgtcatattttag

SEQ ID NO: 204940 - DNA, 38 bp, Artificial Sequence
  Synthetic oligonucleotide
gtacagtacggactatcagcccagctcactctttatca

SEQ ID NO: 204941 - DNA, 35 bp, Artificial Sequence
  Synthetic oligonucleotide
acgtactttcactttttgtagtgattttgcgggct

SEQ ID NO: 204942 - DNA, 36 bp, Artificial Sequence
  Synthetic oligonucleotide
accgctccctgcgaatgaagcggtggcttcctcgag

SEQ ID NO: 204943 - DNA, 36 bp, Artificial Sequence
  Synthetic oligonucleotide
accacaactgtaagcactctgacgctacaccttact

SEQ ID NO: 204944 - DNA, 36 bp, Artificial Sequence
  Synthetic oligonucleotide
atcctgcgaagtgtatgctatcactttcctccgtca

SEQ ID NO: 204945 - DNA, 35 bp, Artificial Sequence
  Synthetic oligonucleotide
cacggagtgtcgtgcgctaactccccgccgatgtc

SEQ ID NO: 204946 - DNA, 35 bp, Artificial Sequence
  Synthetic oligonucleotide
attggtatcttagaaacgagcttctgttcattaag

SEQ ID NO: 204947 - DNA, 38 bp, Artificial Sequence
  Synthetic oligonucleotide
gcgagctatgcactatccctacccggttctagccttca

SEQ ID NO: 204948 - DNA, 35 bp, Artificial Sequence
  Synthetic oligonucleotide
ttcgagatcttgccggagccagaatgagcgaacca

SEQ ID NO: 204949 - DNA, 35 bp, Artificial Sequence
  Synthetic oligonucleotide
acgctccttggttctatcccatgggcgggggccat

SEQ ID NO: 204950 - DNA, 38 bp, Artificial Sequence
  Synthetic oligonucleotide
tgttccttaatatcgaatagaacgtgtactcacgctca

SEQ ID NO: 204951 - DNA, 35 bp, Artificial Sequence
  Synthetic oligonucleotide
gctgaactcgcgcgcaacgagcatagtgcgctttt

SEQ ID NO: 204952 - DNA, 36 bp, Artificial Sequence
  Synthetic oligonucleotide
gcggatacttgtcaacctgggtttcaaaggcctaaa

SEQ ID NO: 204953 - DNA, 35 bp, Artificial Sequence
  Synthetic oligonucleotide
cacccacttccctgatgccgagggtgctggcaccc

SEQ ID NO: 204954 - DNA, 35 bp, Artificial Sequence
  Synthetic oligonucleotide
ttagtcgctctccgctgccatactcgtttcccttc

SEQ ID NO: 204955 - DNA, 35 bp, Artificial Sequence
  Synthetic oligonucleotide
cttacggcgaatttccctaacgcttataattccca

SEQ ID NO: 204956 - DNA, 35 bp, Artificial Sequence
  Synthetic oligonucleotide
gcatgccagttccatcgagccctacagttctctcg

SEQ ID NO: 204957 - DNA, 38 bp, Artificial Sequence
  Synthetic oligonucleotide
aagtaggacggttatcatggtagttaattactttttgt

SEQ ID NO: 204958 - DNA, 31 bp, Artificial Sequence
  Synthetic oligonucleotide
accgtcaaagggctacatgtgggccacctca

SEQ ID NO: 204959 - DNA, 36 bp, Artificial Sequence
  Synthetic oligonucleotide
aataatgtctttaacccagctctatcgcggttgtat

SEQ ID NO: 204960 - DNA, 37 bp, Artificial Sequence
  Synthetic oligonucleotide
accgcggctcccggattgcgtaaggcataacttttca

SEQ ID NO: 204961 - DNA, 37 bp, Artificial Sequence
  Synthetic oligonucleotide
accaaccgcaccttgggcttagctttttatatcacgt

SEQ ID NO: 204962 - DNA, 36 bp, Artificial Sequence
  Synthetic oligonucleotide
ggtgaccaggacgaggttttcattgacatcaataaa

SEQ ID NO: 204963 - DNA, 35 bp, Artificial Sequence
  Synthetic oligonucleotide
tatcgtgacgattgccgtattctggccttccacag

SEQ ID NO: 204964 - DNA, 35 bp, Artificial Sequence
  Synthetic oligonucleotide
gtctggtccttacctcgcacctgggatccttatct

SEQ ID NO: 204965 - DNA, 34 bp, Artificial Sequence
  Synthetic oligonucleotide
tccacccttcgacccacatacgtgaaccaggtat

SEQ ID NO: 204966 - DNA, 38 bp, Artificial Sequence
  Synthetic oligonucleotide
aattcgtcactcgttttgtgtagccggtgcccaattga

SEQ ID NO: 204967 - DNA, 35 bp, Artificial Sequence
  Synthetic oligonucleotide
taagtcacctccgtgttaaattttttgttaccaag

SEQ ID NO: 204968 - DNA, 36 bp, Artificial Sequence
  Synthetic oligonucleotide
acgggagtttattaaaacatgtccacgttctttcct

SEQ ID NO: 204969 - DNA, 36 bp, Artificial Sequence
  Synthetic oligonucleotide
agattacacgcgccaaagagaaacgtgtttaccgaa

SEQ ID NO: 204970 - DNA, 32 bp, Artificial Sequence
  Synthetic oligonucleotide
gaaagtttcgatacatcaaaaatgctgcctca

SEQ ID NO: 204971 - DNA, 38 bp, Artificial Sequence
  Synthetic oligonucleotide
tagtctaaacacggtgttgccgtgcgaccatatcctca

SEQ ID NO: 204972 - DNA, 36 bp, Artificial Sequence
  Synthetic oligonucleotide
atagcttagtaccatggtggtgatcttctcgagcca

SEQ ID NO: 204973 - DNA, 26 bp, Artificial Sequence
  Synthetic oligonucleotide
tggtccatgattctttttatctacgc

SEQ ID NO: 204974 - DNA, 37 bp, Artificial Sequence
  Synthetic oligonucleotide
gttgacacccatgtccttcaccgcatatcgaccacgt

SEQ ID NO: 204975 - DNA, 35 bp, Artificial Sequence
  Synthetic oligonucleotide
acctaccacccgcaatgttgcggtgttgtctatct

SEQ ID NO: 204976 - DNA, 35 bp, Artificial Sequence
  Synthetic oligonucleotide
gccctgacaccaaagtcgcacaatcaatcgtgtgc

SEQ ID NO: 204977 - DNA, 35 bp, Artificial Sequence
  Synthetic oligonucleotide
ggctgtcatgtgtgagggtcctttggaagggggcg

SEQ ID NO: 204978 - DNA, 36 bp, Artificial Sequence
  Synthetic oligonucleotide
agccctagtcagccacaacacgccgcctagcactat

SEQ ID NO: 204979 - DNA, 35 bp, Artificial Sequence
  Synthetic oligonucleotide
tccggcgttaatcacccacaacgccgtatgcatcc

SEQ ID NO: 204980 - DNA, 38 bp, Artificial Sequence
  Synthetic oligonucleotide
ccgctccggtctatttaagtgcgattttaatttgatca

SEQ ID NO: 204981 - DNA, 35 bp, Artificial Sequence
  Synthetic oligonucleotide
cccggcgaaccacgggctgtacgagcaagtcacac

SEQ ID NO: 204982 - DNA, 36 bp, Artificial Sequence
  Synthetic oligonucleotide
gttcgttgagcgaaaacgggaatttctgcctgtaag

SEQ ID NO: 204983 - DNA, 36 bp, Artificial Sequence
  Synthetic oligonucleotide
gcgtggagtgatcgctatgctaatgtgcctacgcca

SEQ ID NO: 204984 - DNA, 35 bp, Artificial Sequence
  Synthetic oligonucleotide
ccaccagagcattggtattaatactacatcaagcg

SEQ ID NO: 204985 - DNA, 29 bp, Artificial Sequence
  Synthetic oligonucleotide
tagccctgccgccgtcaatttttatgtag

SEQ ID NO: 204986 - DNA, 35 bp, Artificial Sequence
  Synthetic oligonucleotide
aggaaatgaggtatgcaatggtctcggtttatcag

SEQ ID NO: 204987 - DNA, 36 bp, Artificial Sequence
  Synthetic oligonucleotide
gttatcaggccgcacgactagtcatatggatagata

SEQ ID NO: 204988 - DNA, 35 bp, Artificial Sequence
  Synthetic oligonucleotide
atttacaactgctaccactcgggggttccgctcat

SEQ ID NO: 204989 - DNA, 36 bp, Artificial Sequence
  Synthetic oligonucleotide
gcggcgaactctgattgtcacgcaccctgtcgcaaa

SEQ ID NO: 204990 - DNA, 32 bp, Artificial Sequence
  Synthetic oligonucleotide
ggcgagccacgggctgtacgagcaagtcacac

SEQ ID NO: 204991 - DNA, 35 bp, Artificial Sequence
  Synthetic oligonucleotide
ttcccgcctaagattgctccgtgaacttcaacgca

SEQ ID NO: 204992 - DNA, 38 bp, Artificial Sequence
  Synthetic oligonucleotide
ttgggggtaaacaccgccccccacacacataccggtgg

SEQ ID NO: 204993 - DNA, 35 bp, Artificial Sequence
  Synthetic oligonucleotide
agtcgtgcctcacccgcccataaggccacctcacg

SEQ ID NO: 204994 - DNA, 35 bp, Artificial Sequence
  Synthetic oligonucleotide
accatgcaccaacgatatcatgaagtagttatctc

SEQ ID NO: 204995 - DNA, 35 bp, Artificial Sequence
  Synthetic oligonucleotide
ctcagagcccactactagcactcggctttctcgcg

SEQ ID NO: 204996 - DNA, 36 bp, Artificial Sequence
  Synthetic oligonucleotide
tccatcctgggacggggcctacctcggtgttgacca

SEQ ID NO: 204997 - DNA, 35 bp, Artificial Sequence
  Synthetic oligonucleotide
cagcatagctgctcgaactttagtcggaaatccag

SEQ ID NO: 204998 - DNA, 36 bp, Artificial Sequence
  Synthetic oligonucleotide
attgtcctccagtgaggcattccagacatcccgttt

SEQ ID NO: 204999 - DNA, 36 bp, Artificial Sequence
  Synthetic oligonucleotide
cacagaccacatgtccgcacctcgccgacgctgatt

SEQ ID NO: 205000 - DNA, 33 bp, Artificial Sequence
  Synthetic oligonucleotide
gacccgtatggctattcggccaatgcagtctca

SEQ ID NO: 205001 - DNA, 35 bp, Artificial Sequence
  Synthetic oligonucleotide
gctgcacccgtgtgtcttttatgtggcgataaacg

SEQ ID NO: 205002 - DNA, 31 bp, Artificial Sequence
  Synthetic oligonucleotide
aagccatccactaggtcctgccaatttcgtt

SEQ ID NO: 205003 - DNA, 38 bp, Artificial Sequence
  Synthetic oligonucleotide
tttctccgatgatcatggctctcgtacgtgcataatga

SEQ ID NO: 205004 - DNA, 38 bp, Artificial Sequence
  Synthetic oligonucleotide
gcgaccttgccgggttcgctatgatataccgattttgt

SEQ ID NO: 205005 - DNA, 35 bp, Artificial Sequence
  Synthetic oligonucleotide
gcaggactataaagtatctccctttaagtcatcat

SEQ ID NO: 205006 - DNA, 35 bp, Artificial Sequence
  Synthetic oligonucleotide
gggcgcccaacaaccgatacgcttactctgccccc

SEQ ID NO: 205007 - DNA, 36 bp, Artificial Sequence
  Synthetic oligonucleotide
tgcacctcgagattgcaccactcttatgttccaatt

SEQ ID NO: 205008 - DNA, 35 bp, Artificial Sequence
  Synthetic oligonucleotide
cacaagccgccttcattcactagcacatactatgg

SEQ ID NO: 205009 - DNA, 35 bp, Artificial Sequence
  Synthetic oligonucleotide
tcacttccaccctacttcgagtgctggttgctcgt

SEQ ID NO: 205010 - DNA, 36 bp, Artificial Sequence
  Synthetic oligonucleotide
gcgtagggccagtggaccttgtgctttaccaggact

SEQ ID NO: 205011 - DNA, 37 bp, Artificial Sequence
  Synthetic oligonucleotide
atcaatttctggctaaggatccgtaaatcccagttca

SEQ ID NO: 205012 - DNA, 36 bp, Artificial Sequence
  Synthetic oligonucleotide
ccacattgatcacttttacccttcgcaccctcggga

SEQ ID NO: 205013 - DNA, 35 bp, Artificial Sequence
  Synthetic oligonucleotide
tcgagtaacgagtgtgggcgaagtttcttggggtt

SEQ ID NO: 205014 - DNA, 37 bp, Artificial Sequence
  Synthetic oligonucleotide
tcccactgggcgatcttatggcatcactcggatagca

SEQ ID NO: 205015 - DNA, 37 bp, Artificial Sequence
  Synthetic oligonucleotide
atgcctggggtcattgtcaatacgctcctatttgtgt

SEQ ID NO: 205016 - DNA, 35 bp, Artificial Sequence
  Synthetic oligonucleotide
tcggcctgcttcgtcgtcgagaatcaggctcattt

SEQ ID NO: 205017 - DNA, 35 bp, Artificial Sequence
  Synthetic oligonucleotide
aggcatatccgtttctaagccctacatcccaccct

SEQ ID NO: 205018 - DNA, 38 bp, Artificial Sequence
  Synthetic oligonucleotide
cacgctccgcactgagcacgccgtctcaatgtccgtga

SEQ ID NO: 205019 - DNA, 36 bp, Artificial Sequence
  Synthetic oligonucleotide
gtgtgacccatgccatttttgttccccagttgcgca

SEQ ID NO: 205020 - DNA, 37 bp, Artificial Sequence
  Synthetic oligonucleotide
tgcatcaattcagtgtaaatcaaaactgtgtacacca

SEQ ID NO: 205021 - DNA, 35 bp, Artificial Sequence
  Synthetic oligonucleotide
cagaccccatccctacgtacatacggccaccaaat

SEQ ID NO: 205022 - DNA, 35 bp, Artificial Sequence
  Synthetic oligonucleotide
ggttctacgccctgcctgccagtactgcagagctt

SEQ ID NO: 205023 - DNA, 35 bp, Artificial Sequence
  Synthetic oligonucleotide
cgaacaactactagcgtatcaaaacgcccgtaaag

SEQ ID NO: 205024 - DNA, 35 bp, Artificial Sequence
  Synthetic oligonucleotide
ggcctctatgtaggccttaggaacaattcggattt

SEQ ID NO: 205025 - DNA, 36 bp, Artificial Sequence
  Synthetic oligonucleotide
agtgtaccagtacgggtgcttgtccaacgacataca

SEQ ID NO: 205026 - DNA, 34 bp, Artificial Sequence
  Synthetic oligonucleotide
cccttcttccgatggctgatacacaaggctattt

SEQ ID NO: 205027 - DNA, 36 bp, Artificial Sequence
  Synthetic oligonucleotide
gcttgggctcgccagccgacccctcgttgtacagca

SEQ ID NO: 205028 - DNA, 38 bp, Artificial Sequence
  Synthetic oligonucleotide
ttgtacaggtatcatcagggtgcgtgtggggtttgtgt

SEQ ID NO: 205029 - DNA, 37 bp, Artificial Sequence
  Synthetic oligonucleotide
gacaatttgacgtctacgccatacgtagcccctctgt

SEQ ID NO: 205030 - DNA, 36 bp, Artificial Sequence
  Synthetic oligonucleotide
acggtgctcacagcctcccattcagaaattgctgct

SEQ ID NO: 205031 - DNA, 35 bp, Artificial Sequence
  Synthetic oligonucleotide
ttctatgtctctgggtctccgcactcacagtctgc

SEQ ID NO: 205032 - DNA, 35 bp, Artificial Sequence
  Synthetic oligonucleotide
gtaacacgattttcacggccgaccgcatacgctcc

SEQ ID NO: 205033 - DNA, 38 bp, Artificial Sequence
  Synthetic oligonucleotide
gttcggtgccgtgcgttaatgcttctcatagtaagtca

SEQ ID NO: 205034 - DNA, 35 bp, Artificial Sequence
  Synthetic oligonucleotide
gcgatggcccagcttctaccgacctctgttatgac

SEQ ID NO: 205035 - DNA, 35 bp, Artificial Sequence
  Synthetic oligonucleotide
ttctgaacgttcttttgccctgccttatgggtgtt

SEQ ID NO: 205036 - DNA, 38 bp, Artificial Sequence
  Synthetic oligonucleotide
actgccgacccggttctccgctttctgtgtacttgtca

SEQ ID NO: 205037 - DNA, 38 bp, Artificial Sequence
  Synthetic oligonucleotide
gactccccttgttgaccgttttccatgcagtaccatgg

SEQ ID NO: 205038 - DNA, 35 bp, Artificial Sequence
  Synthetic oligonucleotide
gcttgacacgataaattcctcactcgtccgtatcg

SEQ ID NO: 205039 - DNA, 37 bp, Artificial Sequence
  Synthetic oligonucleotide
tctgtccatacgctgttctttcctcttcgaccattgt

SEQ ID NO: 205040 - DNA, 35 bp, Artificial Sequence
  Synthetic oligonucleotide
cgtaaccctgtcctcccgagtatgtaccttggctt

SEQ ID NO: 205041 - DNA, 35 bp, Artificial Sequence
  Synthetic oligonucleotide
ggcttcgaggaaactacatgtacgaagatcggaag

SEQ ID NO: 205042 - DNA, 36 bp, Artificial Sequence
  Synthetic oligonucleotide
ggtcacgacgcaggtaatatctaacgccctgtgtca

SEQ ID NO: 205043 - DNA, 35 bp, Artificial Sequence
  Synthetic oligonucleotide
agttgtaccttgctgggccattacgcgaatgcact

SEQ ID NO: 205044 - DNA, 35 bp, Artificial Sequence
  Synthetic oligonucleotide
aatagtctcactttgcccatttcaaatgtttgcca

SEQ ID NO: 205045 - DNA, 35 bp, Artificial Sequence
  Synthetic oligonucleotide
tggcatccttactgtgacatctgttggctccacca

SEQ ID NO: 205046 - DNA, 37 bp, Artificial Sequence
  Synthetic oligonucleotide
ctccggtgagacgattcccttctacgctccacgcgca

SEQ ID NO: 205047 - DNA, 35 bp, Artificial Sequence
  Synthetic oligonucleotide
ccgtaggcggtgcccgttattttcttttctataca

SEQ ID NO: 205048 - DNA, 35 bp, Artificial Sequence
  Synthetic oligonucleotide
gcctgtacgtgacgcgcccagcccctgactattgc

SEQ ID NO: 205049 - DNA, 26 bp, Artificial Sequence
  Synthetic oligonucleotide
gagcccacttatccacccattatcca

SEQ ID NO: 205050 - DNA, 35 bp, Artificial Sequence
  Synthetic oligonucleotide
accccactacctagacaccggtgtcgacaaagaaa

SEQ ID NO: 205051 - DNA, 36 bp, Artificial Sequence
  Synthetic oligonucleotide
gcagaaatcgatgcgtgacacatgccgcctaattcg

SEQ ID NO: 205052 - DNA, 34 bp, Artificial Sequence
  Synthetic oligonucleotide
aacggcttacgcagccatccgcgtaccggtgcat

SEQ ID NO: 205053 - DNA, 35 bp, Artificial Sequence
  Synthetic oligonucleotide
gcttgccacgataaattcctcactcgtccgtatcg

SEQ ID NO: 205054 - DNA, 35 bp, Artificial Sequence
  Synthetic oligonucleotide
gattcgccatttatctcacttgcatccacggacaa

SEQ ID NO: 205055 - DNA, 36 bp, Artificial Sequence
  Synthetic oligonucleotide
cgaatgaccgccgctcatgatctgtactgaggtgca

SEQ ID NO: 205056 - DNA, 36 bp, Artificial Sequence
  Synthetic oligonucleotide
agttccttatggagctcccttgttttgaacactcaa

SEQ ID NO: 205057 - DNA, 35 bp, Artificial Sequence
  Synthetic oligonucleotide
ggctgcatggatgtcttgcctagtattcctctcct

SEQ ID NO: 205058 - DNA, 35 bp, Artificial Sequence
  Synthetic oligonucleotide
tcttattagtttagcgacgatcagtctgatcgtcc

SEQ ID NO: 205059 - DNA, 36 bp, Artificial Sequence
  Synthetic oligonucleotide
catggtactacgtttacccttggctggttcggttct

SEQ ID NO: 205060 - DNA, 38 bp, Artificial Sequence
  Synthetic oligonucleotide
tctgttagttctcagatggtgttattccgccctcgtca

SEQ ID NO: 205061 - DNA, 38 bp, Artificial Sequence
  Synthetic oligonucleotide
agaattgttccagcgctacgcccggttcgtgttaatgt

SEQ ID NO: 205062 - DNA, 25 bp, Artificial Sequence
  Synthetic oligonucleotide
tccgcgttaacgcacttgatcccca

SEQ ID NO: 205063 - DNA, 35 bp, Artificial Sequence
  Synthetic oligonucleotide
taatcgatttgctaacgcattttccgcggatggaa

SEQ ID NO: 205064 - DNA, 36 bp, Artificial Sequence
  Synthetic oligonucleotide
ggaggcgagtaaaagctggaactgtatggcgttgaa

SEQ ID NO: 205065 - DNA, 35 bp, Artificial Sequence
  Synthetic oligonucleotide
gggggttttataaatgatcggcaaaattttttcag

SEQ ID NO: 205066 - DNA, 37 bp, Artificial Sequence
  Synthetic oligonucleotide
tcctggtttctggtgttttatttagcttgttacctga

SEQ ID NO: 205067 - DNA, 35 bp, Artificial Sequence
  Synthetic oligonucleotide
aagcccgaaattgcttcagccactgtaagccagcg

SEQ ID NO: 205068 - DNA, 35 bp, Artificial Sequence
  Synthetic oligonucleotide
gtaacacgattttcgcggccgaccgcatacgcgcc

SEQ ID NO: 205069 - DNA, 38 bp, Artificial Sequence
  Synthetic oligonucleotide
cactcctgagctagtaagctttacacccccgccggtgg

SEQ ID NO: 205070 - DNA, 37 bp, Artificial Sequence
  Synthetic oligonucleotide
tatggtacgccttttgacccaatactcgcctgtccca

SEQ ID NO: 205071 - DNA, 35 bp, Artificial Sequence
  Synthetic oligonucleotide
ggaatggtgtatacctccctacacgtgcccggaag

SEQ ID NO: 205072 - DNA, 35 bp, Artificial Sequence
  Synthetic oligonucleotide
gtgtttgaaatcataggtcttaattgcggccccca

SEQ ID NO: 205073 - DNA, 38 bp, Artificial Sequence
  Synthetic oligonucleotide
agcggtactccgataatatcggtttaactttagcctca

SEQ ID NO: 205074 - DNA, 35 bp, Artificial Sequence
  Synthetic oligonucleotide
gtcctaaggccaaacattcggttacccggggccat

SEQ ID NO: 205075 - DNA, 35 bp, Artificial Sequence
  Synthetic oligonucleotide
aagctcgtcgcctatctagtatcggtatggctcag

SEQ ID NO: 205076 - DNA, 35 bp, Artificial Sequence
  Synthetic oligonucleotide
gcccatcgctggagaaagatcgtcctgaacggcga

SEQ ID NO: 205077 - DNA, 35 bp, Artificial Sequence
  Synthetic oligonucleotide
tacctcctggatccgctcctttagtgtcttacaca

SEQ ID NO: 205078 - DNA, 36 bp, Artificial Sequence
  Synthetic oligonucleotide
gaatatgacctctcgcggaacccatcttgccttaca

SEQ ID NO: 205079 - DNA, 35 bp, Artificial Sequence
  Synthetic oligonucleotide
gtgatcggaaccattcatcgggctaacgcggttac

SEQ ID NO: 205080 - DNA, 36 bp, Artificial Sequence
  Synthetic oligonucleotide
aaccaagcttctcctcgcgtccgcaactgacatccg

SEQ ID NO: 205081 - DNA, 37 bp, Artificial Sequence
  Synthetic oligonucleotide
gccagcaccgatctcggcctcaagcctcaggcattca

SEQ ID NO: 205082 - DNA, 35 bp, Artificial Sequence
  Synthetic oligonucleotide
tctaagactgaatgaaggagggcctctttttgttc

SEQ ID NO: 205083 - DNA, 35 bp, Artificial Sequence
  Synthetic oligonucleotide
ctacaggtcataccctaaggttctgcacctgttat

SEQ ID NO: 205084 - DNA, 34 bp, Artificial Sequence
  Synthetic oligonucleotide
ttctatgctaggtccctatcgcgatccggttgag

SEQ ID NO: 205085 - DNA, 36 bp, Artificial Sequence
  Synthetic oligonucleotide
caccctgcggagtttactctcccgcgacctacccca

SEQ ID NO: 205086 - DNA, 35 bp, Artificial Sequence
  Synthetic oligonucleotide
tatcgtgatccgcaacgtgagaggacgtttccgcg

SEQ ID NO: 205087 - DNA, 37 bp, Artificial Sequence
  Synthetic oligonucleotide
cgggcttaccaaaatcaacacataccgcacaagtgca

SEQ ID NO: 205088 - DNA, 35 bp, Artificial Sequence
  Synthetic oligonucleotide
cccgctgtgcgcctatttctcgctgtaacatctag

SEQ ID NO: 205089 - DNA, 35 bp, Artificial Sequence
  Synthetic oligonucleotide
cgaaccctctccgtgctttcaccctatagtggaca

SEQ ID NO: 205090 - DNA, 36 bp, Artificial Sequence
  Synthetic oligonucleotide
atccttcgataggaaattgacgcgttatgaccgctt

SEQ ID NO: 205091 - DNA, 38 bp, Artificial Sequence
  Synthetic oligonucleotide
gtccatctttcatagcaattattgctgccttcgcttca

SEQ ID NO: 205092 - DNA, 38 bp, Artificial Sequence
  Synthetic oligonucleotide
ggtccgacatttctagaagtaatatataaataccgtca

SEQ ID NO: 205093 - DNA, 37 bp, Artificial Sequence
  Synthetic oligonucleotide
aaccgcctaatatacccaatgctctgtcctctgtcgt

SEQ ID NO: 205094 - DNA, 35 bp, Artificial Sequence
  Synthetic oligonucleotide
actgcgatacatctactaccaggtactgtgattaa

SEQ ID NO: 205095 - DNA, 36 bp, Artificial Sequence
  Synthetic oligonucleotide
gagcaaggctcccaggacttgctagtaacacatatg

SEQ ID NO: 205096 - DNA, 35 bp, Artificial Sequence
  Synthetic oligonucleotide
tttgtcttattccgtgggaatatgaatacaccaaa

SEQ ID NO: 205097 - DNA, 36 bp, Artificial Sequence
  Synthetic oligonucleotide
ggaccggtcgcggtacttgcggagccagcctgccag

SEQ ID NO: 205098 - DNA, 35 bp, Artificial Sequence
  Synthetic oligonucleotide
tcacagcgtagatcctcctctgctctctcgctgcg

SEQ ID NO: 205099 - DNA, 35 bp, Artificial Sequence
  Synthetic oligonucleotide
tccaaggctagtgattccctctagagtggtacccg

SEQ ID NO: 205100 - DNA, 35 bp, Artificial Sequence
  Synthetic oligonucleotide
gggaatacagccacaggtgtcaatgcccgcggtcc

SEQ ID NO: 205101 - DNA, 35 bp, Artificial Sequence
  Synthetic oligonucleotide
cccggcgagccacgggctgtacgagcaagtcacgt

SEQ ID NO: 205102 - DNA, 37 bp, Artificial Sequence
  Synthetic oligonucleotide
aacacgtatgcctgtttccactctcgctacaccgtga

SEQ ID NO: 205103 - DNA, 37 bp, Artificial Sequence
  Synthetic oligonucleotide
ggttccgtacgtgcccgagctagtctcctacgcgagt

SEQ ID NO: 205104 - DNA, 36 bp, Artificial Sequence
  Synthetic oligonucleotide
gcatgcgacataaccattacctcacacattgacacg

SEQ ID NO: 205105 - DNA, 37 bp, Artificial Sequence
  Synthetic oligonucleotide
ggacgctgcccctgcatttccgcgggcgtatgttcca

SEQ ID NO: 205106 - DNA, 35 bp, Artificial Sequence
  Synthetic oligonucleotide
ggacatgtaactcctgacgattccttctcgcacca

SEQ ID NO: 205107 - DNA, 34 bp, Artificial Sequence
  Synthetic oligonucleotide
tcctccagcccccaggaacgcgtagctattccct

SEQ ID NO: 205108 - DNA, 35 bp, Artificial Sequence
  Synthetic oligonucleotide
gagtagggtttacacttgagggcccaattgtctca

SEQ ID NO: 205109 - DNA, 36 bp, Artificial Sequence
  Synthetic oligonucleotide
tcatcaggcgctccctctgtggtgtccaagtgcgaa

SEQ ID NO: 205110 - DNA, 35 bp, Artificial Sequence
  Synthetic oligonucleotide
acggttggttcacggcgcacgtgccagtccgggac

SEQ ID NO: 205111 - DNA, 37 bp, Artificial Sequence
  Synthetic oligonucleotide
tcgttgttctcacggctttagcctcccccccgtttgt

SEQ ID NO: 205112 - DNA, 37 bp, Artificial Sequence
  Synthetic oligonucleotide
gcgtctattccgaccccacgcggttcgtgtgactgga

SEQ ID NO: 205113 - DNA, 35 bp, Artificial Sequence
  Synthetic oligonucleotide
gtccatttgctagccttttaatgtacctcccgacc

SEQ ID NO: 205114 - DNA, 37 bp, Artificial Sequence
  Synthetic oligonucleotide
gctgagttactcccgaaaggatcaccccggtactcgt

SEQ ID NO: 205115 - DNA, 36 bp, Artificial Sequence
  Synthetic oligonucleotide
tcccgcccttcccaacctagaactgtatctgacaca

SEQ ID NO: 205116 - DNA, 34 bp, Artificial Sequence
  Synthetic oligonucleotide
caacctccaaaacacaaacgacctgaatacctcc

SEQ ID NO: 205117 - DNA, 35 bp, Artificial Sequence
  Synthetic oligonucleotide
tacctgtaacaagttggttggttttgttacactag

SEQ ID NO: 205118 - DNA, 35 bp, Artificial Sequence
  Synthetic oligonucleotide
agatatatgcatctggggatcgctggggggcatca

SEQ ID NO: 205119 - DNA, 37 bp, Artificial Sequence
  Synthetic oligonucleotide
ggcttacggtactggacagcacgaaccggaccttaca

SEQ ID NO: 205120 - DNA, 35 bp, Artificial Sequence
  Synthetic oligonucleotide
gtagctggtataaatctgtgctaatcttcgcgtat

SEQ ID NO: 205121 - DNA, 35 bp, Artificial Sequence
  Synthetic oligonucleotide
tgagaatgtacggaactgcatattgggtgtctcct

SEQ ID NO: 205122 - DNA, 35 bp, Artificial Sequence
  Synthetic oligonucleotide
gtaacacgattttcatggccgaccgcatacgcgcc

SEQ ID NO: 205123 - DNA, 36 bp, Artificial Sequence
  Synthetic oligonucleotide
gtgtaatcttaccgagggtgaaagcggctagggcaa

SEQ ID NO: 205124 - DNA, 35 bp, Artificial Sequence
  Synthetic oligonucleotide
gggtctaccgcacaaggtgtaaccccccgatagct

SEQ ID NO: 205125 - DNA, 34 bp, Artificial Sequence
  Synthetic oligonucleotide
cccgtgctggtttttttgtctgagtaggagaact

SEQ ID NO: 205126 - DNA, 35 bp, Artificial Sequence
  Synthetic oligonucleotide
gacaatatctgcggctatgtgtaagctcccgccat

SEQ ID NO: 205127 - DNA, 35 bp, Artificial Sequence
  Synthetic oligonucleotide
agatttcgctcaacgttcttcaagtgagaaacccc

SEQ ID NO: 205128 - DNA, 35 bp, Artificial Sequence
  Synthetic oligonucleotide
ggccctacccatgaccttagggacggatttaaacc

SEQ ID NO: 205129 - DNA, 37 bp, Artificial Sequence
  Synthetic oligonucleotide
tgtctaataagatgtttgtacttttcccgacaatgca

SEQ ID NO: 205130 - DNA, 36 bp, Artificial Sequence
  Synthetic oligonucleotide
gcgacccacccctaaactcgcatctgtcgggtttca

SEQ ID NO: 205131 - DNA, 36 bp, Artificial Sequence
  Synthetic oligonucleotide
aagtagaaccgtactggccttaagctgtaggtcgaa

SEQ ID NO: 205132 - DNA, 35 bp, Artificial Sequence
  Synthetic oligonucleotide
ggcttcgaggaaactacatgtacgaagatcggaat

SEQ ID NO: 205133 - DNA, 36 bp, Artificial Sequence
  Synthetic oligonucleotide
gtagtgttaatttcaaatatcattacctcctactct

SEQ ID NO: 205134 - DNA, 27 bp, Artificial Sequence
  Synthetic oligonucleotide
cgtgcgttaatcatgtcatgtcacttt

SEQ ID NO: 205135 - DNA, 38 bp, Artificial Sequence
  Synthetic oligonucleotide
gggctacccgtgataatcccgccttgtctatttattca

SEQ ID NO: 205136 - DNA, 37 bp, Artificial Sequence
  Synthetic oligonucleotide
gacgatatggaggctgttccttgattgcgagctttga

SEQ ID NO: 205137 - DNA, 35 bp, Artificial Sequence
  Synthetic oligonucleotide
cgtctggacttaatcggattaatagcgctgcacat

SEQ ID NO: 205138 - DNA, 36 bp, Artificial Sequence
  Synthetic oligonucleotide
tgactgtacgggcgcactgacacccggacctatcca

SEQ ID NO: 205139 - DNA, 36 bp, Artificial Sequence
  Synthetic oligonucleotide
cagtcctctaacagccctgctcaacgaaatgcaatt

SEQ ID NO: 205140 - DNA, 38 bp, Artificial Sequence
  Synthetic oligonucleotide
catggtaccgaacctgctcttgttcgtataagccctgt

SEQ ID NO: 205141 - DNA, 36 bp, Artificial Sequence
  Synthetic oligonucleotide
ttacctctcagtttttcgtgattaccgtgggtttca

SEQ ID NO: 205142 - DNA, 36 bp, Artificial Sequence
  Synthetic oligonucleotide
tgcgacttcccgccggccactatgttggtttaatca

SEQ ID NO: 205143 - DNA, 35 bp, Artificial Sequence
  Synthetic oligonucleotide
gcgttgctgttgcactctaggagttattcggtcct

SEQ ID NO: 205144 - DNA, 38 bp, Artificial Sequence
  Synthetic oligonucleotide
cgttcgccctgatacgacgtcataagtatctttgttca

SEQ ID NO: 205145 - DNA, 37 bp, Artificial Sequence
  Synthetic oligonucleotide
ggtggcaccttttttttcggacccgagctagactgca

SEQ ID NO: 205146 - DNA, 35 bp, Artificial Sequence
  Synthetic oligonucleotide
tgctgtccagatatataagcatacgtggatgtccg

SEQ ID NO: 205147 - DNA, 35 bp, Artificial Sequence
  Synthetic oligonucleotide
gagcagtagcgaagctttatcttctagcggtgaaa

SEQ ID NO: 205148 - DNA, 37 bp, Artificial Sequence
  Synthetic oligonucleotide
tatcgttccgtactggcgaactaaccatagggaggca

SEQ ID NO: 205149 - DNA, 36 bp, Artificial Sequence
  Synthetic oligonucleotide
gctcctagtcgtagtctctatttttgaatacttgca

SEQ ID NO: 205150 - DNA, 37 bp, Artificial Sequence
  Synthetic oligonucleotide
tcatgtacgtgatttggtaccgcctaatctgctctga

SEQ ID NO: 205151 - DNA, 35 bp, Artificial Sequence
  Synthetic oligonucleotide
tttagtcatgcctttacggattcaggcccctctag

SEQ ID NO: 205152 - DNA, 37 bp, Artificial Sequence
  Synthetic oligonucleotide
cgtaataaagcgtacacttggaaatacggtgagggga

SEQ ID NO: 205153 - DNA, 38 bp, Artificial Sequence
  Synthetic oligonucleotide
atgcgaagcactttccgaccgagtatttccattggtca

SEQ ID NO: 205154 - DNA, 38 bp, Artificial Sequence
  Synthetic oligonucleotide
accaatcgcatattttggctaggggtttcctaccatga

SEQ ID NO: 205155 - DNA, 38 bp, Artificial Sequence
  Synthetic oligonucleotide
acctctattaagtgggtgtatccaccctggctgcttgt

SEQ ID NO: 205156 - DNA, 38 bp, Artificial Sequence
  Synthetic oligonucleotide
gcatgagcttcgcactagttgcactgggcctatagtca

SEQ ID NO: 205157 - DNA, 37 bp, Artificial Sequence
  Synthetic oligonucleotide
ttctgacggcattacgtagaagaacttccgcgcgggt

SEQ ID NO: 205158 - DNA, 35 bp, Artificial Sequence
  Synthetic oligonucleotide
ataaagctgcactattccggcaattttttcaactc

SEQ ID NO: 205159 - DNA, 35 bp, Artificial Sequence
  Synthetic oligonucleotide
gtggggcacaagtttcgctcgtaaaccatgttgcg

SEQ ID NO: 205160 - DNA, 37 bp, Artificial Sequence
  Synthetic oligonucleotide
tcgcgtcgcttttcattgtcttcttgtgtctgtagca

SEQ ID NO: 205161 - DNA, 35 bp, Artificial Sequence
  Synthetic oligonucleotide
tacgtaattggggggggggattctgttttgtctct

SEQ ID NO: 205162 - DNA, 34 bp, Artificial Sequence
  Synthetic oligonucleotide
ccctagggaacataattgactccatgacaacgct

SEQ ID NO: 205163 - DNA, 35 bp, Artificial Sequence
  Synthetic oligonucleotide
tcccgccgcggccctatctgcagtcgcaacccgcg

SEQ ID NO: 205164 - DNA, 35 bp, Artificial Sequence
  Synthetic oligonucleotide
atcttctcgttcactggacgctcggcatctacctt

SEQ ID NO: 205165 - DNA, 35 bp, Artificial Sequence
  Synthetic oligonucleotide
atggtataccgtaacgaaccctggtccgtctctat

SEQ ID NO: 205166 - DNA, 35 bp, Artificial Sequence
  Synthetic oligonucleotide
tgtatatgcaacgtcttcttcgccgaaattacgct

SEQ ID NO: 205167 - DNA, 37 bp, Artificial Sequence
  Synthetic oligonucleotide
cccactgtccccctccgaccgacctgagtgtgacgca

SEQ ID NO: 205168 - DNA, 37 bp, Artificial Sequence
  Synthetic oligonucleotide
tgacccttggcattcggttagtttagtgattgaacga

SEQ ID NO: 205169 - DNA, 35 bp, Artificial Sequence
  Synthetic oligonucleotide
atctcccaggctccgggtagacgcgttccgctacc

SEQ ID NO: 205170 - DNA, 35 bp, Artificial Sequence
  Synthetic oligonucleotide
tagtgacatctatgcacgtgattgtgatatcctgg

SEQ ID NO: 205171 - DNA, 36 bp, Artificial Sequence
  Synthetic oligonucleotide
ggtcactcgcaattctacggtataccgtttctacca

SEQ ID NO: 205172 - DNA, 36 bp, Artificial Sequence
  Synthetic oligonucleotide
tcggtgcatattgtccgaacgtcaacccactacaga

SEQ ID NO: 205173 - DNA, 37 bp, Artificial Sequence
  Synthetic oligonucleotide
tcatatactcaccaacgactatcgcatttcgcgctga

SEQ ID NO: 205174 - DNA, 36 bp, Artificial Sequence
  Synthetic oligonucleotide
tactcgtctaataccccgcactgttacgcaacatta

SEQ ID NO: 205175 - DNA, 36 bp, Artificial Sequence
  Synthetic oligonucleotide
cgagtgcacggatccatgctgatgggctctgatgca

SEQ ID NO: 205176 - DNA, 35 bp, Artificial Sequence
  Synthetic oligonucleotide
cgaccgcgtttaactttaaatgatcctatgccctg

SEQ ID NO: 205177 - DNA, 36 bp, Artificial Sequence
  Synthetic oligonucleotide
gtcgacccggccataaattagcgtataccaggggct

SEQ ID NO: 205178 - DNA, 35 bp, Artificial Sequence
  Synthetic oligonucleotide
ggggtgttcataccccactatgctcccagcaagac

SEQ ID NO: 205179 - DNA, 37 bp, Artificial Sequence
  Synthetic oligonucleotide
actccgcttttgccaacgctaggccagattacttaca

SEQ ID NO: 205180 - DNA, 35 bp, Artificial Sequence
  Synthetic oligonucleotide
ggtttccatgcctcgcaaattgactatgcccggcc

SEQ ID NO: 205181 - DNA, 36 bp, Artificial Sequence
  Synthetic oligonucleotide
atcggagagtctgttttctggtattcttcttaagca

SEQ ID NO: 205182 - DNA, 35 bp, Artificial Sequence
  Synthetic oligonucleotide
ttggttgcgaacaatcagtcgcgggtgtatctgcc

SEQ ID NO: 205183 - DNA, 38 bp, Artificial Sequence
  Synthetic oligonucleotide
cgcgctaccgactacgagcatgaaccttttgaatgtca

SEQ ID NO: 205184 - DNA, 36 bp, Artificial Sequence
  Synthetic oligonucleotide
ccttccgctagaggtataccgcgtcaagcaatttct

SEQ ID NO: 205185 - DNA, 36 bp, Artificial Sequence
  Synthetic oligonucleotide
ctcgcccaactgttgacaagccacagaaacgggtct

SEQ ID NO: 205186 - DNA, 38 bp, Artificial Sequence
  Synthetic oligonucleotide
tgtgacgctagagctgcacccgtacatggtctttctga

SEQ ID NO: 205187 - DNA, 35 bp, Artificial Sequence
  Synthetic oligonucleotide
cacttggacctgcgatgctctccttctgttgatcg

SEQ ID NO: 205188 - DNA, 36 bp, Artificial Sequence
  Synthetic oligonucleotide
atcctgcgaagtgtatgctatcactttcctccgtat

SEQ ID NO: 205189 - DNA, 36 bp, Artificial Sequence
  Synthetic oligonucleotide
acatacggtcgctaattgtcttacggtactggccca

SEQ ID NO: 205190 - DNA, 36 bp, Artificial Sequence
  Synthetic oligonucleotide
actgtgtctgggcttcttgtggaccgatttgtgcca

SEQ ID NO: 205191 - DNA, 35 bp, Artificial Sequence
  Synthetic oligonucleotide
taaagggtaacgataggcactctctgcttggctag

SEQ ID NO: 205192 - DNA, 35 bp, Artificial Sequence
  Synthetic oligonucleotide
gtctcctagagccaatagctttacgtcgcctccag

SEQ ID NO: 205193 - DNA, 37 bp, Artificial Sequence
  Synthetic oligonucleotide
gtccatgcgttcctctttagtctcaacgcatgcctca

SEQ ID NO: 205194 - DNA, 37 bp, Artificial Sequence
  Synthetic oligonucleotide
gtccatttaggggacccaaccatagtccggtcccgca

SEQ ID NO: 205195 - DNA, 36 bp, Artificial Sequence
  Synthetic oligonucleotide
tgttcggctgtgaatatctccctctatgctccgtca

SEQ ID NO: 205196 - DNA, 35 bp, Artificial Sequence
  Synthetic oligonucleotide
cgcgttccccctgtacgaagaccttcgctaaaccc

SEQ ID NO: 205197 - DNA, 37 bp, Artificial Sequence
  Synthetic oligonucleotide
tcatatacgcaccaacgactatcgcatttcgcgctgg

SEQ ID NO: 205198 - DNA, 35 bp, Artificial Sequence
  Synthetic oligonucleotide
gtgtgcattccttatctgataggctacgcgtatct

SEQ ID NO: 205199 - DNA, 38 bp, Artificial Sequence
  Synthetic oligonucleotide
gtctggattatagacttgttggtttttttgattagtca

SEQ ID NO: 205200 - DNA, 35 bp, Artificial Sequence
  Synthetic oligonucleotide
accatcagggtctttgtctacctcacctccgagag

SEQ ID NO: 205201 - DNA, 35 bp, Artificial Sequence
  Synthetic oligonucleotide
atatgtactgcaaaagcacttggtgtggtcatacg

SEQ ID NO: 205202 - DNA, 36 bp, Artificial Sequence
  Synthetic oligonucleotide
cgctattgcacaggttgggcacctctatggagtgca

SEQ ID NO: 205203 - DNA, 38 bp, Artificial Sequence
  Synthetic oligonucleotide
tctcaggcatgcccattattgcgttttggagcccctca

SEQ ID NO: 205204 - DNA, 36 bp, Artificial Sequence
  Synthetic oligonucleotide
ataggccccatcaccagagacttccgcccggtctca

SEQ ID NO: 205205 - DNA, 36 bp, Artificial Sequence
  Synthetic oligonucleotide
gccctccatttgcctgagatacgctcaaccttccgt

SEQ ID NO: 205206 - DNA, 36 bp, Artificial Sequence
  Synthetic oligonucleotide
ttcatcttatctttggggggaccatagcgctgggca

SEQ ID NO: 205207 - DNA, 38 bp, Artificial Sequence
  Synthetic oligonucleotide
aattcgtcactcgttgtgtgtagccggtgcccaatcga

SEQ ID NO: 205208 - DNA, 37 bp, Artificial Sequence
  Synthetic oligonucleotide
gtctccatggttcaccgagccgaatcgtttttagggt

SEQ ID NO: 205209 - DNA, 35 bp, Artificial Sequence
  Synthetic oligonucleotide
gtgcgaattctatgaagtagcaaacctggcgttcc

SEQ ID NO: 205210 - DNA, 38 bp, Artificial Sequence
  Synthetic oligonucleotide
aattcgtcactcgttgtgtgtagccggtgcccgattga

SEQ ID NO: 205211 - DNA, 35 bp, Artificial Sequence
  Synthetic oligonucleotide
gcgaccatcaacactggtcaccaactggcccttgg

SEQ ID NO: 205212 - DNA, 35 bp, Artificial Sequence
  Synthetic oligonucleotide
cgcatgttagaactatgcgttctcactatctgtgg

SEQ ID NO: 205213 - DNA, 37 bp, Artificial Sequence
  Synthetic oligonucleotide
cacttacgcacgcagttatcgcctgaaagctccccca

SEQ ID NO: 205214 - DNA, 35 bp, Artificial Sequence
  Synthetic oligonucleotide
tgggtacgcattgcccgctggtttacttcccctcc

SEQ ID NO: 205215 - DNA, 36 bp, Artificial Sequence
  Synthetic oligonucleotide
ttttcgcaatccggtgttccctggtgacagcactgt

SEQ ID NO: 205216 - DNA, 38 bp, Artificial Sequence
  Synthetic oligonucleotide
tgagtaaacggtctgagtgctacgataaccggggttgt

SEQ ID NO: 205217 - DNA, 35 bp, Artificial Sequence
  Synthetic oligonucleotide
tttacagtttttagtaacttggtgtgaggtgtcgt

SEQ ID NO: 205218 - DNA, 35 bp, Artificial Sequence
  Synthetic oligonucleotide
gtgaacgtgatgtttgcacgcgtgagcatgcagat

SEQ ID NO: 205219 - DNA, 35 bp, Artificial Sequence
  Synthetic oligonucleotide
accacctgattgcccgtggacattcatgttccatg

SEQ ID NO: 205220 - DNA, 35 bp, Artificial Sequence
  Synthetic oligonucleotide
atccggcgaaccaccggatcctcgctaggactctg

SEQ ID NO: 205221 - DNA, 33 bp, Artificial Sequence
  Synthetic oligonucleotide
gtcatggggttcagttctcaattcgtgaactcc

SEQ ID NO: 205222 - DNA, 38 bp, Artificial Sequence
  Synthetic oligonucleotide
tgaattgggggaactgtccgccacctgcgctcctatga

SEQ ID NO: 205223 - DNA, 37 bp, Artificial Sequence
  Synthetic oligonucleotide
ttgcaatccttgggacatctctgtctgatccgcgcgt

SEQ ID NO: 205224 - DNA, 35 bp, Artificial Sequence
  Synthetic oligonucleotide
atgcctggccggacctcccgtcattacactttagc

SEQ ID NO: 205225 - DNA, 35 bp, Artificial Sequence
  Synthetic oligonucleotide
aatagatccgtattatgatcgttcacagcctgttg

SEQ ID NO: 205226 - DNA, 35 bp, Artificial Sequence
  Synthetic oligonucleotide
gctatacgctcgggtccctcattagtttcgtctct

SEQ ID NO: 205227 - DNA, 35 bp, Artificial Sequence
  Synthetic oligonucleotide
ttacagtcagcaccttaatacgatcgaagttctct

SEQ ID NO: 205228 - DNA, 35 bp, Artificial Sequence
  Synthetic oligonucleotide
cccggcaagccacgggctgtacgagcaagtcacac

SEQ ID NO: 205229 - DNA, 35 bp, Artificial Sequence
  Synthetic oligonucleotide
ggtatatcctcttgttcactcgccaagtatgtcct

SEQ ID NO: 205230 - DNA, 35 bp, Artificial Sequence
  Synthetic oligonucleotide
tttccgaggaagctcaacccgcatacattctagcc

SEQ ID NO: 205231 - DNA, 35 bp, Artificial Sequence
  Synthetic oligonucleotide
acaatccgtgccttctccatggcccgtttaatccg

SEQ ID NO: 205232 - DNA, 36 bp, Artificial Sequence
  Synthetic oligonucleotide
ggcttcgaggctgtttgtgcccacaaatgtttttca

SEQ ID NO: 205233 - DNA, 36 bp, Artificial Sequence
  Synthetic oligonucleotide
gttgacccatgatttgcgtaactcgttccctctgca

SEQ ID NO: 205234 - DNA, 36 bp, Artificial Sequence
  Synthetic oligonucleotide
atgggggtcccatatactactggcgtcaccggctaa

SEQ ID NO: 205235 - DNA, 38 bp, Artificial Sequence
  Synthetic oligonucleotide
tctgattactgcgacctaatcactggtgaattttgtca

SEQ ID NO: 205236 - DNA, 35 bp, Artificial Sequence
  Synthetic oligonucleotide
catattactatcgggtcctccctagctgtcatact

SEQ ID NO: 205237 - DNA, 38 bp, Artificial Sequence
  Synthetic oligonucleotide
gcaagtcaggcccttcagagccactatactatccatgg

SEQ ID NO: 205238 - DNA, 35 bp, Artificial Sequence
  Synthetic oligonucleotide
ccgtagtcccaacccggcattattatgggacaccg

SEQ ID NO: 205239 - DNA, 37 bp, Artificial Sequence
  Synthetic oligonucleotide
gcaacctaaatcgctgctaccatttcatttaatcgca

SEQ ID NO: 205240 - DNA, 36 bp, Artificial Sequence
  Synthetic oligonucleotide
attgcgttgtcccctgcttcacattcccaattcaga

SEQ ID NO: 205241 - DNA, 35 bp, Artificial Sequence
  Synthetic oligonucleotide
cttaagtacgaccgattctgatatccatgttatct

SEQ ID NO: 205242 - DNA, 35 bp, Artificial Sequence
  Synthetic oligonucleotide
gcccctcgtggggaatttcccggtataaatcgaac

SEQ ID NO: 205243 - DNA, 37 bp, Artificial Sequence
  Synthetic oligonucleotide
ctatgtgtgcgctccttcccattgatgtactttaaga

SEQ ID NO: 205244 - DNA, 36 bp, Artificial Sequence
  Synthetic oligonucleotide
ccctcctcgggtgactcgatttgattgtaatatgta

SEQ ID NO: 205245 - DNA, 36 bp, Artificial Sequence
  Synthetic oligonucleotide
cacctggaggtaatagcgcctaactcatctgttcca

SEQ ID NO: 205246 - DNA, 36 bp, Artificial Sequence
  Synthetic oligonucleotide
tgccgaagtactgctagcagtcacctccatctcaca

SEQ ID NO: 205247 - DNA, 35 bp, Artificial Sequence
  Synthetic oligonucleotide
gctagtcacttacagtgacgttactgtcttgagat

SEQ ID NO: 205248 - DNA, 36 bp, Artificial Sequence
  Synthetic oligonucleotide
cgagctggatctctcgttgacttcactggttcataa

SEQ ID NO: 205249 - DNA, 36 bp, Artificial Sequence
  Synthetic oligonucleotide
tgtaaccgcccagcccccgcagctgcctcaacggga

SEQ ID NO: 205250 - DNA, 36 bp, Artificial Sequence
  Synthetic oligonucleotide
gaggcggagtttcatcctgccgttctagcacagcca

SEQ ID NO: 205251 - DNA, 37 bp, Artificial Sequence
  Synthetic oligonucleotide
cttccagcactgtcttcacccccagtactccttcaca

SEQ ID NO: 205252 - DNA, 35 bp, Artificial Sequence
  Synthetic oligonucleotide
cccctggttgaagtcacttctgaacgattcgctca

SEQ ID NO: 205253 - DNA, 35 bp, Artificial Sequence
  Synthetic oligonucleotide
catcccgaggatcttttggctctttcaaggttcca

SEQ ID NO: 205254 - DNA, 36 bp, Artificial Sequence
  Synthetic oligonucleotide
atgaagcagtccgttgttgcccacgatcatcttgtt

SEQ ID NO: 205255 - DNA, 36 bp, Artificial Sequence
  Synthetic oligonucleotide
atccgtctttgccccccggagtgaataatactccaa

SEQ ID NO: 205256 - DNA, 37 bp, Artificial Sequence
  Synthetic oligonucleotide
atgaatatagacgcctacctgcgagcgacccagccca

SEQ ID NO: 205257 - DNA, 38 bp, Artificial Sequence
  Synthetic oligonucleotide
aattagcgtgcgtaggctgccgactccaagcccactca

SEQ ID NO: 205258 - DNA, 37 bp, Artificial Sequence
  Synthetic oligonucleotide
cccttatagaggttgatcatccacgtggatccgtaca

SEQ ID NO: 205259 - DNA, 35 bp, Artificial Sequence
  Synthetic oligonucleotide
ttctggtagatatccatcgatggttcttttcacct

SEQ ID NO: 205260 - DNA, 35 bp, Artificial Sequence
  Synthetic oligonucleotide
taccggtcggtgagtccaccatgttctcctaataa

SEQ ID NO: 205261 - DNA, 36 bp, Artificial Sequence
  Synthetic oligonucleotide
gggaacgattcagtcttatcgctctctggattttag

SEQ ID NO: 205262 - DNA, 37 bp, Artificial Sequence
  Synthetic oligonucleotide
gtagcctacgccagttacctcaatgcgtatttcctga

SEQ ID NO: 205263 - DNA, 35 bp, Artificial Sequence
  Synthetic oligonucleotide
ccctacgctcgctccggcgactattccgcggggat

SEQ ID NO: 205264 - DNA, 35 bp, Artificial Sequence
  Synthetic oligonucleotide
tgattcttaggctgagtcctcaggattgacactgt

SEQ ID NO: 205265 - DNA, 37 bp, Artificial Sequence
  Synthetic oligonucleotide
gcgtcgaaacgctgccaagtagaaccggggtttgtca

SEQ ID NO: 205266 - DNA, 35 bp, Artificial Sequence
  Synthetic oligonucleotide
accatcagggtctttgtctacctcacctccgagat

SEQ ID NO: 205267 - DNA, 35 bp, Artificial Sequence
  Synthetic oligonucleotide
gccatccgcgaaatcgcaagatgccgtcgacccag

SEQ ID NO: 205268 - DNA, 38 bp, Artificial Sequence
  Synthetic oligonucleotide
ttctagagctccactctaagcccctttcattgttttca

SEQ ID NO: 205269 - DNA, 35 bp, Artificial Sequence
  Synthetic oligonucleotide
attctcttcggcattgcatctatttgattaggtac

SEQ ID NO: 205270 - DNA, 35 bp, Artificial Sequence
  Synthetic oligonucleotide
ttgccttaatcaggtctacggtgttcgtggttgcc

SEQ ID NO: 205271 - DNA, 36 bp, Artificial Sequence
  Synthetic oligonucleotide
gatctggtgtatcgttagtttatatcgcgccgggct

SEQ ID NO: 205272 - DNA, 36 bp, Artificial Sequence
  Synthetic oligonucleotide
tcatttttctgtaaccggtaacttattctatcagca

SEQ ID NO: 205273 - DNA, 35 bp, Artificial Sequence
  Synthetic oligonucleotide
ttacgcattcgctcgcacaagagcgaaattaccag

SEQ ID NO: 205274 - DNA, 35 bp, Artificial Sequence
  Synthetic oligonucleotide
ttgtactcagtgtgagaagtgatcgacgaatacca

SEQ ID NO: 205275 - DNA, 37 bp, Artificial Sequence
  Synthetic oligonucleotide
cacgcgtcgaagcgtttttccctggcttcctcaatca

SEQ ID NO: 205276 - DNA, 37 bp, Artificial Sequence
  Synthetic oligonucleotide
gccgcgtgaggccttgcctttttttggtaatctcgca

SEQ ID NO: 205277 - DNA, 35 bp, Artificial Sequence
  Synthetic oligonucleotide
gccacgcaccaggaatctctgaatacagagatccc

SEQ ID NO: 205278 - DNA, 35 bp, Artificial Sequence
  Synthetic oligonucleotide
cccggcgagccacgggctgtacgagcaagttacac

SEQ ID NO: 205279 - DNA, 36 bp, Artificial Sequence
  Synthetic oligonucleotide
tccgcggccctctacgtactagccggcatcacctca

SEQ ID NO: 205280 - DNA, 37 bp, Artificial Sequence
  Synthetic oligonucleotide
accctggttattgatcccggaagttcggttccgttca

SEQ ID NO: 205281 - DNA, 26 bp, Artificial Sequence
  Synthetic oligonucleotide
ccccgaacttttaccattctcaatca

SEQ ID NO: 205282 - DNA, 35 bp, Artificial Sequence
  Synthetic oligonucleotide
ctttgacatttgcggacattatccgacgccttcac

SEQ ID NO: 205283 - DNA, 35 bp, Artificial Sequence
  Synthetic oligonucleotide
ccctgcttctggtggagaaacgcccattattgcag

SEQ ID NO: 205284 - DNA, 37 bp, Artificial Sequence
  Synthetic oligonucleotide
agagaaatccttccgctttgattgatcgaaaccggca

SEQ ID NO: 205285 - DNA, 35 bp, Artificial Sequence
  Synthetic oligonucleotide
cacggggtgtcgtgcgccaactccccgccgatgtc

SEQ ID NO: 205286 - DNA, 35 bp, Artificial Sequence
  Synthetic oligonucleotide
aatgccctggagccgcacccgggttagccgttcat

SEQ ID NO: 205287 - DNA, 35 bp, Artificial Sequence
  Synthetic oligonucleotide
gttgcctgctccgacggatctaagacccgctcgtt

SEQ ID NO: 205288 - DNA, 36 bp, Artificial Sequence
  Synthetic oligonucleotide
ccgctgggatcctgttacgatccgctcctctcttat

SEQ ID NO: 205289 - DNA, 35 bp, Artificial Sequence
  Synthetic oligonucleotide
gggcggtgtgatgcccactagcgtaaggacgagcc

SEQ ID NO: 205290 - DNA, 35 bp, Artificial Sequence
  Synthetic oligonucleotide
attgagtggcttcctgaacttctaaacttgagggt

SEQ ID NO: 205291 - DNA, 36 bp, Artificial Sequence
  Synthetic oligonucleotide
gtccacaaacctataatcagggattcagttccgtca

SEQ ID NO: 205292 - DNA, 35 bp, Artificial Sequence
  Synthetic oligonucleotide
agtggctacacaattgttcgtggtcttctctcgtg

SEQ ID NO: 205293 - DNA, 35 bp, Artificial Sequence
  Synthetic oligonucleotide
tggctacgcgcgattagttacgcgttaatcttcaa

SEQ ID NO: 205294 - DNA, 36 bp, Artificial Sequence
  Synthetic oligonucleotide
ctggctctttatagatccgtcatcttactaggtttt

SEQ ID NO: 205295 - DNA, 37 bp, Artificial Sequence
  Synthetic oligonucleotide
gtattaatagtgtggaagctaacgggatagggtgcga

SEQ ID NO: 205296 - DNA, 35 bp, Artificial Sequence
  Synthetic oligonucleotide
gctagcgtgagtccattctaaattactgttgtcca

SEQ ID NO: 205297 - DNA, 36 bp, Artificial Sequence
  Synthetic oligonucleotide
cctcatcttcgggcgtactcgagaagcgggccccaa

SEQ ID NO: 205298 - DNA, 35 bp, Artificial Sequence
  Synthetic oligonucleotide
ggcctatggttgtgtgacgtcggaccctcctcgcg

SEQ ID NO: 205299 - DNA, 36 bp, Artificial Sequence
  Synthetic oligonucleotide
acgtctaatgcggtacgtctattttcatcgatttct

SEQ ID NO: 205300 - DNA, 35 bp, Artificial Sequence
  Synthetic oligonucleotide
gtgcgcctcgttttcaacctctcgtacgcatccct

SEQ ID NO: 205301 - DNA, 38 bp, Artificial Sequence
  Synthetic oligonucleotide
ttagagtacagtccataacacatttgccggcccactca

SEQ ID NO: 205302 - DNA, 35 bp, Artificial Sequence
  Synthetic oligonucleotide
gtctcgtcgccccttgttgacatgtgttcctcgcg

SEQ ID NO: 205303 - DNA, 35 bp, Artificial Sequence
  Synthetic oligonucleotide
caataaggtctgctcccgtctgttcgttcccttct

SEQ ID NO: 205304 - DNA, 36 bp, Artificial Sequence
  Synthetic oligonucleotide
gacttttaagctattttaacattgaccccccggcca

SEQ ID NO: 205305 - DNA, 35 bp, Artificial Sequence
  Synthetic oligonucleotide
gaaccaaacagccttccagttcaacccgaaaagca

SEQ ID NO: 205306 - DNA, 36 bp, Artificial Sequence
  Synthetic oligonucleotide
ggccattgatcctcgtccttgtttcgcgtcctctca

SEQ ID NO: 205307 - DNA, 38 bp, Artificial Sequence
  Synthetic oligonucleotide
tcgacctatttgcggactcattttttacaatgaactca

SEQ ID NO: 205308 - DNA, 36 bp, Artificial Sequence
  Synthetic oligonucleotide
tgttccgtgtgaacggaccaagcacatttaccgggg

SEQ ID NO: 205309 - DNA, 35 bp, Artificial Sequence
  Synthetic oligonucleotide
gtttgaccgcgttgtacgtctatatctcttcgtat

SEQ ID NO: 205310 - DNA, 37 bp, Artificial Sequence
  Synthetic oligonucleotide
gtaggaaattggcccccatctcctcaacttacatcca

SEQ ID NO: 205311 - DNA, 36 bp, Artificial Sequence
  Synthetic oligonucleotide
actactctaaaccaccagagtgtctatcctatcaca

SEQ ID NO: 205312 - DNA, 35 bp, Artificial Sequence
  Synthetic oligonucleotide
tcacggcctatccgacgcaccgacaggtacgctcg

SEQ ID NO: 205313 - DNA, 36 bp, Artificial Sequence
  Synthetic oligonucleotide
ttcggaatgggctagggctacatagaagtctttatt

SEQ ID NO: 205314 - DNA, 37 bp, Artificial Sequence
  Synthetic oligonucleotide
gagcttggtaatccccgaccgtttatctttaacagca

SEQ ID NO: 205315 - DNA, 38 bp, Artificial Sequence
  Synthetic oligonucleotide
ctcctggtcccttttcagaggcactacgcgcttcgtga

SEQ ID NO: 205316 - DNA, 35 bp, Artificial Sequence
  Synthetic oligonucleotide
gtactcttgctatgggccccgtactccgaccccgt

SEQ ID NO: 205317 - DNA, 35 bp, Artificial Sequence
  Synthetic oligonucleotide
gtctaatccgggttctattcaataaatattacctt

SEQ ID NO: 205318 - DNA, 35 bp, Artificial Sequence
  Synthetic oligonucleotide
cgggcccgctcgctccgccttttcattggtgtttt

SEQ ID NO: 205319 - DNA, 35 bp, Artificial Sequence
  Synthetic oligonucleotide
tgaggagtacccgcatttaagcttgtacttaccca

SEQ ID NO: 205320 - DNA, 38 bp, Artificial Sequence
  Synthetic oligonucleotide
tccgcctctaatttccttcctgttactcaggtaggtca

SEQ ID NO: 205321 - DNA, 35 bp, Artificial Sequence
  Synthetic oligonucleotide
tcaggaccacatacctaccaggattgctaacgtca

SEQ ID NO: 205322 - DNA, 35 bp, Artificial Sequence
  Synthetic oligonucleotide
catgcacagttgagcaattctacaccagatatccc

SEQ ID NO: 205323 - DNA, 37 bp, Artificial Sequence
  Synthetic oligonucleotide
aacgtgaggtattacatcctaactcgagccttactgt

SEQ ID NO: 205324 - DNA, 36 bp, Artificial Sequence
  Synthetic oligonucleotide
tttccaggtgccgaaacgtatgtcgaaatgattcca

SEQ ID NO: 205325 - DNA, 38 bp, Artificial Sequence
  Synthetic oligonucleotide
accatcctctccgaggcgatggatcggatgccccgtgt

SEQ ID NO: 205326 - DNA, 35 bp, Artificial Sequence
  Synthetic oligonucleotide
tccgtttatctacttttccggtactgttcccgtct

SEQ ID NO: 205327 - DNA, 35 bp, Artificial Sequence
  Synthetic oligonucleotide
gactcggctatcaacgctcgagcttgctctccccg

SEQ ID NO: 205328 - DNA, 35 bp, Artificial Sequence
  Synthetic oligonucleotide
tggaggttcctcctgcgcttacccggttatcagct

SEQ ID NO: 205329 - DNA, 35 bp, Artificial Sequence
  Synthetic oligonucleotide
taagcgcgctcctggcggacatcataaacaagcag

SEQ ID NO: 205330 - DNA, 36 bp, Artificial Sequence
  Synthetic oligonucleotide
ggtgtgaagcaggttgcatccttgtccctcggttaa

SEQ ID NO: 205331 - DNA, 35 bp, Artificial Sequence
  Synthetic oligonucleotide
tatgccgtccgtcgtgaaaatttaggcaatctcgc

SEQ ID NO: 205332 - DNA, 35 bp, Artificial Sequence
  Synthetic oligonucleotide
ttgcgtcgtgactacaaacgcagcctttcactgca

SEQ ID NO: 205333 - DNA, 35 bp, Artificial Sequence
  Synthetic oligonucleotide
ctacacagcgttgcccggttcggttcgttccttac

SEQ ID NO: 205334 - DNA, 37 bp, Artificial Sequence
  Synthetic oligonucleotide
ctaccactagtcacttgtcattggcccggtccgggca

SEQ ID NO: 205335 - DNA, 35 bp, Artificial Sequence
  Synthetic oligonucleotide
tctgctgcacctaaccatatcctgaaccactgccc

SEQ ID NO: 205336 - DNA, 35 bp, Artificial Sequence
  Synthetic oligonucleotide
taatcagactgtagacatattcgtcctcataatca

SEQ ID NO: 205337 - DNA, 35 bp, Artificial Sequence
  Synthetic oligonucleotide
gcatggtgtgcgaggtcttggatcaaaagtgctca

SEQ ID NO: 205338 - DNA, 35 bp, Artificial Sequence
  Synthetic oligonucleotide
tcacaggatgttatactgtcaaactcgctctatcc

SEQ ID NO: 205339 - DNA, 36 bp, Artificial Sequence
  Synthetic oligonucleotide
tggccgaggccatcccaccctttttgcgtatcgcta

SEQ ID NO: 205340 - DNA, 35 bp, Artificial Sequence
  Synthetic oligonucleotide
cctaagcccgatgctaccgcacctttgcactgact

SEQ ID NO: 205341 - DNA, 35 bp, Artificial Sequence
  Synthetic oligonucleotide
ttcactccacttttgttcatccgcgacttacccga

SEQ ID NO: 205342 - DNA, 37 bp, Artificial Sequence
  Synthetic oligonucleotide
actcttgggcgtctacatttctcagggggtttccgca

SEQ ID NO: 205343 - DNA, 35 bp, Artificial Sequence
  Synthetic oligonucleotide
gaagggcgttccagggtttagttctatactccgcg

SEQ ID NO: 205344 - DNA, 35 bp, Artificial Sequence
  Synthetic oligonucleotide
atgcagttgtagcgcctcactcgttgtcctggaag

SEQ ID NO: 205345 - DNA, 35 bp, Artificial Sequence
  Synthetic oligonucleotide
ttctgcctgagaacaggcggtattttcgtttaaat

SEQ ID NO: 205346 - DNA, 36 bp, Artificial Sequence
  Synthetic oligonucleotide
gcgtagggccagtggaccttgtgctttaccaggaaa

SEQ ID NO: 205347 - DNA, 35 bp, Artificial Sequence
  Synthetic oligonucleotide
gcttgagctgctgttcgttcttagctacttttcta

SEQ ID NO: 205348 - DNA, 36 bp, Artificial Sequence
  Synthetic oligonucleotide
gcatcgtcctactattccgcacattaccgtcccaca

SEQ ID NO: 205349 - DNA, 36 bp, Artificial Sequence
  Synthetic oligonucleotide
tgaagctgtcttatctatcgcgacactcctcccagt

SEQ ID NO: 205350 - DNA, 37 bp, Artificial Sequence
  Synthetic oligonucleotide
ttggcgccttggaacgcaacgcaagccttgtgtccca

SEQ ID NO: 205351 - DNA, 35 bp, Artificial Sequence
  Synthetic oligonucleotide
atgctgcggagtcgcgtccctacttccgaatgtat

SEQ ID NO: 205352 - DNA, 35 bp, Artificial Sequence
  Synthetic oligonucleotide
gctgatcctgccactactcgtgatatcttttcccc

SEQ ID NO: 205353 - DNA, 35 bp, Artificial Sequence
  Synthetic oligonucleotide
tccaaaagttatcagccctaacactgccccagact

SEQ ID NO: 205354 - DNA, 37 bp, Artificial Sequence
  Synthetic oligonucleotide
gttctatctgaggcgccccggtcctttttcgttgaca

SEQ ID NO: 205355 - DNA, 35 bp, Artificial Sequence
  Synthetic oligonucleotide
gctgcctgggaggattttctcctctagtcaaccat

SEQ ID NO: 205356 - DNA, 35 bp, Artificial Sequence
  Synthetic oligonucleotide
aatacgttgccggtcgacgtccattctttggacag

SEQ ID NO: 205357 - DNA, 36 bp, Artificial Sequence
  Synthetic oligonucleotide
gatgcaatccaatcctgatcttctctgtgatagctg

SEQ ID NO: 205358 - DNA, 36 bp, Artificial Sequence
  Synthetic oligonucleotide
attgcctcgcatgttcggcctagacacaaggaagca

SEQ ID NO: 205359 - DNA, 35 bp, Artificial Sequence
  Synthetic oligonucleotide
tccggtatcctggtggtaaaggctgctactcatac

SEQ ID NO: 205360 - DNA, 35 bp, Artificial Sequence
  Synthetic oligonucleotide
cgcagtcattttggtatctcgctttataacgtgct

SEQ ID NO: 205361 - DNA, 35 bp, Artificial Sequence
  Synthetic oligonucleotide
ttcgccgacccgtccttcagtcttgaatcctggcg

SEQ ID NO: 205362 - DNA, 35 bp, Artificial Sequence
  Synthetic oligonucleotide
aatggcccatctatgcatttgcggacaggtttacc

SEQ ID NO: 205363 - DNA, 35 bp, Artificial Sequence
  Synthetic oligonucleotide
gcacacgtaggcctcctccccaatcactccggtgt

SEQ ID NO: 205364 - DNA, 35 bp, Artificial Sequence
  Synthetic oligonucleotide
ctcataattttgaatgccgtagtgacctatgcttc

SEQ ID NO: 205365 - DNA, 35 bp, Artificial Sequence
  Synthetic oligonucleotide
cctgccggaaatcgtcagtcctgtccgcacgatat

SEQ ID NO: 205366 - DNA, 35 bp, Artificial Sequence
  Synthetic oligonucleotide
gtccagcccttgaatgctatctagcctctcgtgtt

SEQ ID NO: 205367 - DNA, 37 bp, Artificial Sequence
  Synthetic oligonucleotide
ggcatcaattcagtgtaaatcaaaactgtgtacacga

SEQ ID NO: 205368 - DNA, 38 bp, Artificial Sequence
  Synthetic oligonucleotide
gtgttgcgcgcaccgaatagcttgctgactgagattca

SEQ ID NO: 205369 - DNA, 36 bp, Artificial Sequence
  Synthetic oligonucleotide
gcataatcaatatgctgggttccttaggaccgaccg

SEQ ID NO: 205370 - DNA, 38 bp, Artificial Sequence
  Synthetic oligonucleotide
aacgatttgcgtttcgcatactgttccctctccgttgt

SEQ ID NO: 205371 - DNA, 35 bp, Artificial Sequence
  Synthetic oligonucleotide
taccgtcatctgtgcgcttcctgtttcacacggac

SEQ ID NO: 205372 - DNA, 36 bp, Artificial Sequence
  Synthetic oligonucleotide
tttgcgttaatctaactgctgccgtatctggctcca

SEQ ID NO: 205373 - DNA, 36 bp, Artificial Sequence
  Synthetic oligonucleotide
tgccgtacttgcatcaatactgcgtcttctacggca

SEQ ID NO: 205374 - DNA, 35 bp, Artificial Sequence
  Synthetic oligonucleotide
ggcacatcccctcacccaggcggtcattggtgttg

SEQ ID NO: 205375 - DNA, 37 bp, Artificial Sequence
  Synthetic oligonucleotide
gtggtcccaaacacactgttcacgtctggggacgtca

SEQ ID NO: 205376 - DNA, 36 bp, Artificial Sequence
  Synthetic oligonucleotide
tttatccaccatttcgtagcccgacgcctgttatat

SEQ ID NO: 205377 - DNA, 37 bp, Artificial Sequence
  Synthetic oligonucleotide
ggtcgtctttctcaacttattccctgggttctcaaga

SEQ ID NO: 205378 - DNA, 36 bp, Artificial Sequence
  Synthetic oligonucleotide
tgagtcctccattcctcgcttcccgcgtgttactca

SEQ ID NO: 205379 - DNA, 35 bp, Artificial Sequence
  Synthetic oligonucleotide
ggtatacctatgattgtcagggtaggtaaaacgca

SEQ ID NO: 205380 - DNA, 37 bp, Artificial Sequence
  Synthetic oligonucleotide
aatattggatgcgaatagggggctttgtacatggtca

SEQ ID NO: 205381 - DNA, 38 bp, Artificial Sequence
  Synthetic oligonucleotide
gacagctacctgcccgaaaggaacgcctttctcattca

SEQ ID NO: 205382 - DNA, 35 bp, Artificial Sequence
  Synthetic oligonucleotide
atcgcccacacgatggtttctcgctacgatgatca

SEQ ID NO: 205383 - DNA, 36 bp, Artificial Sequence
  Synthetic oligonucleotide
gctgccagtgcactacctatgaccagggtactacta

SEQ ID NO: 205384 - DNA, 37 bp, Artificial Sequence
  Synthetic oligonucleotide
gcctcgtgaggccttgcctttttttggtaatctcgga

SEQ ID NO: 205385 - DNA, 35 bp, Artificial Sequence
  Synthetic oligonucleotide
tttaggaacgaagaaccccggctccgactctagct

SEQ ID NO: 205386 - DNA, 37 bp, Artificial Sequence
  Synthetic oligonucleotide
agctcactcaatagtcgactacggtcgcaccacccca

SEQ ID NO: 205387 - DNA, 36 bp, Artificial Sequence
  Synthetic oligonucleotide
accgtagccacttaaattgttgccaggacatggcaa

SEQ ID NO: 205388 - DNA, 38 bp, Artificial Sequence
  Synthetic oligonucleotide
gaccccgatcatcgcacgactcacaggtagtatgttca

SEQ ID NO: 205389 - DNA, 38 bp, Artificial Sequence
  Synthetic oligonucleotide
gctttccaatgttgggtggcaacacctcccgcttttga

SEQ ID NO: 205390 - DNA, 36 bp, Artificial Sequence
  Synthetic oligonucleotide
tgtctggttggagcattagccataggctttccacca

SEQ ID NO: 205391 - DNA, 36 bp, Artificial Sequence
  Synthetic oligonucleotide
aattctctctggttcccaaggaggaacgactaagtt

SEQ ID NO: 205392 - DNA, 27 bp, Artificial Sequence
  Synthetic oligonucleotide
acaacacgggatatcacagtgagggat

SEQ ID NO: 205393 - DNA, 36 bp, Artificial Sequence
  Synthetic oligonucleotide
gcactatgggaagaacctaatcggtgaagcaccgtt

SEQ ID NO: 205394 - DNA, 37 bp, Artificial Sequence
  Synthetic oligonucleotide
ccgtatcaacttcagcatgcatgtgtctcgcccccgt

SEQ ID NO: 205395 - DNA, 38 bp, Artificial Sequence
  Synthetic oligonucleotide
tgtactccttcccacgacgtgcgccatgcctagcatca

SEQ ID NO: 205396 - DNA, 37 bp, Artificial Sequence
  Synthetic oligonucleotide
gagagatttttgatgctttcgcccgtgtcgtagtaca

SEQ ID NO: 205397 - DNA, 36 bp, Artificial Sequence
  Synthetic oligonucleotide
tctgctacggttgtttggcctcagtttatactccat

SEQ ID NO: 205398 - DNA, 36 bp, Artificial Sequence
  Synthetic oligonucleotide
cgatctcgcgtatgcgtaccgtactttggtgtatca

SEQ ID NO: 205399 - DNA, 36 bp, Artificial Sequence
  Synthetic oligonucleotide
taaagcgtgcttagtgttattctggtcttcctcaca

SEQ ID NO: 205400 - DNA, 36 bp, Artificial Sequence
  Synthetic oligonucleotide
cgcccttccgtactgcccgaactatgtaattctagt

SEQ ID NO: 205401 - DNA, 35 bp, Artificial Sequence
  Synthetic oligonucleotide
tctgaccagagggacaccatgcttcttctgcgcca

SEQ ID NO: 205402 - DNA, 27 bp, Artificial Sequence
  Synthetic oligonucleotide
cgcctcataccagcccgattcggttgt

SEQ ID NO: 205403 - DNA, 35 bp, Artificial Sequence
  Synthetic oligonucleotide
tgccgccctcatattgacatatctgttagtgccat

SEQ ID NO: 205404 - DNA, 37 bp, Artificial Sequence
  Synthetic oligonucleotide
ggaccctgggcattcggttagtttagtgattgaacga

SEQ ID NO: 205405 - DNA, 35 bp, Artificial Sequence
  Synthetic oligonucleotide
gacacagtgtttcatcgtaccgttatgcttaccag

SEQ ID NO: 205406 - DNA, 35 bp, Artificial Sequence
  Synthetic oligonucleotide
ggatagttccgagagtaagcccctatgcagtcatt

SEQ ID NO: 205407 - DNA, 38 bp, Artificial Sequence
  Synthetic oligonucleotide
ttccaatcaacttctgcctcttcgactgtcttgcttgt

SEQ ID NO: 205408 - DNA, 35 bp, Artificial Sequence
  Synthetic oligonucleotide
cacgctgtgaacttcccccccattcgctagccgtg

SEQ ID NO: 205409 - DNA, 35 bp, Artificial Sequence
  Synthetic oligonucleotide
gatgttgtccctggtctcaggcttaattcatgccc

SEQ ID NO: 205410 - DNA, 36 bp, Artificial Sequence
  Synthetic oligonucleotide
gttgtgcggtttgggtctcaggcaagtccactttaa

SEQ ID NO: 205411 - DNA, 38 bp, Artificial Sequence
  Synthetic oligonucleotide
tcgtgtgatctggttcccgtaagtagaagtcggaatga

SEQ ID NO: 205412 - DNA, 29 bp, Artificial Sequence
  Synthetic oligonucleotide
catgcaacagctcaccgctatattgtttg

SEQ ID NO: 205413 - DNA, 37 bp, Artificial Sequence
  Synthetic oligonucleotide
cacccgatactagtactacatccgcataactatccca

SEQ ID NO: 205414 - DNA, 37 bp, Artificial Sequence
  Synthetic oligonucleotide
tgctgtggtagccgctttatcgtgcgttgtaatctca

SEQ ID NO: 205415 - DNA, 36 bp, Artificial Sequence
  Synthetic oligonucleotide
gttgtgcggtttgggtctcaggcaagtccactttct

SEQ ID NO: 205416 - DNA, 35 bp, Artificial Sequence
  Synthetic oligonucleotide
gcgggagaaaatgggtctcgcaccgagacatcttt

SEQ ID NO: 205417 - DNA, 38 bp, Artificial Sequence
  Synthetic oligonucleotide
gccacccactttatggtatcaccttatacccacggtca

SEQ ID NO: 205418 - DNA, 37 bp, Artificial Sequence
  Synthetic oligonucleotide
catgactgcccggttctggcttcttgggcgcttcttt

SEQ ID NO: 205419 - DNA, 35 bp, Artificial Sequence
  Synthetic oligonucleotide
cgagcgatgcgtaagacgtctctccacctgggtcg

SEQ ID NO: 205420 - DNA, 36 bp, Artificial Sequence
  Synthetic oligonucleotide
tctcagggatgatatcatctcatcttctgtctccta

SEQ ID NO: 205421 - DNA, 37 bp, Artificial Sequence
  Synthetic oligonucleotide
acgatcattatagcgcggctaacaagcgcacctagca

SEQ ID NO: 205422 - DNA, 37 bp, Artificial Sequence
  Synthetic oligonucleotide
tttacgctggtgagacgccttcccggaagtctgttgt

SEQ ID NO: 205423 - DNA, 36 bp, Artificial Sequence
  Synthetic oligonucleotide
ttgtaagcgattgattccgcgcatgatttatgtcca

SEQ ID NO: 205424 - DNA, 35 bp, Artificial Sequence
  Synthetic oligonucleotide
cgagtgagaaaacgtacatccactatgcccactca

SEQ ID NO: 205425 - DNA, 34 bp, Artificial Sequence
  Synthetic oligonucleotide
ataccaccttcatctgaacgtgcgactgctacct

SEQ ID NO: 205426 - DNA, 38 bp, Artificial Sequence
  Synthetic oligonucleotide
gcaagtcaggcccttcagagccactatactatccatgt

SEQ ID NO: 205427 - DNA, 38 bp, Artificial Sequence
  Synthetic oligonucleotide
ggggtatgcaacggcttgtgccccctaactcgtcttgg

SEQ ID NO: 205428 - DNA, 35 bp, Artificial Sequence
  Synthetic oligonucleotide
ggcgcccgcgactgactctaccttttctaagtacc

SEQ ID NO: 205429 - DNA, 35 bp, Artificial Sequence
  Synthetic oligonucleotide
atttgaacgttatgcagtaaccgccctgttcaata

SEQ ID NO: 205430 - DNA, 35 bp, Artificial Sequence
  Synthetic oligonucleotide
tactctgtctgttgtttacacgtactcagaatgag

SEQ ID NO: 205431 - DNA, 35 bp, Artificial Sequence
  Synthetic oligonucleotide
cacaaccgcacggatatgcaggcatattctgccat

SEQ ID NO: 205432 - DNA, 36 bp, Artificial Sequence
  Synthetic oligonucleotide
atgcaaggtgccctccgtcaatacggacgcgttgat

SEQ ID NO: 205433 - DNA, 35 bp, Artificial Sequence
  Synthetic oligonucleotide
ttgcaacgtctgcccccttcatcctaccagttacc

SEQ ID NO: 205434 - DNA, 36 bp, Artificial Sequence
  Synthetic oligonucleotide
cccgaagagccgatactttctccggctttggagtct

SEQ ID NO: 205435 - DNA, 35 bp, Artificial Sequence
  Synthetic oligonucleotide
tagcatttcttcaaccccatctgcataatcggtag

SEQ ID NO: 205436 - DNA, 36 bp, Artificial Sequence
  Synthetic oligonucleotide
ggtaggctcgacatccagctacccgccccccgtcat

SEQ ID NO: 205437 - DNA, 37 bp, Artificial Sequence
  Synthetic oligonucleotide
gtgtgcccgcgttgcaccgcccttcccgatacgtggt

SEQ ID NO: 205438 - DNA, 35 bp, Artificial Sequence
  Synthetic oligonucleotide
ctccgtccgtctacaacgctgatatagctacctct

SEQ ID NO: 205439 - DNA, 36 bp, Artificial Sequence
  Synthetic oligonucleotide
gtggtgtaccaaatttccaacacctgtcacctacca

SEQ ID NO: 205440 - DNA, 36 bp, Artificial Sequence
  Synthetic oligonucleotide
gcaccctcctatcagacagtgcacctcgtgcggact

SEQ ID NO: 205441 - DNA, 35 bp, Artificial Sequence
  Synthetic oligonucleotide
acatcaggcgacgtgcatgcttactacgctcgaag

SEQ ID NO: 205442 - DNA, 35 bp, Artificial Sequence
  Synthetic oligonucleotide
ggtgttgcgcatgtttgccgtttccgcttttctct

SEQ ID NO: 205443 - DNA, 37 bp, Artificial Sequence
  Synthetic oligonucleotide
ttcaggtacccgttttcgtttaacatccacctggtga

SEQ ID NO: 205444 - DNA, 35 bp, Artificial Sequence
  Synthetic oligonucleotide
gctgcacccgtgtgtctgttatgtggcgataaact

SEQ ID NO: 205445 - DNA, 35 bp, Artificial Sequence
  Synthetic oligonucleotide
tatgaacgtatgcgaggttcgttttcaacgcttag

SEQ ID NO: 205446 - DNA, 35 bp, Artificial Sequence
  Synthetic oligonucleotide
cggtctctgccactcatctatctagtacccgccag

SEQ ID NO: 205447 - DNA, 37 bp, Artificial Sequence
  Synthetic oligonucleotide
accgccatggttatgtgcctccagtaattcgtaacca

SEQ ID NO: 205448 - DNA, 35 bp, Artificial Sequence
  Synthetic oligonucleotide
tcctacggagggacgatcagtcattggatctctct

SEQ ID NO: 205449 - DNA, 36 bp, Artificial Sequence
  Synthetic oligonucleotide
gacagtagtgcatcaaacttaagcatgccccttcca

SEQ ID NO: 205450 - DNA, 37 bp, Artificial Sequence
  Synthetic oligonucleotide
tcgaactggcgatatgccggttagtttccctgtgaga

SEQ ID NO: 205451 - DNA, 35 bp, Artificial Sequence
  Synthetic oligonucleotide
cgcctcccctcactcgcgtctccggtaaggactcc

SEQ ID NO: 205452 - DNA, 35 bp, Artificial Sequence
  Synthetic oligonucleotide
gcctctctcggtcactcttcttgcttccggctgca

SEQ ID NO: 205453 - DNA, 35 bp, Artificial Sequence
  Synthetic oligonucleotide
gcctgtaccaaatcataggacactagcaagggcag

SEQ ID NO: 205454 - DNA, 36 bp, Artificial Sequence
  Synthetic oligonucleotide
tgctcttagttcgtatggatgtgttctgttattgaa

SEQ ID NO: 205455 - DNA, 35 bp, Artificial Sequence
  Synthetic oligonucleotide
ctgtcctcgaaattcccaccagcttacaatcatcc

SEQ ID NO: 205456 - DNA, 35 bp, Artificial Sequence
  Synthetic oligonucleotide
tacatattatttgttacaccgcctcgaggcaatag

SEQ ID NO: 205457 - DNA, 38 bp, Artificial Sequence
  Synthetic oligonucleotide
acagtggatctaccttgtgttgcatgggttccccttca

SEQ ID NO: 205458 - DNA, 35 bp, Artificial Sequence
  Synthetic oligonucleotide
tcaaacgctccaccaaacctcgtgtcgtgcggtct

SEQ ID NO: 205459 - DNA, 38 bp, Artificial Sequence
  Synthetic oligonucleotide
tagtttccgtgacacaccaaaactagctgaccatttgt

SEQ ID NO: 205460 - DNA, 38 bp, Artificial Sequence
  Synthetic oligonucleotide
gatgatagggtcacttccatgctggcttctcctattca

SEQ ID NO: 205461 - DNA, 35 bp, Artificial Sequence
  Synthetic oligonucleotide
tgcttgcaggaatgcggtgggttgttagtaatcag

SEQ ID NO: 205462 - DNA, 35 bp, Artificial Sequence
  Synthetic oligonucleotide
ccaggtcggacgtctgtcaagacctcacatgggcc

SEQ ID NO: 205463 - DNA, 35 bp, Artificial Sequence
  Synthetic oligonucleotide
tctatcaaataccgaagcgggcttagccacaggtt

SEQ ID NO: 205464 - DNA, 35 bp, Artificial Sequence
  Synthetic oligonucleotide
cccggcgagccacgggctgtacgagcaagtcacgc

SEQ ID NO: 205465 - DNA, 36 bp, Artificial Sequence
  Synthetic oligonucleotide
catgtggccaaccactgcgacaccgcccccttccca

SEQ ID NO: 205466 - DNA, 37 bp, Artificial Sequence
  Synthetic oligonucleotide
tgattctcttcatcttagcctttcttaaccagtaaca

SEQ ID NO: 205467 - DNA, 35 bp, Artificial Sequence
  Synthetic oligonucleotide
gcaccgtcaagcgcactgcgcaatggccaacggct

SEQ ID NO: 205468 - DNA, 36 bp, Artificial Sequence
  Synthetic oligonucleotide
ttgggaccaccacgggacgtatcgtttttgattcaa

SEQ ID NO: 205469 - DNA, 37 bp, Artificial Sequence
  Synthetic oligonucleotide
tagttccaactcgtacggaagttgcgagttctttggt

SEQ ID NO: 205470 - DNA, 35 bp, Artificial Sequence
  Synthetic oligonucleotide
gtggtcatcgttctcccgacccctccatccctgcg

SEQ ID NO: 205471 - DNA, 35 bp, Artificial Sequence
  Synthetic oligonucleotide
tgagcatatcttcaataatcctgtatttggggaac

SEQ ID NO: 205472 - DNA, 35 bp, Artificial Sequence
  Synthetic oligonucleotide
gaatctccgcattctcataaaatatgactacctcc

SEQ ID NO: 205473 - DNA, 36 bp, Artificial Sequence
  Synthetic oligonucleotide
cattccaaccaaacatggttaggtatcaaattatca

SEQ ID NO: 205474 - DNA, 35 bp, Artificial Sequence
  Synthetic oligonucleotide
gctctcgaaccaccctggggtagagccgcctacat

SEQ ID NO: 205475 - DNA, 36 bp, Artificial Sequence
  Synthetic oligonucleotide
tacgtaccgcaactaatcctactagcttgctaggtt

SEQ ID NO: 205476 - DNA, 35 bp, Artificial Sequence
  Synthetic oligonucleotide
gagagctattgtacttactttatacaccctctgtg

SEQ ID NO: 205477 - DNA, 35 bp, Artificial Sequence
  Synthetic oligonucleotide
ctccgcccatcactccctgcagtcaccgttggtgt

SEQ ID NO: 205478 - DNA, 35 bp, Artificial Sequence
  Synthetic oligonucleotide
gttcagatctcacccttagcctgaccccgccggaa

SEQ ID NO: 205479 - DNA, 37 bp, Artificial Sequence
  Synthetic oligonucleotide
aatgctgtgcattgaaataaagagcccctctttggca

SEQ ID NO: 205480 - DNA, 37 bp, Artificial Sequence
  Synthetic oligonucleotide
gttgaactgtaatgtgctgatagcgagacttcatggt

SEQ ID NO: 205481 - DNA, 37 bp, Artificial Sequence
  Synthetic oligonucleotide
gcctcgcttatcaagcatgacccaacacctactaagg

SEQ ID NO: 205482 - DNA, 35 bp, Artificial Sequence
  Synthetic oligonucleotide
aatcgttataatcaccctccgtccgagaacgtttt

SEQ ID NO: 205483 - DNA, 38 bp, Artificial Sequence
  Synthetic oligonucleotide
tttagaagggctttcgttggatgaggaatatttgatga

SEQ ID NO: 205484 - DNA, 38 bp, Artificial Sequence
  Synthetic oligonucleotide
cagcactgcctttcctcgctcatagcattccgttttgt

SEQ ID NO: 205485 - DNA, 35 bp, Artificial Sequence
  Synthetic oligonucleotide
acctaccacccgcaatgttgcggtgttgtctataa

SEQ ID NO: 205486 - DNA, 36 bp, Artificial Sequence
  Synthetic oligonucleotide
gcggtcactttgctctgtgaacttcccgaatgctaa

SEQ ID NO: 205487 - DNA, 36 bp, Artificial Sequence
  Synthetic oligonucleotide
gaatgaaatgcttgcaataggtcccacgcttctaca

SEQ ID NO: 205488 - DNA, 35 bp, Artificial Sequence
  Synthetic oligonucleotide
acactgaatccttatttgcacgactacaatccgtt

SEQ ID NO: 205489 - DNA, 35 bp, Artificial Sequence
  Synthetic oligonucleotide
gctagggtctctccggaaagggttttccacctgcc

SEQ ID NO: 205490 - DNA, 35 bp, Artificial Sequence
  Synthetic oligonucleotide
gcggcaacttggtgacagtcaggttccgctcacct

SEQ ID NO: 205491 - DNA, 37 bp, Artificial Sequence
  Synthetic oligonucleotide
ccgtatcaacttcagcatgcatgtgtctcgcccccca

SEQ ID NO: 205492 - DNA, 36 bp, Artificial Sequence
  Synthetic oligonucleotide
atgggcggtgatcccagttcagctttagcaagccta

SEQ ID NO: 205493 - DNA, 37 bp, Artificial Sequence
  Synthetic oligonucleotide
gatatcgtgtttccttcgaattggcatacagcatcct

SEQ ID NO: 205494 - DNA, 36 bp, Artificial Sequence
  Synthetic oligonucleotide
attggtgctcaaacaatcactgtgcggggggtacca

SEQ ID NO: 205495 - DNA, 38 bp, Artificial Sequence
  Synthetic oligonucleotide
taaggcctgcatgagtataccaaacagaaagctgttga

SEQ ID NO: 205496 - DNA, 35 bp, Artificial Sequence
  Synthetic oligonucleotide
ctactggactgtacgttttgccgctttgataccct

SEQ ID NO: 205497 - DNA, 35 bp, Artificial Sequence
  Synthetic oligonucleotide
tggcatccttactgtgacatctgttggctccactt

SEQ ID NO: 205498 - DNA, 35 bp, Artificial Sequence
  Synthetic oligonucleotide
gccgtcatggctgacgtgcccttgcaatccggtct

SEQ ID NO: 205499 - DNA, 36 bp, Artificial Sequence
  Synthetic oligonucleotide
agcgcaaggcttgccctggaataactctgactcaaa

SEQ ID NO: 205500 - DNA, 36 bp, Artificial Sequence
  Synthetic oligonucleotide
tcccaaggttccgggtctcttaattcgcccaccctg

SEQ ID NO: 205501 - DNA, 36 bp, Artificial Sequence
  Synthetic oligonucleotide
gtggacgtcgccttacgctcagtcgcatcttcttct

SEQ ID NO: 205502 - DNA, 35 bp, Artificial Sequence
  Synthetic oligonucleotide
aatacgttgccggtcgacgtccattctttggacat

SEQ ID NO: 205503 - DNA, 37 bp, Artificial Sequence
  Synthetic oligonucleotide
ttggatcggtttggtaatcgcatatggtggctttagt

SEQ ID NO: 205504 - DNA, 35 bp, Artificial Sequence
  Synthetic oligonucleotide
aggacttccctctacttatcttatgcgcggaccct

SEQ ID NO: 205505 - DNA, 36 bp, Artificial Sequence
  Synthetic oligonucleotide
agcattcgtccagaggatcagatttcacgttacaaa

SEQ ID NO: 205506 - DNA, 35 bp, Artificial Sequence
  Synthetic oligonucleotide
tcaggactatagttcctaacggttgtacatcttat

SEQ ID NO: 205507 - DNA, 37 bp, Artificial Sequence
  Synthetic oligonucleotide
gagcatactactgtgtccggtatcgtttggtcggagt

SEQ ID NO: 205508 - DNA, 37 bp, Artificial Sequence
  Synthetic oligonucleotide
gcattacaccccgcaccgtacaatgacatgcgtgtgt

SEQ ID NO: 205509 - DNA, 35 bp, Artificial Sequence
  Synthetic oligonucleotide
cgtcataggattataccttcacgtacgctctggag

SEQ ID NO: 205510 - DNA, 35 bp, Artificial Sequence
  Synthetic oligonucleotide
acgacttctgtacgggtacacatgttacgacgtca

SEQ ID NO: 205511 - DNA, 36 bp, Artificial Sequence
  Synthetic oligonucleotide
gcagtatgcggaaaaaggtgcccccgtgtaaccagg

SEQ ID NO: 205512 - DNA, 37 bp, Artificial Sequence
  Synthetic oligonucleotide
agtcccgtacgctgcacggggatattactggttttca

SEQ ID NO: 205513 - DNA, 38 bp, Artificial Sequence
  Synthetic oligonucleotide
ctgcggaactaacgactttgccccctgaacaatcgtca

SEQ ID NO: 205514 - DNA, 35 bp, Artificial Sequence
  Synthetic oligonucleotide
tggcccaaacttgcgccgccgaaataagccaaaat

SEQ ID NO: 205515 - DNA, 36 bp, Artificial Sequence
  Synthetic oligonucleotide
atcgcaaaatgatactcgcgttgctctctgcgatca

SEQ ID NO: 205516 - DNA, 35 bp, Artificial Sequence
  Synthetic oligonucleotide
aggtcgtggcatcatttcgctattcagcttttcct

SEQ ID NO: 205517 - DNA, 35 bp, Artificial Sequence
  Synthetic oligonucleotide
gccatgcgctcattttgggtacggtatcaggccat

SEQ ID NO: 205518 - DNA, 35 bp, Artificial Sequence
  Synthetic oligonucleotide
gcgggcaagtttaactaagatgaccaccctatccc

SEQ ID NO: 205519 - DNA, 35 bp, Artificial Sequence
  Synthetic oligonucleotide
cccggcgagccaggggctgtacgagcaagtcacac

SEQ ID NO: 205520 - DNA, 36 bp, Artificial Sequence
  Synthetic oligonucleotide
gatcctggtactacttcattttcccggtcatggaca

SEQ ID NO: 205521 - DNA, 38 bp, Artificial Sequence
  Synthetic oligonucleotide
acgtaggccagttcgccactgcggggccccacctgtca

SEQ ID NO: 205522 - DNA, 35 bp, Artificial Sequence
  Synthetic oligonucleotide
agtgctgcaggttctaccgtggattcataaatcag

SEQ ID NO: 205523 - DNA, 26 bp, Artificial Sequence
  Synthetic oligonucleotide
cgtttgcgtgtttctcgacttcctgt

SEQ ID NO: 205524 - DNA, 35 bp, Artificial Sequence
  Synthetic oligonucleotide
tcgagggcctccgtatattgcgtctcctcggttat

SEQ ID NO: 205525 - DNA, 37 bp, Artificial Sequence
  Synthetic oligonucleotide
ggttgtctgcggctagcaatctaagctcttttggcgt

SEQ ID NO: 205526 - DNA, 35 bp, Artificial Sequence
  Synthetic oligonucleotide
tgcttaattggggggggggattctgttttgtctct

SEQ ID NO: 205527 - DNA, 38 bp, Artificial Sequence
  Synthetic oligonucleotide
atccggtttggagaagccgatctctgcctaatttatca

SEQ ID NO: 205528 - DNA, 31 bp, Artificial Sequence
  Synthetic oligonucleotide
acaaagtgcgttaatcccaacccgtgagcgc

SEQ ID NO: 205529 - DNA, 35 bp, Artificial Sequence
  Synthetic oligonucleotide
tgcaccgtacaacaagtacgggtcagagtacagac

SEQ ID NO: 205530 - DNA, 36 bp, Artificial Sequence
  Synthetic oligonucleotide
gccagcctgcctcatattgaggctctcaccctggaa

SEQ ID NO: 205531 - DNA, 35 bp, Artificial Sequence
  Synthetic oligonucleotide
gcttgagctgatgaccgtaggggaattgctggagt

SEQ ID NO: 205532 - DNA, 35 bp, Artificial Sequence
  Synthetic oligonucleotide
gtctgtcccccgctgttcaagtcacgtttgcttag

SEQ ID NO: 205533 - DNA, 37 bp, Artificial Sequence
  Synthetic oligonucleotide
tcacaccaacagcattcccccgaacattgcgctacta

SEQ ID NO: 205534 - DNA, 35 bp, Artificial Sequence
  Synthetic oligonucleotide
ggacttgtagttctggccatctagcccaacgagct

SEQ ID NO: 205535 - DNA, 35 bp, Artificial Sequence
  Synthetic oligonucleotide
gcaactcgtaattgtacgaaagatccttgggcaaa

SEQ ID NO: 205536 - DNA, 35 bp, Artificial Sequence
  Synthetic oligonucleotide
atcgttccccaatttgaaggggcgactcaagcaag

SEQ ID NO: 205537 - DNA, 35 bp, Artificial Sequence
  Synthetic oligonucleotide
acgatacctgccgaacggacaagacctagcttgag

SEQ ID NO: 205538 - DNA, 35 bp, Artificial Sequence
  Synthetic oligonucleotide
tccactagttttcgcgttcaaattggtctttagag

SEQ ID NO: 205539 - DNA, 35 bp, Artificial Sequence
  Synthetic oligonucleotide
cgtatacacgacgcagccgtagggtccgttatttt

SEQ ID NO: 205540 - DNA, 35 bp, Artificial Sequence
  Synthetic oligonucleotide
attataggaccttcctggtacaagtgtcttctcct

SEQ ID NO: 205541 - DNA, 36 bp, Artificial Sequence
  Synthetic oligonucleotide
ttcaccacgaccaatctggacacaccgccgggagtt

SEQ ID NO: 205542 - DNA, 38 bp, Artificial Sequence
  Synthetic oligonucleotide
gctgccaagcctacaccctgagatttggtaaatcatgg

SEQ ID NO: 205543 - DNA, 35 bp, Artificial Sequence
  Synthetic oligonucleotide
ttagcgcgttcatcattcattggcttatcggtaag

SEQ ID NO: 205544 - DNA, 36 bp, Artificial Sequence
  Synthetic oligonucleotide
accctcggaaaggtacttgtgccaacatggccgtca

SEQ ID NO: 205545 - DNA, 35 bp, Artificial Sequence
  Synthetic oligonucleotide
cagggtgcgtcatgccttttcaatcatttgcccgc

SEQ ID NO: 205546 - DNA, 35 bp, Artificial Sequence
  Synthetic oligonucleotide
ttgtccagccgtggtcttcccatgtccgccctgct

SEQ ID NO: 205547 - DNA, 36 bp, Artificial Sequence
  Synthetic oligonucleotide
aattctctctggttcccaaggaggaacgactaagca

SEQ ID NO: 205548 - DNA, 34 bp, Artificial Sequence
  Synthetic oligonucleotide
tcggccattaacccgcacaggtgcgtccgctcca

SEQ ID NO: 205549 - DNA, 38 bp, Artificial Sequence
  Synthetic oligonucleotide
acctaatcccgtggtgacccaacccccactcaagctga

SEQ ID NO: 205550 - DNA, 36 bp, Artificial Sequence
  Synthetic oligonucleotide
aagtgtctatacgttagtccgctttcgtctttcgaa

SEQ ID NO: 205551 - DNA, 35 bp, Artificial Sequence
  Synthetic oligonucleotide
cattgttgtatgtttgctatgttgttaattaaggg

SEQ ID NO: 205552 - DNA, 35 bp, Artificial Sequence
  Synthetic oligonucleotide
taccgtgtgctttagattaagctcagcggttcact

SEQ ID NO: 205553 - DNA, 36 bp, Artificial Sequence
  Synthetic oligonucleotide
ggtcactcgcaattctacggtataccgtttctacat

SEQ ID NO: 205554 - DNA, 37 bp, Artificial Sequence
  Synthetic oligonucleotide
tcatatacgcaccaacgactatcgcatttcgcgctgt

SEQ ID NO: 205555 - DNA, 38 bp, Artificial Sequence
  Synthetic oligonucleotide
accaagcgcatattttggctaggggtttcctaccatca

SEQ ID NO: 205556 - DNA, 29 bp, Artificial Sequence
  Synthetic oligonucleotide
catgcaacagctcaccgctatattgttca

SEQ ID NO: 205557 - DNA, 38 bp, Artificial Sequence
  Synthetic oligonucleotide
ccaattcggatgtacgcacctccgattgattccggtga

SEQ ID NO: 205558 - DNA, 35 bp, Artificial Sequence
  Synthetic oligonucleotide
cccggcgagccacgggctgtacgaccaagtcacac

SEQ ID NO: 205559 - DNA, 38 bp, Artificial Sequence
  Synthetic oligonucleotide
tctcaatccacgctaactacgtaacgatcggtgggtca

SEQ ID NO: 205560 - DNA, 35 bp, Artificial Sequence
  Synthetic oligonucleotide
gtccagctttatcgccttccccgaagatagaattg

SEQ ID NO: 205561 - DNA, 35 bp, Artificial Sequence
  Synthetic oligonucleotide
atcattgtcggttcgatcccttgcggaggtgatag

SEQ ID NO: 205562 - DNA, 35 bp, Artificial Sequence
  Synthetic oligonucleotide
gaacccgatcgatttggtgttccgtcagatacaag

SEQ ID NO: 205563 - DNA, 36 bp, Artificial Sequence
  Synthetic oligonucleotide
gtgtcttcatcagcatacggttgcgtagcgctcttt

SEQ ID NO: 205564 - DNA, 37 bp, Artificial Sequence
  Synthetic oligonucleotide
gaagggaccccgaagtatcactactccattgattgca

SEQ ID NO: 205565 - DNA, 35 bp, Artificial Sequence
  Synthetic oligonucleotide
gctgcaaaaagacctatgcaacttacttgccttat

SEQ ID NO: 205566 - DNA, 35 bp, Artificial Sequence
  Synthetic oligonucleotide
ctccctcgcatttagcatactcccccgtctcttac

SEQ ID NO: 205567 - DNA, 36 bp, Artificial Sequence
  Synthetic oligonucleotide
cggagggtgcccttatccctgtacaatccgggtcaa

SEQ ID NO: 205568 - DNA, 26 bp, Artificial Sequence
  Synthetic oligonucleotide
ggttaaccacaattcactcatggtgg

SEQ ID NO: 205569 - DNA, 36 bp, Artificial Sequence
  Synthetic oligonucleotide
gctcatgacctgcttgtaacaatgcttcccgggcaa

SEQ ID NO: 205570 - DNA, 35 bp, Artificial Sequence
  Synthetic oligonucleotide
tcgttcttccctgtgaatgccatcttatcgtttat

SEQ ID NO: 205571 - DNA, 35 bp, Artificial Sequence
  Synthetic oligonucleotide
taccgttagcgcttggaatattacatcttttacag

SEQ ID NO: 205572 - DNA, 35 bp, Artificial Sequence
  Synthetic oligonucleotide
accgaaattgggctgagctatactttgggcttcag

SEQ ID NO: 205573 - DNA, 35 bp, Artificial Sequence
  Synthetic oligonucleotide
tatctgagtacaccgacccgatgtttcgtttcact

SEQ ID NO: 205574 - DNA, 35 bp, Artificial Sequence
  Synthetic oligonucleotide
gccctggcaccacagtcgcacaatcaatcgtgtgc

SEQ ID NO: 205575 - DNA, 36 bp, Artificial Sequence
  Synthetic oligonucleotide
gggtagggaaataattgtcacgactgcttcactaca

SEQ ID NO: 205576 - DNA, 37 bp, Artificial Sequence
  Synthetic oligonucleotide
agctcactcaatagtcgactacggtcgcaccacccgt

SEQ ID NO: 205577 - DNA, 38 bp, Artificial Sequence
  Synthetic oligonucleotide
agggcctaaacggttatgtaggattaggtttggtttga

SEQ ID NO: 205578 - DNA, 35 bp, Artificial Sequence
  Synthetic oligonucleotide
tttcggaagccagctttgcataaatcttcactcat

SEQ ID NO: 205579 - DNA, 37 bp, Artificial Sequence
  Synthetic oligonucleotide
tttatcagtccttatcgccttcagtctaccgtgcgca

SEQ ID NO: 205580 - DNA, 31 bp, Artificial Sequence
  Synthetic oligonucleotide
ttgcgttgcagtctactaccttgtcattctt

SEQ ID NO: 205581 - DNA, 36 bp, Artificial Sequence
  Synthetic oligonucleotide
atcgcccaaagtttctgcgtgacttcttttgaagca

SEQ ID NO: 205582 - DNA, 35 bp, Artificial Sequence
  Synthetic oligonucleotide
cccggcgtgccacgggctgtacgagcaagtcacac

SEQ ID NO: 205583 - DNA, 38 bp, Artificial Sequence
  Synthetic oligonucleotide
acatcttcttcaactgtctcgtccctcatcatgtctgt

SEQ ID NO: 205584 - DNA, 36 bp, Artificial Sequence
  Synthetic oligonucleotide
gttctgcaatgccagaggcctccttaatgttcttaa

SEQ ID NO: 205585 - DNA, 35 bp, Artificial Sequence
  Synthetic oligonucleotide
tctagtcacttacagtgacgttactgtcttgagct

SEQ ID NO: 205586 - DNA, 36 bp, Artificial Sequence
  Synthetic oligonucleotide
tccgtgagcgcacgtgcgccataaaagtttttcgca

SEQ ID NO: 205587 - DNA, 36 bp, Artificial Sequence
  Synthetic oligonucleotide
cctactgcttaggcatgctgaccgtagttcttacaa

SEQ ID NO: 205588 - DNA, 37 bp, Artificial Sequence
  Synthetic oligonucleotide
cgctaccgatctatccgctctgcaagactgcattgca

SEQ ID NO: 205589 - DNA, 35 bp, Artificial Sequence
  Synthetic oligonucleotide
agtcacttgctaatcatagccatagaggattacag

SEQ ID NO: 205590 - DNA, 38 bp, Artificial Sequence
  Synthetic oligonucleotide
gacattggactcacccgctttcgggcttttgcgtgtca

SEQ ID NO: 205591 - DNA, 36 bp, Artificial Sequence
  Synthetic oligonucleotide
tttttgcctccattcgcgtccgggcgaaacgccgga

SEQ ID NO: 205592 - DNA, 35 bp, Artificial Sequence
  Synthetic oligonucleotide
tcaccgctctccatttagggcattgtatcgctcgt

SEQ ID NO: 205593 - DNA, 35 bp, Artificial Sequence
  Synthetic oligonucleotide
cgcccgcgaccgctttcgctcgccactacgacccg

SEQ ID NO: 205594 - DNA, 36 bp, Artificial Sequence
  Synthetic oligonucleotide
gttattgcagctgtcaccttgcatctctatccgcca

SEQ ID NO: 205595 - DNA, 37 bp, Artificial Sequence
  Synthetic oligonucleotide
tcacatttggatcagtttactactggagggtgtggga

SEQ ID NO: 205596 - DNA, 35 bp, Artificial Sequence
  Synthetic oligonucleotide
caactgctaccatcccggttacctcatgccttccg

SEQ ID NO: 205597 - DNA, 37 bp, Artificial Sequence
  Synthetic oligonucleotide
taccagtggcacctgtactggtctgctcccacgccca

SEQ ID NO: 205598 - DNA, 36 bp, Artificial Sequence
  Synthetic oligonucleotide
gttgttgagcctcccgctttagcttgcgctctatca

SEQ ID NO: 205599 - DNA, 36 bp, Artificial Sequence
  Synthetic oligonucleotide
gtctcgtattaggcccgggtgggaggtatccaagca

SEQ ID NO: 205600 - DNA, 36 bp, Artificial Sequence
  Synthetic oligonucleotide
ccatgctgtaggccacggttcacagccttattatct

SEQ ID NO: 205601 - DNA, 37 bp, Artificial Sequence
  Synthetic oligonucleotide
ccccctgaaagtctctaggaccaccacttactccagt

SEQ ID NO: 205602 - DNA, 35 bp, Artificial Sequence
  Synthetic oligonucleotide
gggttaactcgtcgtcttactatgttctcaccgct

SEQ ID NO: 205603 - DNA, 35 bp, Artificial Sequence
  Synthetic oligonucleotide
cgagtagtgcacataattcggggttcctgttatta

SEQ ID NO: 205604 - DNA, 38 bp, Artificial Sequence
  Synthetic oligonucleotide
gtacggtcgccgtctatccgtttgaacccgttacatgt

SEQ ID NO: 205605 - DNA, 35 bp, Artificial Sequence
  Synthetic oligonucleotide
ctgccgcatgaatagtttggggtttttcggtccca

SEQ ID NO: 205606 - DNA, 35 bp, Artificial Sequence
  Synthetic oligonucleotide
gcgtacattatggcatcctcccgaacggaaggtgt

SEQ ID NO: 205607 - DNA, 36 bp, Artificial Sequence
  Synthetic oligonucleotide
gtgtcagcattacgtgactatgatctggatccagca

SEQ ID NO: 205608 - DNA, 36 bp, Artificial Sequence
  Synthetic oligonucleotide
gttacactcctccatgccgccgtccccagactctgt

SEQ ID NO: 205609 - DNA, 35 bp, Artificial Sequence
  Synthetic oligonucleotide
aggacagtgataatttcatttctccgtcttaactg

SEQ ID NO: 205610 - DNA, 35 bp, Artificial Sequence
  Synthetic oligonucleotide
aacacctaccgcatcatttatgacagtgccggagt

SEQ ID NO: 205611 - DNA, 36 bp, Artificial Sequence
  Synthetic oligonucleotide
ggggctcctctgctacttcagcggttcgttatcttt

SEQ ID NO: 205612 - DNA, 37 bp, Artificial Sequence
  Synthetic oligonucleotide
gggtcattttaaatgcgtaattgtcagtcttcacgca

SEQ ID NO: 205613 - DNA, 37 bp, Artificial Sequence
  Synthetic oligonucleotide
ggcggaatgcatcgcttcaaattccccaactattaca

SEQ ID NO: 205614 - DNA, 37 bp, Artificial Sequence
  Synthetic oligonucleotide
ccaccttttccaaccattccaggatagtcgcccacgt

SEQ ID NO: 205615 - DNA, 35 bp, Artificial Sequence
  Synthetic oligonucleotide
tgccgtgggggaaagcccctgacaaatgcctgatt

SEQ ID NO: 205616 - DNA, 36 bp, Artificial Sequence
  Synthetic oligonucleotide
tggcgcatcttgactaaagattattctcgtgctcca

SEQ ID NO: 205617 - DNA, 35 bp, Artificial Sequence
  Synthetic oligonucleotide
gcctctctcggtcactcttcttgcttccggctgtg

SEQ ID NO: 205618 - DNA, 35 bp, Artificial Sequence
  Synthetic oligonucleotide
gcttaatcgcgcccctaacaatatgcttccttcca

SEQ ID NO: 205619 - DNA, 35 bp, Artificial Sequence
  Synthetic oligonucleotide
ccaattgaccggatggtcatctggctccgctctat

SEQ ID NO: 205620 - DNA, 36 bp, Artificial Sequence
  Synthetic oligonucleotide
tcgctacaggcgaccatgagcctggtagccgaaaca

SEQ ID NO: 205621 - DNA, 35 bp, Artificial Sequence
  Synthetic oligonucleotide
tccaacagttatcagccctaacactgccccagatt

SEQ ID NO: 205622 - DNA, 35 bp, Artificial Sequence
  Synthetic oligonucleotide
gtgatcatggctacgctgctgtttgtccctcgcag

SEQ ID NO: 205623 - DNA, 37 bp, Artificial Sequence
  Synthetic oligonucleotide
taatatgacggttgtctcttggcctagtccgcgttgt

SEQ ID NO: 205624 - DNA, 38 bp, Artificial Sequence
  Synthetic oligonucleotide
accatgccgtggagtgacaccgtgtgcttcgtgtttca

SEQ ID NO: 205625 - DNA, 36 bp, Artificial Sequence
  Synthetic oligonucleotide
tgtttaacaccgcaagctcaagagcatgtttctaca

SEQ ID NO: 205626 - DNA, 35 bp, Artificial Sequence
  Synthetic oligonucleotide
ttggcgaaacaggaagctaacgattcaccacactt

SEQ ID NO: 205627 - DNA, 35 bp, Artificial Sequence
  Synthetic oligonucleotide
gctccgcccgggcgctggtgaacgactccaaggta

SEQ ID NO: 205628 - DNA, 35 bp, Artificial Sequence
  Synthetic oligonucleotide
gcttaggccaattaattagtatggccgggtccacc

SEQ ID NO: 205629 - DNA, 34 bp, Artificial Sequence
  Synthetic oligonucleotide
atcctgatccttcagcaagttgcgcattggctac

SEQ ID NO: 205630 - DNA, 36 bp, Artificial Sequence
  Synthetic oligonucleotide
ctgttcaggctcacagcttgttgataacatgattaa

SEQ ID NO: 205631 - DNA, 35 bp, Artificial Sequence
  Synthetic oligonucleotide
aaatctggctatgaccctatcatagcgtaatcaat

SEQ ID NO: 205632 - DNA, 37 bp, Artificial Sequence
  Synthetic oligonucleotide
tacgctcgtttggacattttaggggggtatggggaca

SEQ ID NO: 205633 - DNA, 38 bp, Artificial Sequence
  Synthetic oligonucleotide
ggtcttgcccgctcgcactttccgagtgttagaattgt

SEQ ID NO: 205634 - DNA, 36 bp, Artificial Sequence
  Synthetic oligonucleotide
taatacgaaacattgtcggtcgctggtacgcgagtt

SEQ ID NO: 205635 - DNA, 37 bp, Artificial Sequence
  Synthetic oligonucleotide
aaagcgcggttgcaagacgttacgctcgcgcttatca

SEQ ID NO: 205636 - DNA, 36 bp, Artificial Sequence
  Synthetic oligonucleotide
gtcgccccacaggtcctgtatgttcctaggtcactt

SEQ ID NO: 205637 - DNA, 35 bp, Artificial Sequence
  Synthetic oligonucleotide
catgcgacgcatcgcgtaattacgcaaaccgagct

SEQ ID NO: 205638 - DNA, 36 bp, Artificial Sequence
  Synthetic oligonucleotide
aacgggctacttaccccctatgttgcggacgcttca

SEQ ID NO: 205639 - DNA, 36 bp, Artificial Sequence
  Synthetic oligonucleotide
accgcccgctggttttccgatatcagacttggtttt

SEQ ID NO: 205640 - DNA, 38 bp, Artificial Sequence
  Synthetic oligonucleotide
tacattcaactactgaaactcagatagattctgactca

SEQ ID NO: 205641 - DNA, 35 bp, Artificial Sequence
  Synthetic oligonucleotide
ccggctgtagataacaaattagcaacgctcaccag

SEQ ID NO: 205642 - DNA, 38 bp, Artificial Sequence
  Synthetic oligonucleotide
tgggagctctctccgttttttatcgctactcagtatca

SEQ ID NO: 205643 - DNA, 35 bp, Artificial Sequence
  Synthetic oligonucleotide
tcggcgaacatgatcaccgctttcctaccgccggc

SEQ ID NO: 205644 - DNA, 37 bp, Artificial Sequence
  Synthetic oligonucleotide
cgctacctatctatccgctctgcaagactgcattgga

SEQ ID NO: 205645 - DNA, 37 bp, Artificial Sequence
  Synthetic oligonucleotide
gcgtctcgtccatattcactatcggaaaggtacccga

SEQ ID NO: 205646 - DNA, 34 bp, Artificial Sequence
  Synthetic oligonucleotide
tcacgcgagcacgctcttggttttgtttccttct

SEQ ID NO: 205647 - DNA, 38 bp, Artificial Sequence
  Synthetic oligonucleotide
gagggcacattggtgcaacgatttgtttggggggttgt

SEQ ID NO: 205648 - DNA, 36 bp, Artificial Sequence
  Synthetic oligonucleotide
tccggtatcgatggcctcatggctcattattgtcca

SEQ ID NO: 205649 - DNA, 35 bp, Artificial Sequence
  Synthetic oligonucleotide
ttgcaatccctaaggcgtatctggactagattcag

SEQ ID NO: 205650 - DNA, 36 bp, Artificial Sequence
  Synthetic oligonucleotide
taaagcgcgctctgctgataaacatcctagatatca

SEQ ID NO: 205651 - DNA, 35 bp, Artificial Sequence
  Synthetic oligonucleotide
cgcgggtcgtgcctgccgcggtcgtaatggcccag

SEQ ID NO: 205652 - DNA, 37 bp, Artificial Sequence
  Synthetic oligonucleotide
gtagtccgtcgtgtacacaaggtccatgatacaccgt

SEQ ID NO: 205653 - DNA, 36 bp, Artificial Sequence
  Synthetic oligonucleotide
tcacgctaactgactacatcatcctgtaagcattca

SEQ ID NO: 205654 - DNA, 36 bp, Artificial Sequence
  Synthetic oligonucleotide
catccatggtcatccacgatgaaatcatgccctcca

SEQ ID NO: 205655 - DNA, 38 bp, Artificial Sequence
  Synthetic oligonucleotide
acctaatcccgtggtgacccaacccccacgcaagctgg

SEQ ID NO: 205656 - DNA, 36 bp, Artificial Sequence
  Synthetic oligonucleotide
tggaactcctgtattaggcgtgcttcgtgtcctggt

SEQ ID NO: 205657 - DNA, 36 bp, Artificial Sequence
  Synthetic oligonucleotide
ctcccggagaaatttttgtatctaccagtgcgtgca

SEQ ID NO: 205658 - DNA, 37 bp, Artificial Sequence
  Synthetic oligonucleotide
acgttcaacgtatacacaagccaaattccggtgttca

SEQ ID NO: 205659 - DNA, 37 bp, Artificial Sequence
  Synthetic oligonucleotide
acagcaacttggtgctgtacgaaccctcactccgtgt

SEQ ID NO: 205660 - DNA, 37 bp, Artificial Sequence
  Synthetic oligonucleotide
gcgtcgcgtccatattcactatcggaaaggtacccca

SEQ ID NO: 205661 - DNA, 35 bp, Artificial Sequence
  Synthetic oligonucleotide
acgtatacacttggcccccctcccgagctatctag

SEQ ID NO: 205662 - DNA, 35 bp, Artificial Sequence
  Synthetic oligonucleotide
tgtcctcaagagaattcagagagatactactgtct

SEQ ID NO: 205663 - DNA, 36 bp, Artificial Sequence
  Synthetic oligonucleotide
cgtcacgcgatgacgtttcttcgccttccccgtctt

SEQ ID NO: 205664 - DNA, 35 bp, Artificial Sequence
  Synthetic oligonucleotide
ttgtcgatttttgcacgctcggtgtgccgcccgca

SEQ ID NO: 205665 - DNA, 37 bp, Artificial Sequence
  Synthetic oligonucleotide
ccagttgctcaaccatttggcgctccttctaaggaca

SEQ ID NO: 205666 - DNA, 35 bp, Artificial Sequence
  Synthetic oligonucleotide
gcctgccggttcatgtgccatgctgattatggatt

SEQ ID NO: 205667 - DNA, 35 bp, Artificial Sequence
  Synthetic oligonucleotide
tcccgaggacataacttggtagtgcttagagtgac

SEQ ID NO: 205668 - DNA, 35 bp, Artificial Sequence
  Synthetic oligonucleotide
actatgggacgtccgtcacgcctaaatgttacatg

SEQ ID NO: 205669 - DNA, 35 bp, Artificial Sequence
  Synthetic oligonucleotide
acctagtagccacaagtatgatgttttcctaccag

SEQ ID NO: 205670 - DNA, 27 bp, Artificial Sequence
  Synthetic oligonucleotide
cttgcgtgaatcatgtcatgtcacttt

SEQ ID NO: 205671 - DNA, 37 bp, Artificial Sequence
  Synthetic oligonucleotide
attcgacttaaatcgcgtgcacctatagattcttgca

SEQ ID NO: 205672 - DNA, 35 bp, Artificial Sequence
  Synthetic oligonucleotide
aattacagtcagaccaggactgacttgaactccat

SEQ ID NO: 205673 - DNA, 36 bp, Artificial Sequence
  Synthetic oligonucleotide
tatatgcaatcggagtcgctgtttataactttgtca

SEQ ID NO: 205674 - DNA, 36 bp, Artificial Sequence
  Synthetic oligonucleotide
gagctcatcacggttccaccaactcccgagcgtgca

SEQ ID NO: 205675 - DNA, 35 bp, Artificial Sequence
  Synthetic oligonucleotide
gccctggcaccaaagtctcacaatcaatcgtgtgc

SEQ ID NO: 205676 - DNA, 38 bp, Artificial Sequence
  Synthetic oligonucleotide
atttcgaacgttacgcgaactcagcctaactctcttgt

SEQ ID NO: 205677 - DNA, 35 bp, Artificial Sequence
  Synthetic oligonucleotide
catgcacagttgagcaattctacaccagatatctt

SEQ ID NO: 205678 - DNA, 35 bp, Artificial Sequence
  Synthetic oligonucleotide
agagtagcacggtgctctagccttccgttaccccc

SEQ ID NO: 205679 - DNA, 35 bp, Artificial Sequence
  Synthetic oligonucleotide
aaccgtcctagccgctacatagacgcgctcacacc

SEQ ID NO: 205680 - DNA, 35 bp, Artificial Sequence
  Synthetic oligonucleotide
gggccttttcaggggtgttaaactggcacccctat

SEQ ID NO: 205681 - DNA, 37 bp, Artificial Sequence
  Synthetic oligonucleotide
aagacgaagctactcagactgcaggttattcagtggt

SEQ ID NO: 205682 - DNA, 35 bp, Artificial Sequence
  Synthetic oligonucleotide
tgatcttctgcgacctaatgacatggtggaatgaa

SEQ ID NO: 205683 - DNA, 36 bp, Artificial Sequence
  Synthetic oligonucleotide
gcccgatacgacaggccttgattaatgaaccttgca

SEQ ID NO: 205684 - DNA, 35 bp, Artificial Sequence
  Synthetic oligonucleotide
gccttggtacattgggcatagaacctactcatgtt

SEQ ID NO: 205685 - DNA, 35 bp, Artificial Sequence
  Synthetic oligonucleotide
gttagctcgggcaccacttctgttcatttatttat

SEQ ID NO: 205686 - DNA, 37 bp, Artificial Sequence
  Synthetic oligonucleotide
aactatgctacagttcccggttaatcgcctcgccaca

SEQ ID NO: 205687 - DNA, 34 bp, Artificial Sequence
  Synthetic oligonucleotide
ccgcctattgacctcactcagcaaccgacgccgt

SEQ ID NO: 205688 - DNA, 35 bp, Artificial Sequence
  Synthetic oligonucleotide
atggttccatcgttgtacaatccgggctacaggcg

SEQ ID NO: 205689 - DNA, 38 bp, Artificial Sequence
  Synthetic oligonucleotide
ttgaatacttcagttagccgtcccttgccgttatctgt

SEQ ID NO: 205690 - DNA, 38 bp, Artificial Sequence
  Synthetic oligonucleotide
acgaagccggcatacgtagagtgtgtcgccgagtgtga

SEQ ID NO: 205691 - DNA, 36 bp, Artificial Sequence
  Synthetic oligonucleotide
aggccatctatgatgctccacctagctgcgggccca

SEQ ID NO: 205692 - DNA, 37 bp, Artificial Sequence
  Synthetic oligonucleotide
gagcataactctctctacatgtgtttgtgaagaaaga

SEQ ID NO: 205693 - DNA, 35 bp, Artificial Sequence
  Synthetic oligonucleotide
atggactactttatcccccgtatgtgttgttctcg

SEQ ID NO: 205694 - DNA, 35 bp, Artificial Sequence
  Synthetic oligonucleotide
gtaaccgcgaggtttatgcttgttattgatgaacc

SEQ ID NO: 205695 - DNA, 36 bp, Artificial Sequence
  Synthetic oligonucleotide
aattaaccgagccggtacctctagttggaacccatt

SEQ ID NO: 205696 - DNA, 36 bp, Artificial Sequence
  Synthetic oligonucleotide
cgtattcttcgatctaaccgatcctgattaacataa

SEQ ID NO: 205697 - DNA, 35 bp, Artificial Sequence
  Synthetic oligonucleotide
cgacgcccttaaggagctcgctggcctgacttacg

SEQ ID NO: 205698 - DNA, 35 bp, Artificial Sequence
  Synthetic oligonucleotide
tatctgagaccaccatgggttgatcagtcgctcgg

SEQ ID NO: 205699 - DNA, 38 bp, Artificial Sequence
  Synthetic oligonucleotide
actttgggtaggtggcatggctgaacgtacacctgtgt

SEQ ID NO: 205700 - DNA, 38 bp, Artificial Sequence
  Synthetic oligonucleotide
tttgacgcgcctggtcctccttttgtgtaggctactca

SEQ ID NO: 205701 - DNA, 36 bp, Artificial Sequence
  Synthetic oligonucleotide
tataattggcccgtgaaatgcaggatagtgctgaca

SEQ ID NO: 205702 - DNA, 36 bp, Artificial Sequence
  Synthetic oligonucleotide
aacctggtatcttacttgccaacgggagttcctgca

SEQ ID NO: 205703 - DNA, 35 bp, Artificial Sequence
  Synthetic oligonucleotide
attggggcgactactcgcgctccacatcaaacagt

SEQ ID NO: 205704 - DNA, 35 bp, Artificial Sequence
  Synthetic oligonucleotide
ccgcccctgacccttttttcgcgttcatccggcgg

SEQ ID NO: 205705 - DNA, 36 bp, Artificial Sequence
  Synthetic oligonucleotide
tccctccgatagacaactctgagcacacgccgccca

SEQ ID NO: 205706 - DNA, 32 bp, Artificial Sequence
  Synthetic oligonucleotide
tagtccttgaagactactgtttcccgtaccaa

SEQ ID NO: 205707 - DNA, 35 bp, Artificial Sequence
  Synthetic oligonucleotide
gagtgtccgaatcgctccctttcttcaggggcctc

SEQ ID NO: 205708 - DNA, 36 bp, Artificial Sequence
  Synthetic oligonucleotide
tcgttcccccttcagactgtgacgcaattgtgcgca

SEQ ID NO: 205709 - DNA, 36 bp, Artificial Sequence
  Synthetic oligonucleotide
tctatgccttccacccaacgactcctcggttcggaa

SEQ ID NO: 205710 - DNA, 35 bp, Artificial Sequence
  Synthetic oligonucleotide
gcatgccatttccatcgagccctacagttctcttg

SEQ ID NO: 205711 - DNA, 35 bp, Artificial Sequence
  Synthetic oligonucleotide
gtcgtatcccggccggacccgacctggttaaattc

SEQ ID NO: 205712 - DNA, 35 bp, Artificial Sequence
  Synthetic oligonucleotide
ggtcgctcgtggcatccggttacctggactttcag

SEQ ID NO: 205713 - DNA, 35 bp, Artificial Sequence
  Synthetic oligonucleotide
ccccccccgtgatctcagtgagtcctattctgaag

SEQ ID NO: 205714 - DNA, 36 bp, Artificial Sequence
  Synthetic oligonucleotide
aacttcaggagcaacatgtggggctttgtgccaaaa

SEQ ID NO: 205715 - DNA, 35 bp, Artificial Sequence
  Synthetic oligonucleotide
gccggtgaaaggttttccctggtgtttatgacggt

SEQ ID NO: 205716 - DNA, 35 bp, Artificial Sequence
  Synthetic oligonucleotide
gtagaatgcagtcttaatagccatttgccatcttg

SEQ ID NO: 205717 - DNA, 38 bp, Artificial Sequence
  Synthetic oligonucleotide
attcagaacaatctacacgtatagtcacgtgttagtca

SEQ ID NO: 205718 - DNA, 37 bp, Artificial Sequence
  Synthetic oligonucleotide
gcgccccggactcctttggacgacatgtaatgaaaca

SEQ ID NO: 205719 - DNA, 36 bp, Artificial Sequence
  Synthetic oligonucleotide
ttatgctacaacagttgctcggtctccgcttaacgt

SEQ ID NO: 205720 - DNA, 35 bp, Artificial Sequence
  Synthetic oligonucleotide
ttctaccatagcccgtctactccattagcaacccg

SEQ ID NO: 205721 - DNA, 37 bp, Artificial Sequence
  Synthetic oligonucleotide
aaaggggacttcatgacctcaattgccattgtacggt

SEQ ID NO: 205722 - DNA, 35 bp, Artificial Sequence
  Synthetic oligonucleotide
cgttgattagttcttaatgctacctcaacgtcaca

SEQ ID NO: 205723 - DNA, 35 bp, Artificial Sequence
  Synthetic oligonucleotide
cacactaaacattacagtcccgcccgcgatgaacc

SEQ ID NO: 205724 - DNA, 35 bp, Artificial Sequence
  Synthetic oligonucleotide
cgcactgttggaccgtatcatgctcatcaatcctt

SEQ ID NO: 205725 - DNA, 37 bp, Artificial Sequence
  Synthetic oligonucleotide
gctctgaggtctagtatttccacaacacgtaatttgg

SEQ ID NO: 205726 - DNA, 36 bp, Artificial Sequence
  Synthetic oligonucleotide
tgtaacctcccagcccccgcagctgccgcaacggga

SEQ ID NO: 205727 - DNA, 35 bp, Artificial Sequence
  Synthetic oligonucleotide
cgctacccttgatgctgtgacggacggataggaat

SEQ ID NO: 205728 - DNA, 35 bp, Artificial Sequence
  Synthetic oligonucleotide
ggttcgagctcgtgcgctgtaatccggcctgacgt

SEQ ID NO: 205729 - DNA, 33 bp, Artificial Sequence
  Synthetic oligonucleotide
gacccgtatggctattcggccaatgcagtctgt

SEQ ID NO: 205730 - DNA, 35 bp, Artificial Sequence
  Synthetic oligonucleotide
gccatctgtgcgtacagtccccccgacgatttacg

SEQ ID NO: 205731 - DNA, 38 bp, Artificial Sequence
  Synthetic oligonucleotide
ggcgttcacgtcgtaggctcccacattcttcaccgtgt

SEQ ID NO: 205732 - DNA, 38 bp, Artificial Sequence
  Synthetic oligonucleotide
tgtccccacgccgtatctagacatgcatcatttggtca

SEQ ID NO: 205733 - DNA, 35 bp, Artificial Sequence
  Synthetic oligonucleotide
ggttctacgccctgccttccagtactgcagagcta

SEQ ID NO: 205734 - DNA, 35 bp, Artificial Sequence
  Synthetic oligonucleotide
caggacttcatgatcggccctactactcttattca

SEQ ID NO: 205735 - DNA, 35 bp, Artificial Sequence
  Synthetic oligonucleotide
gtccgcttctaaacgctattgcaagaccgtcatcg

SEQ ID NO: 205736 - DNA, 35 bp, Artificial Sequence
  Synthetic oligonucleotide
cgattggtcctgaaggagattattaaggttttgcg

SEQ ID NO: 205737 - DNA, 37 bp, Artificial Sequence
  Synthetic oligonucleotide
tgtccttcaggccacttctttcactcggcttccttgg

SEQ ID NO: 205738 - DNA, 35 bp, Artificial Sequence
  Synthetic oligonucleotide
cgccttgctaacgcctttccgacggagtattccat

SEQ ID NO: 205739 - DNA, 35 bp, Artificial Sequence
  Synthetic oligonucleotide
agcccctggggtcacgtcaacttcccgtcgacaat

SEQ ID NO: 205740 - DNA, 35 bp, Artificial Sequence
  Synthetic oligonucleotide
gctgtaacttctcggaccgttcataagctttctta

SEQ ID NO: 205741 - DNA, 35 bp, Artificial Sequence
  Synthetic oligonucleotide
ctttacttctcggccgttagcttcgccgtaatgat

SEQ ID NO: 205742 - DNA, 35 bp, Artificial Sequence
  Synthetic oligonucleotide
acggggctgccattcctcacgagccatataagtct

SEQ ID NO: 205743 - DNA, 38 bp, Artificial Sequence
  Synthetic oligonucleotide
gtgctagtaccgacaccgtagtaaacgccctggtctgt

SEQ ID NO: 205744 - DNA, 36 bp, Artificial Sequence
  Synthetic oligonucleotide
gggtgctatcaaccctgcccagctctcactggcaca

SEQ ID NO: 205745 - DNA, 35 bp, Artificial Sequence
  Synthetic oligonucleotide
tctatatctagccgccgttggcctcagtgcatgcg

SEQ ID NO: 205746 - DNA, 35 bp, Artificial Sequence
  Synthetic oligonucleotide
gattcatgatcggtggtacctatccaccttaatta

SEQ ID NO: 205747 - DNA, 35 bp, Artificial Sequence
  Synthetic oligonucleotide
ctcagcgcaccctcccgcgtttgcccgattgcgaa

SEQ ID NO: 205748 - DNA, 36 bp, Artificial Sequence
  Synthetic oligonucleotide
ccctgatttcgcgcaaggcgttgttcgggccactaa

SEQ ID NO: 205749 - DNA, 37 bp, Artificial Sequence
  Synthetic oligonucleotide
tgaagtgatccaacgcttggttcggaatcttacacga

SEQ ID NO: 205750 - DNA, 38 bp, Artificial Sequence
  Synthetic oligonucleotide
ttccaatcaacttctgcctcttcgactgtcttgcttca

SEQ ID NO: 205751 - DNA, 36 bp, Artificial Sequence
  Synthetic oligonucleotide
gggtggaaattgagttccaaatggggggtgggtgaa

SEQ ID NO: 205752 - DNA, 36 bp, Artificial Sequence
  Synthetic oligonucleotide
ggtgctcggccctgtgctggtgcgtaattgtggaca

SEQ ID NO: 205753 - DNA, 38 bp, Artificial Sequence
  Synthetic oligonucleotide
atcctgcctgtttgcaattgtagttcctttgccggtga

SEQ ID NO: 205754 - DNA, 35 bp, Artificial Sequence
  Synthetic oligonucleotide
gcgatcggatacacttttcctgatgggtaccaaag

SEQ ID NO: 205755 - DNA, 36 bp, Artificial Sequence
  Synthetic oligonucleotide
cttccgtgcggatcgtgcctaaccgctctacatatt

SEQ ID NO: 205756 - DNA, 36 bp, Artificial Sequence
  Synthetic oligonucleotide
gactatgttgaatatgccacctacgcgcttcgctca

SEQ ID NO: 205757 - DNA, 35 bp, Artificial Sequence
  Synthetic oligonucleotide
ctatgacgtacccgttgtagtacgttctgtgtccg

SEQ ID NO: 205758 - DNA, 35 bp, Artificial Sequence
  Synthetic oligonucleotide
tcactacctttcgattgctggtagctctacaggaa

SEQ ID NO: 205759 - DNA, 35 bp, Artificial Sequence
  Synthetic oligonucleotide
ttgaccctttaccatgggcacatgtgaacagggac

SEQ ID NO: 205760 - DNA, 35 bp, Artificial Sequence
  Synthetic oligonucleotide
cccttgcggggttgactgcacatgtcaacttaggg

SEQ ID NO: 205761 - DNA, 38 bp, Artificial Sequence
  Synthetic oligonucleotide
ttcaccctgaaacgagatatgctaggactccgccttgt

SEQ ID NO: 205762 - DNA, 36 bp, Artificial Sequence
  Synthetic oligonucleotide
cccctgctcctgcgcttcccagggtcgaaagttcca

SEQ ID NO: 205763 - DNA, 35 bp, Artificial Sequence
  Synthetic oligonucleotide
ccgttatcgggaaggaagtgcgtccttcgggccag

SEQ ID NO: 205764 - DNA, 35 bp, Artificial Sequence
  Synthetic oligonucleotide
tccccgggggtcgcttattgtctagctaggcctac

SEQ ID NO: 205765 - DNA, 36 bp, Artificial Sequence
  Synthetic oligonucleotide
agaatcaggaagttgccacttcgaccaacaaagaca

SEQ ID NO: 205766 - DNA, 35 bp, Artificial Sequence
  Synthetic oligonucleotide
ccgggcgagccacgggctgtacgagcaagtcacac

SEQ ID NO: 205767 - DNA, 38 bp, Artificial Sequence
  Synthetic oligonucleotide
aattcgtcactcgttgtgtgtagccggtccccaattga

SEQ ID NO: 205768 - DNA, 35 bp, Artificial Sequence
  Synthetic oligonucleotide
ccttggctgtgtcctgtcactttttatttcatgct

SEQ ID NO: 205769 - DNA, 35 bp, Artificial Sequence
  Synthetic oligonucleotide
gacaaatccgtcaaggaagaaacccccattgaggt

SEQ ID NO: 205770 - DNA, 36 bp, Artificial Sequence
  Synthetic oligonucleotide
cgcgaatttagaaaacatgcccctgcactgcccgaa

SEQ ID NO: 205771 - DNA, 35 bp, Artificial Sequence
  Synthetic oligonucleotide
tattcgttcctaacgtccgcgtccggtaaacgcca

SEQ ID NO: 205772 - DNA, 35 bp, Artificial Sequence
  Synthetic oligonucleotide
gggtttggctatcgtgttttcattcgttccgttag

SEQ ID NO: 205773 - DNA, 36 bp, Artificial Sequence
  Synthetic oligonucleotide
gtactcaaccaggctgagaacggtctaactatccct

SEQ ID NO: 205774 - DNA, 36 bp, Artificial Sequence
  Synthetic oligonucleotide
tgtaaccgcccagcccccgcagctgccgcaacgggt

SEQ ID NO: 205775 - DNA, 35 bp, Artificial Sequence
  Synthetic oligonucleotide
gccatggcaccaaagtcgcacaatcaatcgtgtgc

SEQ ID NO: 205776 - DNA, 35 bp, Artificial Sequence
  Synthetic oligonucleotide
tttggttgtttctttaaccatagcttaccacgcgt

SEQ ID NO: 205777 - DNA, 38 bp, Artificial Sequence
  Synthetic oligonucleotide
cccccctcttatttgaggagtccagctttgcgcaatgt

SEQ ID NO: 205778 - DNA, 35 bp, Artificial Sequence
  Synthetic oligonucleotide
cgacgtgatgaggtgtgttcctagtctctatctca

SEQ ID NO: 205779 - DNA, 35 bp, Artificial Sequence
  Synthetic oligonucleotide
tggctactccactctgagagtactctttagtaatt

SEQ ID NO: 205780 - DNA, 35 bp, Artificial Sequence
  Synthetic oligonucleotide
tccggcgagccacgggctgtacgagcaagtcacac

SEQ ID NO: 205781 - DNA, 35 bp, Artificial Sequence
  Synthetic oligonucleotide
caccgaagtaagctatcttcgctctctccctttag

SEQ ID NO: 205782 - DNA, 35 bp, Artificial Sequence
  Synthetic oligonucleotide
tgtgcggctaacgcctggctggaagggccgaactt

SEQ ID NO: 205783 - DNA, 36 bp, Artificial Sequence
  Synthetic oligonucleotide
cccggcgagccacgggctgtacggagcaagtcaccc

SEQ ID NO: 205784 - DNA, 35 bp, Artificial Sequence
  Synthetic oligonucleotide
gtaacctgtccttcagcccccatgagcccctcccg

SEQ ID NO: 205785 - DNA, 34 bp, Artificial Sequence
  Synthetic oligonucleotide
aatgctattgctcatctttagatggatccttttg

SEQ ID NO: 205786 - DNA, 37 bp, Artificial Sequence
  Synthetic oligonucleotide
tattatggcatgctagcttttttggcaccttaatcgt

SEQ ID NO: 205787 - DNA, 37 bp, Artificial Sequence
  Synthetic oligonucleotide
actaagttaccattcctctttatagcagtcacgctgg

SEQ ID NO: 205788 - DNA, 35 bp, Artificial Sequence
  Synthetic oligonucleotide
gccatcggacaatataaccaccatctactccgtcg

SEQ ID NO: 205789 - DNA, 36 bp, Artificial Sequence
  Synthetic oligonucleotide
gacctatggactgaccacgctctcttgttttttgct

SEQ ID NO: 205790 - DNA, 35 bp, Artificial Sequence
  Synthetic oligonucleotide
tggcttcaagctccatttcaacctacattgctacg

SEQ ID NO: 205791 - DNA, 35 bp, Artificial Sequence
  Synthetic oligonucleotide
agcaaaatcaccccggcccccatcaagacactgcc

SEQ ID NO: 205792 - DNA, 35 bp, Artificial Sequence
  Synthetic oligonucleotide
tccattagtggtcctcggtaggtactctgcctccg

SEQ ID NO: 205793 - DNA, 36 bp, Artificial Sequence
  Synthetic oligonucleotide
ttggttttgctgcggcccatcatacctattgtgtca

SEQ ID NO: 205794 - DNA, 38 bp, Artificial Sequence
  Synthetic oligonucleotide
tgaattggggtaattgtccgccacctgcgctcctatga

SEQ ID NO: 205795 - DNA, 35 bp, Artificial Sequence
  Synthetic oligonucleotide
aactgcgtcataagttcttaattgtggtaccgtac

SEQ ID NO: 205796 - DNA, 37 bp, Artificial Sequence
  Synthetic oligonucleotide
atcgttacctctttcgcactccatggctaaggttcga

SEQ ID NO: 205797 - DNA, 38 bp, Artificial Sequence
  Synthetic oligonucleotide
gactttaagcaagtttgggtctcacaccgtagtactca

SEQ ID NO: 205798 - DNA, 36 bp, Artificial Sequence
  Synthetic oligonucleotide
ggggaccctgctgacgttgtcccacttatgctattt

SEQ ID NO: 205799 - DNA, 36 bp, Artificial Sequence
  Synthetic oligonucleotide
cccggttcatagcgatggagccgcatcatctcacag

SEQ ID NO: 205800 - DNA, 35 bp, Artificial Sequence
  Synthetic oligonucleotide
ctaacgcctacagtcgtccttcgtaggtgacgaat

SEQ ID NO: 205801 - DNA, 38 bp, Artificial Sequence
  Synthetic oligonucleotide
ttatagagttgttccgttctatacttagctgtgggtgt

SEQ ID NO: 205802 - DNA, 37 bp, Artificial Sequence
  Synthetic oligonucleotide
gagtgctagcgcttacgtcctctatctcgtactgaaa

SEQ ID NO: 205803 - DNA, 36 bp, Artificial Sequence
  Synthetic oligonucleotide
tgggttgagcgcttcacgcgccctctggatttacca

SEQ ID NO: 205804 - DNA, 35 bp, Artificial Sequence
  Synthetic oligonucleotide
aatcgagggaatccaagtgaccagcgatgtccaac

SEQ ID NO: 205805 - DNA, 35 bp, Artificial Sequence
  Synthetic oligonucleotide
agaagcggttgcttccgattccttgcctgtttgcc

SEQ ID NO: 205806 - DNA, 37 bp, Artificial Sequence
  Synthetic oligonucleotide
catccccgactttagtttaagttccatctacgctgga

SEQ ID NO: 205807 - DNA, 37 bp, Artificial Sequence
  Synthetic oligonucleotide
ggactgttcagtctaccatctacttattgtattccgt

SEQ ID NO: 205808 - DNA, 35 bp, Artificial Sequence
  Synthetic oligonucleotide
tgaaaggaaatcgcgtactagccacctgacaaccc

SEQ ID NO: 205809 - DNA, 37 bp, Artificial Sequence
  Synthetic oligonucleotide
gctgcacctattgtgcttgcttgtagctcccccacca

SEQ ID NO: 205810 - DNA, 34 bp, Artificial Sequence
  Synthetic oligonucleotide
gtctgtttattccgcctgagcctcgctcggctca

SEQ ID NO: 205811 - DNA, 36 bp, Artificial Sequence
  Synthetic oligonucleotide
ctagccacacccaatatgccccgtttcaagatctta

SEQ ID NO: 205812 - DNA, 38 bp, Artificial Sequence
  Synthetic oligonucleotide
agtatcgatttgggggtacgccaccgcgggggacgtca

SEQ ID NO: 205813 - DNA, 26 bp, Artificial Sequence
  Synthetic oligonucleotide
tggtccaggattctttttatctactc

SEQ ID NO: 205814 - DNA, 37 bp, Artificial Sequence
  Synthetic oligonucleotide
ttctgcaaagcctcggagccattacccacggtcctca

SEQ ID NO: 205815 - DNA, 35 bp, Artificial Sequence
  Synthetic oligonucleotide
tctcgcgcccgattaactttcgattccacaccttg

SEQ ID NO: 205816 - DNA, 37 bp, Artificial Sequence
  Synthetic oligonucleotide
ccgaaaagcctggaaggtgtaagtccctgctcttaca

SEQ ID NO: 205817 - DNA, 35 bp, Artificial Sequence
  Synthetic oligonucleotide
cctctagggcctatctatctacccgccgttgtgag

SEQ ID NO: 205818 - DNA, 36 bp, Artificial Sequence
  Synthetic oligonucleotide
tatggatcgtatacgtcaaaccgcggttctgcgctt

SEQ ID NO: 205819 - DNA, 35 bp, Artificial Sequence
  Synthetic oligonucleotide
tgcatcggccgacacgttctacttcccctctaagg

SEQ ID NO: 205820 - DNA, 33 bp, Artificial Sequence
  Synthetic oligonucleotide
tttcacgtatctctggtgcctcgacatttgtgt

SEQ ID NO: 205821 - DNA, 35 bp, Artificial Sequence
  Synthetic oligonucleotide
tttcatctcacctaactatacaacctactacctca

SEQ ID NO: 205822 - DNA, 35 bp, Artificial Sequence
  Synthetic oligonucleotide
cccagtcttctcccccttctgctcgccatacccgt

SEQ ID NO: 205823 - DNA, 35 bp, Artificial Sequence
  Synthetic oligonucleotide
ttcggtgctgactaaaaagcgacccgccggacatt

SEQ ID NO: 205824 - DNA, 36 bp, Artificial Sequence
  Synthetic oligonucleotide
gaaagttgcaaactcttttattttgctcgaggtatt

SEQ ID NO: 205825 - DNA, 36 bp, Artificial Sequence
  Synthetic oligonucleotide
cgctgtacattcggtcatgggtctgactacttgtca

SEQ ID NO: 205826 - DNA, 36 bp, Artificial Sequence
  Synthetic oligonucleotide
cgtacgagcaaacatgagtcgcggcttatcctccga

SEQ ID NO: 205827 - DNA, 35 bp, Artificial Sequence
  Synthetic oligonucleotide
gtcaatgcctaccgtaaacgggttctgaatcacgt

SEQ ID NO: 205828 - DNA, 35 bp, Artificial Sequence
  Synthetic oligonucleotide
gtaattgtgctcggaaagcccattgatgcaagtgt

SEQ ID NO: 205829 - DNA, 37 bp, Artificial Sequence
  Synthetic oligonucleotide
gctgctgctcgcccgggttatgatacctcgaccgtca

SEQ ID NO: 205830 - DNA, 36 bp, Artificial Sequence
  Synthetic oligonucleotide
aaagtaggactgcttacaaccgtcccgttttctgca

SEQ ID NO: 205831 - DNA, 36 bp, Artificial Sequence
  Synthetic oligonucleotide
acgctaacgactggttccaagccacatagcccatca

SEQ ID NO: 205832 - DNA, 35 bp, Artificial Sequence
  Synthetic oligonucleotide
atgtacagcatgtcgtgcatccctggctaacccgt

SEQ ID NO: 205833 - DNA, 38 bp, Artificial Sequence
  Synthetic oligonucleotide
caacccaccgagcaatgctctagatgacctatacctca

SEQ ID NO: 205834 - DNA, 37 bp, Artificial Sequence
  Synthetic oligonucleotide
cgctaatagcgcaggatcacccacggaacgagttcgt

SEQ ID NO: 205835 - DNA, 35 bp, Artificial Sequence
  Synthetic oligonucleotide
tgattggagtggctctatcatatccggatccatat

SEQ ID NO: 205836 - DNA, 37 bp, Artificial Sequence
  Synthetic oligonucleotide
gtctatcacagcggagcccctcaccaattcgttatca

SEQ ID NO: 205837 - DNA, 37 bp, Artificial Sequence
  Synthetic oligonucleotide
gtgactccccttcgccccaacttccagactgctccca

SEQ ID NO: 205838 - DNA, 35 bp, Artificial Sequence
  Synthetic oligonucleotide
cgccggtccccagtgtagcacttgcacttaaggat

SEQ ID NO: 205839 - DNA, 35 bp, Artificial Sequence
  Synthetic oligonucleotide
tgcccgctagcaaagagtccctaactgagtaataa

SEQ ID NO: 205840 - DNA, 36 bp, Artificial Sequence
  Synthetic oligonucleotide
gttatcagacttgcaccaaatacgaaacctttgcct

SEQ ID NO: 205841 - DNA, 38 bp, Artificial Sequence
  Synthetic oligonucleotide
cattacttaaggtcaatgcgcttctcacttatccttgt

SEQ ID NO: 205842 - DNA, 35 bp, Artificial Sequence
  Synthetic oligonucleotide
cctaatcggtgcgttactcttactaagttgccacg

SEQ ID NO: 205843 - DNA, 36 bp, Artificial Sequence
  Synthetic oligonucleotide
atagagggccgtcactaacatcgaagctgtacgtaa

SEQ ID NO: 205844 - DNA, 35 bp, Artificial Sequence
  Synthetic oligonucleotide
ctgctacggtcgcgttggtctacaatccatatcct

SEQ ID NO: 205845 - DNA, 35 bp, Artificial Sequence
  Synthetic oligonucleotide
cccggaagggtcgatcttaaccacagctctttgcg

SEQ ID NO: 205846 - DNA, 35 bp, Artificial Sequence
  Synthetic oligonucleotide
tactactaacgcgactagggtagggcatgttaggc

SEQ ID NO: 205847 - DNA, 37 bp, Artificial Sequence
  Synthetic oligonucleotide
tggctgtggggttctcattcattaaattatgtggcca

SEQ ID NO: 205848 - DNA, 35 bp, Artificial Sequence
  Synthetic oligonucleotide
gaatatggtccgtacttggctttttagttccttca

SEQ ID NO: 205849 - DNA, 36 bp, Artificial Sequence
  Synthetic oligonucleotide
cttacctttaaaacttcatagtcgtccactgccttt

SEQ ID NO: 205850 - DNA, 38 bp, Artificial Sequence
  Synthetic oligonucleotide
tctgcccaccctcacgtacctacacctactcggcttgg

SEQ ID NO: 205851 - DNA, 36 bp, Artificial Sequence
  Synthetic oligonucleotide
gtcacgtattcttgacaacccgctcccgttcgcttt

SEQ ID NO: 205852 - DNA, 35 bp, Artificial Sequence
  Synthetic oligonucleotide
ccctgcttatttgcgcggtgctacgtgggactctg

SEQ ID NO: 205853 - DNA, 35 bp, Artificial Sequence
  Synthetic oligonucleotide
cgcactatctcttgccctccttgtcgaatgctcga

SEQ ID NO: 205854 - DNA, 35 bp, Artificial Sequence
  Synthetic oligonucleotide
tatttagcctaccgcattcgtgggtcactgtgact

SEQ ID NO: 205855 - DNA, 35 bp, Artificial Sequence
  Synthetic oligonucleotide
taagaccttagtattctatttagcactggtgggtt

SEQ ID NO: 205856 - DNA, 36 bp, Artificial Sequence
  Synthetic oligonucleotide
ccgtacacgtcattttttagcaatctctcctcacag

SEQ ID NO: 205857 - DNA, 36 bp, Artificial Sequence
  Synthetic oligonucleotide
ccaataactcactactttaggctccttatagtcgta

SEQ ID NO: 205858 - DNA, 35 bp, Artificial Sequence
  Synthetic oligonucleotide
attcatgactttccaattgtggtatggtgtgagtt

SEQ ID NO: 205859 - DNA, 34 bp, Artificial Sequence
  Synthetic oligonucleotide
ttcgcaagaataaggctctccttcagcatagcca

SEQ ID NO: 205860 - DNA, 36 bp, Artificial Sequence
  Synthetic oligonucleotide
ctaactcacagtccccaccacgctcatttgagcgca

SEQ ID NO: 205861 - DNA, 35 bp, Artificial Sequence
  Synthetic oligonucleotide
atgaaccgaccacctaacctgttgggttcactatc

SEQ ID NO: 205862 - DNA, 35 bp, Artificial Sequence
  Synthetic oligonucleotide
aattttcagcgagacaaaggatttaggtgcagtct

SEQ ID NO: 205863 - DNA, 35 bp, Artificial Sequence
  Synthetic oligonucleotide
gaggttacgcgccagttcacacgtctcactcatct

SEQ ID NO: 205864 - DNA, 35 bp, Artificial Sequence
  Synthetic oligonucleotide
ttgaactcttctatcgcatgacagggatgtaggct

SEQ ID NO: 205865 - DNA, 35 bp, Artificial Sequence
  Synthetic oligonucleotide
ggaaccgggccaattcaattacctgatgggtataa

SEQ ID NO: 205866 - DNA, 36 bp, Artificial Sequence
  Synthetic oligonucleotide
ggttgttcctatcgtcctaacggaatcgtgttagaa

SEQ ID NO: 205867 - DNA, 38 bp, Artificial Sequence
  Synthetic oligonucleotide
aaatgtctccactctccgtgtattttccattaccggca

SEQ ID NO: 205868 - DNA, 36 bp, Artificial Sequence
  Synthetic oligonucleotide
gcaatctgtatcgtgttactttttagaaacatccgt

SEQ ID NO: 205869 - DNA, 35 bp, Artificial Sequence
  Synthetic oligonucleotide
agagcccgtagaatacctgtcctcaccgaaatcaa

SEQ ID NO: 205870 - DNA, 37 bp, Artificial Sequence
  Synthetic oligonucleotide
atacactcattgttgcttccccggcatgtttatggca

SEQ ID NO: 205871 - DNA, 36 bp, Artificial Sequence
  Synthetic oligonucleotide
actcggatagccggggttcctctcgtgtgactgtca

SEQ ID NO: 205872 - DNA, 36 bp, Artificial Sequence
  Synthetic oligonucleotide
tattcacttaagccatgggtatcttctcgctgtttt

SEQ ID NO: 205873 - DNA, 37 bp, Artificial Sequence
  Synthetic oligonucleotide
tgtgctctacggtttcgcctcttcccgagtagatcgt

SEQ ID NO: 205874 - DNA, 35 bp, Artificial Sequence
  Synthetic oligonucleotide
tgacgtcgcgcacgtagcaagacatgcacgtattt

SEQ ID NO: 205875 - DNA, 36 bp, Artificial Sequence
  Synthetic oligonucleotide
atacttaaacttgaaggctcatcgtacctgggggca

SEQ ID NO: 205876 - DNA, 38 bp, Artificial Sequence
  Synthetic oligonucleotide
ctgcccggttagcggttgccttacatttttagcattca

SEQ ID NO: 205877 - DNA, 35 bp, Artificial Sequence
  Synthetic oligonucleotide
ttctgtaaagttaactcgtctacacgtgagtgact

SEQ ID NO: 205878 - DNA, 38 bp, Artificial Sequence
  Synthetic oligonucleotide
ccatagttctttatgctgcctgacggtctcgtgtttgt

SEQ ID NO: 205879 - DNA, 35 bp, Artificial Sequence
  Synthetic oligonucleotide
gctacataatggtcgacaatccattatactcgaaa

SEQ ID NO: 205880 - DNA, 35 bp, Artificial Sequence
  Synthetic oligonucleotide
tatggccgtacacaatattcggaacccgttaccct

SEQ ID NO: 205881 - DNA, 38 bp, Artificial Sequence
  Synthetic oligonucleotide
acgctggacctttggccttcttgggaatcctctaatgg

SEQ ID NO: 205882 - DNA, 35 bp, Artificial Sequence
  Synthetic oligonucleotide
tcatgctaagctcctcgtagagctacgttatttca

SEQ ID NO: 205883 - DNA, 36 bp, Artificial Sequence
  Synthetic oligonucleotide
ctgcgcacactcacatctaccgtttcaccgcgatct

SEQ ID NO: 205884 - DNA, 38 bp, Artificial Sequence
  Synthetic oligonucleotide
cgcccgcttaataagccatctgctcttctgtatcatgg

SEQ ID NO: 205885 - DNA, 36 bp, Artificial Sequence
  Synthetic oligonucleotide
taagtctcacctcccggtggtcatcagtaactctca

SEQ ID NO: 205886 - DNA, 35 bp, Artificial Sequence
  Synthetic oligonucleotide
cccggcgagccacgggctatacgagcaagtcacac

SEQ ID NO: 205887 - DNA, 35 bp, Artificial Sequence
  Synthetic oligonucleotide
cgggccaccagtcgcatttctagagtcattatagg

SEQ ID NO: 205888 - DNA, 35 bp, Artificial Sequence
  Synthetic oligonucleotide
tcttgtgacctctcattgttcgcatgccaccccat

SEQ ID NO: 205889 - DNA, 38 bp, Artificial Sequence
  Synthetic oligonucleotide
tcaaattcctgccccttgaatttattggacgagattgt

SEQ ID NO: 205890 - DNA, 35 bp, Artificial Sequence
  Synthetic oligonucleotide
ttgacatgacgcgagcattctcgaggtgttaggag

SEQ ID NO: 205891 - DNA, 35 bp, Artificial Sequence
  Synthetic oligonucleotide
ctcgccacggtctctgataagatcattgttgtccc

SEQ ID NO: 205892 - DNA, 38 bp, Artificial Sequence
  Synthetic oligonucleotide
gttcgctgagcccgccgagagcctacgattgttcttca

SEQ ID NO: 205893 - DNA, 34 bp, Artificial Sequence
  Synthetic oligonucleotide
atttcaagctttccgagagtgcccctgtgattcc

SEQ ID NO: 205894 - DNA, 37 bp, Artificial Sequence
  Synthetic oligonucleotide
taacaatagtcgggttttgtccgcatggccccactgt

SEQ ID NO: 205895 - DNA, 36 bp, Artificial Sequence
  Synthetic oligonucleotide
tcttggtaacatcccgactcaagcataatagtaatt

SEQ ID NO: 205896 - DNA, 38 bp, Artificial Sequence
  Synthetic oligonucleotide
acgtggaagtcatcagctcttagccaaccatattgtca

SEQ ID NO: 205897 - DNA, 36 bp, Artificial Sequence
  Synthetic oligonucleotide
gctattaacatctcccggtaccgcagatctttcaca

SEQ ID NO: 205898 - DNA, 35 bp, Artificial Sequence
  Synthetic oligonucleotide
ctcactctgagcgcttagacgcttgtgtgaacgta

SEQ ID NO: 205899 - DNA, 36 bp, Artificial Sequence
  Synthetic oligonucleotide
ggatctttgccggtggtcatccacgaattcaactag

SEQ ID NO: 205900 - DNA, 38 bp, Artificial Sequence
  Synthetic oligonucleotide
agccccatgctacacagagtgcgtctcttatcctgtgt

SEQ ID NO: 205901 - DNA, 34 bp, Artificial Sequence
  Synthetic oligonucleotide
gatgcaggagtctttagggctagatttcttcggc

SEQ ID NO: 205902 - DNA, 36 bp, Artificial Sequence
  Synthetic oligonucleotide
acgtctgctgacgcaaacacagggatggttactact

SEQ ID NO: 205903 - DNA, 35 bp, Artificial Sequence
  Synthetic oligonucleotide
tacaggattccgtttttgcagccctactcacatat

SEQ ID NO: 205904 - DNA, 35 bp, Artificial Sequence
  Synthetic oligonucleotide
gtccgcggtgggtcccattttgggcatttgaatca

SEQ ID NO: 205905 - DNA, 32 bp, Artificial Sequence
  Synthetic oligonucleotide
actacgggacgtagccccaacactctctcttt

SEQ ID NO: 205906 - DNA, 36 bp, Artificial Sequence
  Synthetic oligonucleotide
ggacctagttactcttactattcgtcacgaatctca

SEQ ID NO: 205907 - DNA, 35 bp, Artificial Sequence
  Synthetic oligonucleotide
gctcactctcggtacactggtcattaccctttgtg

SEQ ID NO: 205908 - DNA, 36 bp, Artificial Sequence
  Synthetic oligonucleotide
tcctcgtctccacccgtgcttattatcattctcgaa

SEQ ID NO: 205909 - DNA, 37 bp, Artificial Sequence
  Synthetic oligonucleotide
ctccgggaatcggagtttacggtccacaataggccca

SEQ ID NO: 205910 - DNA, 38 bp, Artificial Sequence
  Synthetic oligonucleotide
aattcgtcactcgttgtgtgtagccggtgtccaattga

SEQ ID NO: 205911 - DNA, 36 bp, Artificial Sequence
  Synthetic oligonucleotide
acgattcgcgcccgtgcgtttgagggattccagcaa

SEQ ID NO: 205912 - DNA, 38 bp, Artificial Sequence
  Synthetic oligonucleotide
gtaagtagagccagaccgtctacgagatccgttcttga

SEQ ID NO: 205913 - DNA, 35 bp, Artificial Sequence
  Synthetic oligonucleotide
actcaagtggttcggttctgcgcgcctcccgggat

SEQ ID NO: 205914 - DNA, 38 bp, Artificial Sequence
  Synthetic oligonucleotide
catctgaattacagcgcgttcctgcttcccactgttgt

SEQ ID NO: 205915 - DNA, 38 bp, Artificial Sequence
  Synthetic oligonucleotide
cgatccaggatcggtggtcgctccctcgttctgtctga

SEQ ID NO: 205916 - DNA, 34 bp, Artificial Sequence
  Synthetic oligonucleotide
tgctacctcacccagaattagacgcctactcact

SEQ ID NO: 205917 - DNA, 36 bp, Artificial Sequence
  Synthetic oligonucleotide
tcatttctctgtctgcgctttacttaggatttggtt

SEQ ID NO: 205918 - DNA, 37 bp, Artificial Sequence
  Synthetic oligonucleotide
acgacgccggttccacatcccatcggtcccatattgt

SEQ ID NO: 205919 - DNA, 38 bp, Artificial Sequence
  Synthetic oligonucleotide
gagggcacattggtgcaacgatttgtttgggaggttga

SEQ ID NO: 205920 - DNA, 35 bp, Artificial Sequence
  Synthetic oligonucleotide
gttgctttggccctcgctatacgggttcgtgttat

SEQ ID NO: 205921 - DNA, 35 bp, Artificial Sequence
  Synthetic oligonucleotide
tgagtttatttcaaattggttccacgaccgcttat

SEQ ID NO: 205922 - DNA, 32 bp, Artificial Sequence
  Synthetic oligonucleotide
ctacgcactacagggactattttcgccacaca

SEQ ID NO: 205923 - DNA, 36 bp, Artificial Sequence
  Synthetic oligonucleotide
gtgtgatcatagttcaaatcctgccggccctttcca

SEQ ID NO: 205924 - DNA, 35 bp, Artificial Sequence
  Synthetic oligonucleotide
tcagtttgccacttgtgacccgccctatttgtcta

SEQ ID NO: 205925 - DNA, 37 bp, Artificial Sequence
  Synthetic oligonucleotide
gctttgctcctttttggacaagtcctcttgacggtca

SEQ ID NO: 205926 - DNA, 35 bp, Artificial Sequence
  Synthetic oligonucleotide
attcccgccagctgcccttcctttgcgtaatctcc

SEQ ID NO: 205927 - DNA, 36 bp, Artificial Sequence
  Synthetic oligonucleotide
actgcggtggctgtcctcatgcaatccacttgcgtg

SEQ ID NO: 205928 - DNA, 35 bp, Artificial Sequence
  Synthetic oligonucleotide
cgaaccctctccgttctttcaccctatagtggaaa

SEQ ID NO: 205929 - DNA, 35 bp, Artificial Sequence
  Synthetic oligonucleotide
tcctagctcatcacattagctcgattcatctttct

SEQ ID NO: 205930 - DNA, 35 bp, Artificial Sequence
  Synthetic oligonucleotide
atcacgtctcccttccggttctgagttcacgctta

SEQ ID NO: 205931 - DNA, 36 bp, Artificial Sequence
  Synthetic oligonucleotide
tacgttcggcctctggccggcccgcacatagggcaa

SEQ ID NO: 205932 - DNA, 35 bp, Artificial Sequence
  Synthetic oligonucleotide
gcccagggacccactcaatatcaaaggtcaacaat

SEQ ID NO: 205933 - DNA, 36 bp, Artificial Sequence
  Synthetic oligonucleotide
acccatgttgcttttcctgctacgctcagatcgcca

SEQ ID NO: 205934 - DNA, 38 bp, Artificial Sequence
  Synthetic oligonucleotide
tatgactgacaaatcaagctggcatccctcgcccctca

SEQ ID NO: 205935 - DNA, 35 bp, Artificial Sequence
  Synthetic oligonucleotide
tttgtaccagacacatggtcacccatgctgtatct

SEQ ID NO: 205936 - DNA, 37 bp, Artificial Sequence
  Synthetic oligonucleotide
tcgacatgcttagtattcataagcaataccaacatca

SEQ ID NO: 205937 - DNA, 37 bp, Artificial Sequence
  Synthetic oligonucleotide
aatgttttcttggtggcaattcagcacattacgtaca

SEQ ID NO: 205938 - DNA, 38 bp, Artificial Sequence
  Synthetic oligonucleotide
gttctaccagaggaccgtggtctcctcacattttatgt

SEQ ID NO: 205939 - DNA, 35 bp, Artificial Sequence
  Synthetic oligonucleotide
ccgtgccctgtcaataggactgtctacgcctggcg

SEQ ID NO: 205940 - DNA, 35 bp, Artificial Sequence
  Synthetic oligonucleotide
catgataattctattgccaagataatgtacattta

SEQ ID NO: 205941 - DNA, 35 bp, Artificial Sequence
  Synthetic oligonucleotide
caatgccagcttgcacctcgtgcggttacccggct

SEQ ID NO: 205942 - DNA, 36 bp, Artificial Sequence
  Synthetic oligonucleotide
ggtgttttcgactcgcgttgcacagtggatttaaaa

SEQ ID NO: 205943 - DNA, 37 bp, Artificial Sequence
  Synthetic oligonucleotide
tcgcgtctcttttcattgtcttcttgtgtctgtagga

SEQ ID NO: 205944 - DNA, 38 bp, Artificial Sequence
  Synthetic oligonucleotide
cgccgaggatgtcatgcgcctgtgcacaacgactttgt

SEQ ID NO: 205945 - DNA, 37 bp, Artificial Sequence
  Synthetic oligonucleotide
agtcctagccgtctgtaggtttggttgttcttgttca

SEQ ID NO: 205946 - DNA, 36 bp, Artificial Sequence
  Synthetic oligonucleotide
cgctcctccaccgtacccttaccgcattagatcggt

SEQ ID NO: 205947 - DNA, 37 bp, Artificial Sequence
  Synthetic oligonucleotide
caactgagcgcggagaatttttagctgacgattttca

SEQ ID NO: 205948 - DNA, 36 bp, Artificial Sequence
  Synthetic oligonucleotide
tgagagcacgctgagctttgttcttgttactctata

SEQ ID NO: 205949 - DNA, 35 bp, Artificial Sequence
  Synthetic oligonucleotide
ggtgtccccccttgcgcaactggccatgagagtaa

SEQ ID NO: 205950 - DNA, 36 bp, Artificial Sequence
  Synthetic oligonucleotide
tttacttctacctgttatggcgatcatataccagca

SEQ ID NO: 205951 - DNA, 28 bp, Artificial Sequence
  Synthetic oligonucleotide
ggatcacgatctattgcggttactgtgg

SEQ ID NO: 205952 - DNA, 35 bp, Artificial Sequence
  Synthetic oligonucleotide
gtttctcactttcatggccctgccatcaatgcgca

SEQ ID NO: 205953 - DNA, 35 bp, Artificial Sequence
  Synthetic oligonucleotide
gtccagttatacttctcccatcggaaacctggtct

SEQ ID NO: 205954 - DNA, 36 bp, Artificial Sequence
  Synthetic oligonucleotide
acggcatcgcccaccattcgatattcaaagcttatt

SEQ ID NO: 205955 - DNA, 38 bp, Artificial Sequence
  Synthetic oligonucleotide
aacatctctctccatgggttctaagaaacgaagtctga

SEQ ID NO: 205956 - DNA, 36 bp, Artificial Sequence
  Synthetic oligonucleotide
gacaccgcatcagtttatcaacaccactgtgctcca

SEQ ID NO: 205957 - DNA, 35 bp, Artificial Sequence
  Synthetic oligonucleotide
tcctcgtcttcattgtaggtatccgtcggagttcc

SEQ ID NO: 205958 - DNA, 35 bp, Artificial Sequence
  Synthetic oligonucleotide
ctcgcagagcaccatcaccgagaaccttagctgcg

SEQ ID NO: 205959 - DNA, 36 bp, Artificial Sequence
  Synthetic oligonucleotide
gtatgcccaccatggccgtataccttcgcccgagct

SEQ ID NO: 205960 - DNA, 37 bp, Artificial Sequence
  Synthetic oligonucleotide
agcggactcataaaccatcagtaactctggtccttgt

SEQ ID NO: 205961 - DNA, 36 bp, Artificial Sequence
  Synthetic oligonucleotide
tgtaagtgtccgtattttcactctgcatcgccatcg

SEQ ID NO: 205962 - DNA, 36 bp, Artificial Sequence
  Synthetic oligonucleotide
tcgggcacaacacttttatactcatgcaatacttca

SEQ ID NO: 205963 - DNA, 36 bp, Artificial Sequence
  Synthetic oligonucleotide
gttgtttccaacaccgtctgtgtcggttgcaaataa

SEQ ID NO: 205964 - DNA, 33 bp, Artificial Sequence
  Synthetic oligonucleotide
ccgcccttacctaatgatgcccctatgttcctg

SEQ ID NO: 205965 - DNA, 38 bp, Artificial Sequence
  Synthetic oligonucleotide
tcaacgaagggtaacacggagggattacgatgcgttgg

SEQ ID NO: 205966 - DNA, 37 bp, Artificial Sequence
  Synthetic oligonucleotide
cttgcctcggtgcacccaggattcgtgaactcccgca

SEQ ID NO: 205967 - DNA, 37 bp, Artificial Sequence
  Synthetic oligonucleotide
aacaggctctggcgcatggcctaagcttaccgtagca

SEQ ID NO: 205968 - DNA, 38 bp, Artificial Sequence
  Synthetic oligonucleotide
taacgacatcgttcgtacggctcatgcgcttactctgt

SEQ ID NO: 205969 - DNA, 36 bp, Artificial Sequence
  Synthetic oligonucleotide
ggcatactagccgatccgagtttgccagcccacacg

SEQ ID NO: 205970 - DNA, 35 bp, Artificial Sequence
  Synthetic oligonucleotide
tgtagagctgcgcaatctacaaacaattctagtcc

SEQ ID NO: 205971 - DNA, 33 bp, Artificial Sequence
  Synthetic oligonucleotide
acaagctcatgcaggtctcataaatacaacacc

SEQ ID NO: 205972 - DNA, 35 bp, Artificial Sequence
  Synthetic oligonucleotide
tgcattctaaacctatgcctcttttggttatagca

SEQ ID NO: 205973 - DNA, 38 bp, Artificial Sequence
  Synthetic oligonucleotide
aaccctatcctgatctgggttaccgtacgacaatttgt

SEQ ID NO: 205974 - DNA, 37 bp, Artificial Sequence
  Synthetic oligonucleotide
gccagcaccgatctcggcctcaagcctcaggcattgt

SEQ ID NO: 205975 - DNA, 36 bp, Artificial Sequence
  Synthetic oligonucleotide
ttctaggtccttcagaccctccgcctcgctggtaca

SEQ ID NO: 205976 - DNA, 37 bp, Artificial Sequence
  Synthetic oligonucleotide
ttatcgctttcgacaccaagccggggctagtatcaca

SEQ ID NO: 205977 - DNA, 37 bp, Artificial Sequence
  Synthetic oligonucleotide
cccttgttcttcgtacggatatcttcagatctcgaca

SEQ ID NO: 205978 - DNA, 37 bp, Artificial Sequence
  Synthetic oligonucleotide
tctatattggctatccgcattctatctctctccgtga

SEQ ID NO: 205979 - DNA, 35 bp, Artificial Sequence
  Synthetic oligonucleotide
gtaagtatcgattctagatggcttgtaactttgct

SEQ ID NO: 205980 - DNA, 38 bp, Artificial Sequence
  Synthetic oligonucleotide
atgccacgggaatactgtatgtaccatctcactgctgt

SEQ ID NO: 205981 - DNA, 36 bp, Artificial Sequence
  Synthetic oligonucleotide
gatcctggtactacttcattttcccggtcatggaat

SEQ ID NO: 205982 - DNA, 35 bp, Artificial Sequence
  Synthetic oligonucleotide
tgtcaccgtttagctcccagaagccgacctgagga

SEQ ID NO: 205983 - DNA, 32 bp, Artificial Sequence
  Synthetic oligonucleotide
accgccggtttcttttcgtcgcaacctcccgt

SEQ ID NO: 205984 - DNA, 35 bp, Artificial Sequence
  Synthetic oligonucleotide
atctctccttgctaagttgaacgactaccgcttgc

SEQ ID NO: 205985 - DNA, 37 bp, Artificial Sequence
  Synthetic oligonucleotide
cgtcccctcttatctttaggcccagggatcaccctgt

SEQ ID NO: 205986 - DNA, 35 bp, Artificial Sequence
  Synthetic oligonucleotide
ggattaacgcattatgaactcccactcacttttat

SEQ ID NO: 205987 - DNA, 35 bp, Artificial Sequence
  Synthetic oligonucleotide
tttaccgcttaaagcatagcatcttatactaacct

SEQ ID NO: 205988 - DNA, 35 bp, Artificial Sequence
  Synthetic oligonucleotide
cctaatcggtgcgttactcttactaagttgccagt

SEQ ID NO: 205989 - DNA, 35 bp, Artificial Sequence
  Synthetic oligonucleotide
agaccatttaaccgccctggctccggccccctcgg

SEQ ID NO: 205990 - DNA, 36 bp, Artificial Sequence
  Synthetic oligonucleotide
atagacctgtgaccaggttgcaccgacatttctgca

SEQ ID NO: 205991 - DNA, 35 bp, Artificial Sequence
  Synthetic oligonucleotide
gcgctaccgatcctgtctaacctactagctccgga

SEQ ID NO: 205992 - DNA, 35 bp, Artificial Sequence
  Synthetic oligonucleotide
gtgtggccgccgggctaccatccgctaggctctct

SEQ ID NO: 205993 - DNA, 36 bp, Artificial Sequence
  Synthetic oligonucleotide
cccctgatcgtccgttttcgacaggggggcaaccaa

SEQ ID NO: 205994 - DNA, 35 bp, Artificial Sequence
  Synthetic oligonucleotide
cgccctctcttgttgttaccgtgctgtcctcggcc

SEQ ID NO: 205995 - DNA, 35 bp, Artificial Sequence
  Synthetic oligonucleotide
gtaacacgattttcacgtccgaccgcatacgcgcc

SEQ ID NO: 205996 - DNA, 35 bp, Artificial Sequence
  Synthetic oligonucleotide
ctgcatgtcctttggatttagccagttgagctcat

SEQ ID NO: 205997 - DNA, 36 bp, Artificial Sequence
  Synthetic oligonucleotide
gcatagtgggatgtttatcgagaactcccgtgtaca

SEQ ID NO: 205998 - DNA, 35 bp, Artificial Sequence
  Synthetic oligonucleotide
cgatacctgtaccctccattctttccatgtagtat

SEQ ID NO: 205999 - DNA, 35 bp, Artificial Sequence
  Synthetic oligonucleotide
gttagagtctcggttaatcgggtactggcttctac

SEQ ID NO: 206000 - DNA, 36 bp, Artificial Sequence
  Synthetic oligonucleotide
atggggtcctgcgacatccatacgactttcgcccca

SEQ ID NO: 206001 - DNA, 36 bp, Artificial Sequence
  Synthetic oligonucleotide
atttgccgccggggcaaaccgccctgttgtcccatt

SEQ ID NO: 206002 - DNA, 35 bp, Artificial Sequence
  Synthetic oligonucleotide
gctatcgctcatcatccacgttgtaccttagcccc

SEQ ID NO: 206003 - DNA, 35 bp, Artificial Sequence
  Synthetic oligonucleotide
tcttaaggtccgcgagacctcgcactaatgtccct

SEQ ID NO: 206004 - DNA, 35 bp, Artificial Sequence
  Synthetic oligonucleotide
gcatgtcccgaagcccgcgccaactgtttacttgc

SEQ ID NO: 206005 - DNA, 36 bp, Artificial Sequence
  Synthetic oligonucleotide
tggttttatagcaatccacacgtgacgcgtcaacgg

SEQ ID NO: 206006 - DNA, 36 bp, Artificial Sequence
  Synthetic oligonucleotide
ttgcttgcccgtccataaacacgatcttgttctcta

SEQ ID NO: 206007 - DNA, 35 bp, Artificial Sequence
  Synthetic oligonucleotide
acgtccccattattaagtgctgactgtgtgcggtt

SEQ ID NO: 206008 - DNA, 34 bp, Artificial Sequence
  Synthetic oligonucleotide
tatttaattgggggggggattctgttttgtctct

SEQ ID NO: 206009 - DNA, 35 bp, Artificial Sequence
  Synthetic oligonucleotide
taggtttgctgtcatgtgcgtaggccatctctccc

SEQ ID NO: 206010 - DNA, 37 bp, Artificial Sequence
  Synthetic oligonucleotide
gaacagcaaccgtgttctcgtaaagaacgactacaca

SEQ ID NO: 206011 - DNA, 35 bp, Artificial Sequence
  Synthetic oligonucleotide
atcatcccccaatgcctgaggttaaaatgtatgct

SEQ ID NO: 206012 - DNA, 36 bp, Artificial Sequence
  Synthetic oligonucleotide
cctgcttaggcatcctttctgacgccgaccacccgt

SEQ ID NO: 206013 - DNA, 37 bp, Artificial Sequence
  Synthetic oligonucleotide
gcggtcggtgtccgtttaccatttcggcttttatcgt

SEQ ID NO: 206014 - DNA, 36 bp, Artificial Sequence
  Synthetic oligonucleotide
tgctacactgagtaccagggctactggcgggtctct

SEQ ID NO: 206015 - DNA, 35 bp, Artificial Sequence
  Synthetic oligonucleotide
gcacgtggccgtctctgctccgcatatttcctact

SEQ ID NO: 206016 - DNA, 35 bp, Artificial Sequence
  Synthetic oligonucleotide
ctcgcgtgaagcgaggtccgtctagcgcattctag

SEQ ID NO: 206017 - DNA, 35 bp, Artificial Sequence
  Synthetic oligonucleotide
actgaatatcccagccctaaaagacagcatcgcca

SEQ ID NO: 206018 - DNA, 37 bp, Artificial Sequence
  Synthetic oligonucleotide
gttcagtttaccccggggatgcaatgtgtacgcctgt

SEQ ID NO: 206019 - DNA, 35 bp, Artificial Sequence
  Synthetic oligonucleotide
gccacagggatgccgtctattttggccctttatga

SEQ ID NO: 206020 - DNA, 28 bp, Artificial Sequence
  Synthetic oligonucleotide
ttccttctcgcctcttcaggctaaatgt

SEQ ID NO: 206021 - DNA, 36 bp, Artificial Sequence
  Synthetic oligonucleotide
actcaactgcggccaatgtaaatggcatgatcgcta

SEQ ID NO: 206022 - DNA, 38 bp, Artificial Sequence
  Synthetic oligonucleotide
gttttgtcgaggttccgtctggccgtttgttattgtgt

SEQ ID NO: 206023 - DNA, 37 bp, Artificial Sequence
  Synthetic oligonucleotide
gatctctggctcagcatccttgaccatgccttgctca

SEQ ID NO: 206024 - DNA, 38 bp, Artificial Sequence
  Synthetic oligonucleotide
gtctgggtccggtcgaggtacttaatcttactttttgt

SEQ ID NO: 206025 - DNA, 35 bp, Artificial Sequence
  Synthetic oligonucleotide
ttgccaatatggtctcgcttgctccatccatttgg

SEQ ID NO: 206026 - DNA, 35 bp, Artificial Sequence
  Synthetic oligonucleotide
catgcaacctacgcgcctgaagaatacggctatag

SEQ ID NO: 206027 - DNA, 38 bp, Artificial Sequence
  Synthetic oligonucleotide
aattcgtcacacgttgtgtgtagccggtgcccaattga

SEQ ID NO: 206028 - DNA, 37 bp, Artificial Sequence
  Synthetic oligonucleotide
aaagttacgcgcaccaaggttattacctggtgttcca

SEQ ID NO: 206029 - DNA, 38 bp, Artificial Sequence
  Synthetic oligonucleotide
ctctcccgtttctgatcctgtcctcaacgtgttcatca

SEQ ID NO: 206030 - DNA, 36 bp, Artificial Sequence
  Synthetic oligonucleotide
ctctcgattttggtccataccctctcgaattctcgt

SEQ ID NO: 206031 - DNA, 37 bp, Artificial Sequence
  Synthetic oligonucleotide
aacgcaatcatgagctctacgagtatagtaaatagca

SEQ ID NO: 206032 - DNA, 35 bp, Artificial Sequence
  Synthetic oligonucleotide
gcctagcaccacattcaaattacctcacatgcacg

SEQ ID NO: 206033 - DNA, 37 bp, Artificial Sequence
  Synthetic oligonucleotide
gagttaactcgttcataatcttggaaaattgtggtgg

SEQ ID NO: 206034 - DNA, 35 bp, Artificial Sequence
  Synthetic oligonucleotide
tacttaattggggggggggattctgttttgtctat

SEQ ID NO: 206035 - DNA, 37 bp, Artificial Sequence
  Synthetic oligonucleotide
tgcctgggcttaaggtattttgcatcaagccatatgt

SEQ ID NO: 206036 - DNA, 35 bp, Artificial Sequence
  Synthetic oligonucleotide
aagtcggctgtctggtgcgcgcaaaccttcccaag

SEQ ID NO: 206037 - DNA, 36 bp, Artificial Sequence
  Synthetic oligonucleotide
acattcatttcttcaatgagtacgtgcacctgcact

SEQ ID NO: 206038 - DNA, 36 bp, Artificial Sequence
  Synthetic oligonucleotide
gcgcgtgctcccaggtcacgcgttgcaaacttcgca

SEQ ID NO: 206039 - DNA, 35 bp, Artificial Sequence
  Synthetic oligonucleotide
cacctcggctgagcttgcctgaattaccccgtgcc

SEQ ID NO: 206040 - DNA, 35 bp, Artificial Sequence
  Synthetic oligonucleotide
gtgaacgtgatgtttgcacgcgtgagcatgcagcg

SEQ ID NO: 206041 - DNA, 36 bp, Artificial Sequence
  Synthetic oligonucleotide
cctggtccactgccctctcgtcaattccatgttaca

SEQ ID NO: 206042 - DNA, 35 bp, Artificial Sequence
  Synthetic oligonucleotide
gccacgggcccatattgtgttatcagttctcagcg

SEQ ID NO: 206043 - DNA, 37 bp, Artificial Sequence
  Synthetic oligonucleotide
agcctgggatgccaagcctcccgtgtgtcatggtgga

SEQ ID NO: 206044 - DNA, 36 bp, Artificial Sequence
  Synthetic oligonucleotide
gcgacccacccctaaactcgcatctgtcgggtttat

SEQ ID NO: 206045 - DNA, 35 bp, Artificial Sequence
  Synthetic oligonucleotide
gatcagctgtgtgatctaatgtatatcactttaag

SEQ ID NO: 206046 - DNA, 36 bp, Artificial Sequence
  Synthetic oligonucleotide
aatagactggtagtctctgtgtttagatatttcaaa

SEQ ID NO: 206047 - DNA, 36 bp, Artificial Sequence
  Synthetic oligonucleotide
tgccgggtacttggaccagacctgattgcgtggtct

SEQ ID NO: 206048 - DNA, 36 bp, Artificial Sequence
  Synthetic oligonucleotide
cagggctctgattattgcatcagcactttcccacca

SEQ ID NO: 206049 - DNA, 35 bp, Artificial Sequence
  Synthetic oligonucleotide
cacgtaagctcgatccattttggcttatcgcccct

SEQ ID NO: 206050 - DNA, 35 bp, Artificial Sequence
  Synthetic oligonucleotide
tcatatcctcgcaagaaaaagtgtgaaggttggct

SEQ ID NO: 206051 - DNA, 38 bp, Artificial Sequence
  Synthetic oligonucleotide
cccggcaatagtctgggtctgcctcgttctatcgttca

SEQ ID NO: 206052 - DNA, 35 bp, Artificial Sequence
  Synthetic oligonucleotide
aaatatcgtacgggtacgcccatctgcgcattcat

SEQ ID NO: 206053 - DNA, 37 bp, Artificial Sequence
  Synthetic oligonucleotide
ggtacgtgacggctgttaatcctcacgctctcttcgg

SEQ ID NO: 206054 - DNA, 35 bp, Artificial Sequence
  Synthetic oligonucleotide
attgccatttccagggcgtcggtctgtcccgcttt

SEQ ID NO: 206055 - DNA, 37 bp, Artificial Sequence
  Synthetic oligonucleotide
ccactcatatcaacccacgcttatgcctccggcatca

SEQ ID NO: 206056 - DNA, 35 bp, Artificial Sequence
  Synthetic oligonucleotide
tcttcatcagcaacatgagctggatgcgtttcgaa

SEQ ID NO: 206057 - DNA, 35 bp, Artificial Sequence
  Synthetic oligonucleotide
tttgtcattacataagttcgcgtgtcatcggttag

SEQ ID NO: 206058 - DNA, 35 bp, Artificial Sequence
  Synthetic oligonucleotide
ggtaatcgttcttaattattctgtgttaggtcacg

SEQ ID NO: 206059 - DNA, 37 bp, Artificial Sequence
  Synthetic oligonucleotide
tgaaaagcgcaagctttattgtgcgggttatcgctca

SEQ ID NO: 206060 - DNA, 37 bp, Artificial Sequence
  Synthetic oligonucleotide
tattgtatggtataccgccactctattagttattcga

SEQ ID NO: 206061 - DNA, 35 bp, Artificial Sequence
  Synthetic oligonucleotide
atgccatactctcctaccggagcatgtttaggtgt

SEQ ID NO: 206062 - DNA, 35 bp, Artificial Sequence
  Synthetic oligonucleotide
cctcgattatgcgctttatccgacagacgtttcgt

SEQ ID NO: 206063 - DNA, 36 bp, Artificial Sequence
  Synthetic oligonucleotide
cgctcctccaccgtacccttaccgcattagatcgca

SEQ ID NO: 206064 - DNA, 36 bp, Artificial Sequence
  Synthetic oligonucleotide
gcggtactgtctgcaacctggctggagtatgcccct

SEQ ID NO: 206065 - DNA, 35 bp, Artificial Sequence
  Synthetic oligonucleotide
ttacggatttacgtgcatgctctctccgtccttcg

SEQ ID NO: 206066 - DNA, 38 bp, Artificial Sequence
  Synthetic oligonucleotide
tcaacgaagggtaacacggagggattacgatgcgttca

SEQ ID NO: 206067 - DNA, 35 bp, Artificial Sequence
  Synthetic oligonucleotide
gcccaacgggacaaatcgaagctccatagcactgg

SEQ ID NO: 206068 - DNA, 37 bp, Artificial Sequence
  Synthetic oligonucleotide
taacaatagtcgggttttgtccgcatggccccactca

SEQ ID NO: 206069 - DNA, 35 bp, Artificial Sequence
  Synthetic oligonucleotide
cccacccgtcaacaatatagctcgtacgcactact

SEQ ID NO: 206070 - DNA, 35 bp, Artificial Sequence
  Synthetic oligonucleotide
cccggtcggttctacggcctgtgaagcccttccag

SEQ ID NO: 206071 - DNA, 35 bp, Artificial Sequence
  Synthetic oligonucleotide
ttagctattccaagccataaaaccatgttcccgaa

SEQ ID NO: 206072 - DNA, 36 bp, Artificial Sequence
  Synthetic oligonucleotide
gggaactgtcgcatgagtgtaccgctcacgccgaat

SEQ ID NO: 206073 - DNA, 36 bp, Artificial Sequence
  Synthetic oligonucleotide
ggggaccctgctgacgttgtcccacttatgctattg

SEQ ID NO: 206074 - DNA, 35 bp, Artificial Sequence
  Synthetic oligonucleotide
tcttttaatgtcgttgtgcgacatagtgtccttcc

SEQ ID NO: 206075 - DNA, 35 bp, Artificial Sequence
  Synthetic oligonucleotide
gctttgtccggaaatttcggtttgatcattactct

SEQ ID NO: 206076 - DNA, 37 bp, Artificial Sequence
  Synthetic oligonucleotide
cggggataaaaccccttttctcacgccctaccttcca

SEQ ID NO: 206077 - DNA, 35 bp, Artificial Sequence
  Synthetic oligonucleotide
gtagccgctactttatgcttcccctgggtctctgt

SEQ ID NO: 206078 - DNA, 35 bp, Artificial Sequence
  Synthetic oligonucleotide
gcaataaaaggggtttcaaggtctgtgctgcgcct

SEQ ID NO: 206079 - DNA, 26 bp, Artificial Sequence
  Synthetic oligonucleotide
cgtttgcttgtttctcgacttcctga

SEQ ID NO: 206080 - DNA, 37 bp, Artificial Sequence
  Synthetic oligonucleotide
ttgtcgttaattttattctgagctctgcattgcctgg

SEQ ID NO: 206081 - DNA, 37 bp, Artificial Sequence
  Synthetic oligonucleotide
gacatccgggtggcaccgcatcggccactccacactg

SEQ ID NO: 206082 - DNA, 37 bp, Artificial Sequence
  Synthetic oligonucleotide
gcctcgggactccggctatgtgcttcgattcctcagt

SEQ ID NO: 206083 - DNA, 38 bp, Artificial Sequence
  Synthetic oligonucleotide
ctaccttgtaaaagcaacacctgtgtgctcctccctca

SEQ ID NO: 206084 - DNA, 36 bp, Artificial Sequence
  Synthetic oligonucleotide
gctcgtctgttgttgattctggggattcacctcaca

SEQ ID NO: 206085 - DNA, 35 bp, Artificial Sequence
  Synthetic oligonucleotide
gatgacgccggtcatgcctctctgaatttcgattt

SEQ ID NO: 206086 - DNA, 35 bp, Artificial Sequence
  Synthetic oligonucleotide
gatcagatcaactcccccagttttatcagaccctt

SEQ ID NO: 206087 - DNA, 36 bp, Artificial Sequence
  Synthetic oligonucleotide
tgaactccggttagtcttagcttcatggccgctgca

SEQ ID NO: 206088 - DNA, 35 bp, Artificial Sequence
  Synthetic oligonucleotide
ctaatccgcaggttcttattgacgagataatcgcg

SEQ ID NO: 206089 - DNA, 35 bp, Artificial Sequence
  Synthetic oligonucleotide
ggaatcgcgtggtgctacacgtcttaccctcctgt

SEQ ID NO: 206090 - DNA, 38 bp, Artificial Sequence
  Synthetic oligonucleotide
acgcttgctttaccccacgccatgcgacgcgtgggtgt

SEQ ID NO: 206091 - DNA, 35 bp, Artificial Sequence
  Synthetic oligonucleotide
gcatttaatgttgctcactacatcggttcttgggg

SEQ ID NO: 206092 - DNA, 36 bp, Artificial Sequence
  Synthetic oligonucleotide
ctccaccgatgccattgccggagctatccattgtgg

SEQ ID NO: 206093 - DNA, 38 bp, Artificial Sequence
  Synthetic oligonucleotide
aacgcctccatgacgaggacctcatcactaaatcgtga

SEQ ID NO: 206094 - DNA, 35 bp, Artificial Sequence
  Synthetic oligonucleotide
gtccagctgatatctcctaccgtgccgtttaaact

SEQ ID NO: 206095 - DNA, 37 bp, Artificial Sequence
  Synthetic oligonucleotide
ctattagccaaatccgcctaatattctctcatcacgt

SEQ ID NO: 206096 - DNA, 35 bp, Artificial Sequence
  Synthetic oligonucleotide
cgaaccgggtcacgcacctccctgaggccatggat

SEQ ID NO: 206097 - DNA, 36 bp, Artificial Sequence
  Synthetic oligonucleotide
gagtgtcacaagctctcagttttggcgtgcttgaaa

SEQ ID NO: 206098 - DNA, 36 bp, Artificial Sequence
  Synthetic oligonucleotide
ggattagcttgtcgatttttggcccgcccctgctga

SEQ ID NO: 206099 - DNA, 36 bp, Artificial Sequence
  Synthetic oligonucleotide
cgctcgggcaattttttctgcgatgccgcgcacaca

SEQ ID NO: 206100 - DNA, 35 bp, Artificial Sequence
  Synthetic oligonucleotide
agcacgtctcccttccgtttctgagttcacgctta

SEQ ID NO: 206101 - DNA, 36 bp, Artificial Sequence
  Synthetic oligonucleotide
tgtcgcggccggaatcatgactttaggggtggagga

SEQ ID NO: 206102 - DNA, 37 bp, Artificial Sequence
  Synthetic oligonucleotide
cgcatctctatcggttcgcgcgacttttccatctggg

SEQ ID NO: 206103 - DNA, 35 bp, Artificial Sequence
  Synthetic oligonucleotide
gccttgtagctactggtgtaccaccacctatagca

SEQ ID NO: 206104 - DNA, 35 bp, Artificial Sequence
  Synthetic oligonucleotide
ctgcaagcccgctttgagcttttgcctcttttgag

SEQ ID NO: 206105 - DNA, 36 bp, Artificial Sequence
  Synthetic oligonucleotide
tgtccaaaccagctggaagaggattccacgctgtgt

SEQ ID NO: 206106 - DNA, 37 bp, Artificial Sequence
  Synthetic oligonucleotide
gctatggcattgggcaatccttgccgttctgtgtagt

SEQ ID NO: 206107 - DNA, 36 bp, Artificial Sequence
  Synthetic oligonucleotide
tcgttatttacctgccattattcgctagcttgacaa

SEQ ID NO: 206108 - DNA, 35 bp, Artificial Sequence
  Synthetic oligonucleotide
agagcctcccccttgtcacatgaatagggaacgtc

SEQ ID NO: 206109 - DNA, 35 bp, Artificial Sequence
  Synthetic oligonucleotide
gacaatatctgcggctatgtgtaagctcccgccag

SEQ ID NO: 206110 - DNA, 37 bp, Artificial Sequence
  Synthetic oligonucleotide
gactcgcgccagccggaggtgtggcgtacctgcctca

SEQ ID NO: 206111 - DNA, 38 bp, Artificial Sequence
  Synthetic oligonucleotide
attttatccggaccggtctggagtgaattgcttcgtca

SEQ ID NO: 206112 - DNA, 35 bp, Artificial Sequence
  Synthetic oligonucleotide
tcgtggcgacattcactacatggtcttccctaaag

SEQ ID NO: 206113 - DNA, 36 bp, Artificial Sequence
  Synthetic oligonucleotide
gatagtttgccgctcaattgttagccgattctaaca

SEQ ID NO: 206114 - DNA, 38 bp, Artificial Sequence
  Synthetic oligonucleotide
tagtacgtgaggcgaccgccagaaccagccctttttgt

SEQ ID NO: 206115 - DNA, 37 bp, Artificial Sequence
  Synthetic oligonucleotide
gtccgttgtccccccacactcctgtagtgagcttcga

SEQ ID NO: 206116 - DNA, 36 bp, Artificial Sequence
  Synthetic oligonucleotide
aagctaaacgcttacaagtcactacgtggtcgacaa

SEQ ID NO: 206117 - DNA, 37 bp, Artificial Sequence
  Synthetic oligonucleotide
atgtattgtgaacccgaggacccggagtattctatca

SEQ ID NO: 206118 - DNA, 35 bp, Artificial Sequence
  Synthetic oligonucleotide
ggtctccgtcatggaaccatctaatctgttgaaat

SEQ ID NO: 206119 - DNA, 35 bp, Artificial Sequence
  Synthetic oligonucleotide
gaacagacctctgttatacccagcattgtaaccct

SEQ ID NO: 206120 - DNA, 36 bp, Artificial Sequence
  Synthetic oligonucleotide
tgtcgtcttaaatcgcgtctcaccagccctctcgtc

SEQ ID NO: 206121 - DNA, 28 bp, Artificial Sequence
  Synthetic oligonucleotide
ccctctgctatctgtacagcccacatcc

SEQ ID NO: 206122 - DNA, 35 bp, Artificial Sequence
  Synthetic oligonucleotide
ttatcagcacatccgctagggtctaaatgttgctg

SEQ ID NO: 206123 - DNA, 37 bp, Artificial Sequence
  Synthetic oligonucleotide
ttgactcaacgttaattatgtcacgggggccccgtca

SEQ ID NO: 206124 - DNA, 35 bp, Artificial Sequence
  Synthetic oligonucleotide
atagtgccataccttggtcgatgaataccccagag

SEQ ID NO: 206125 - DNA, 34 bp, Artificial Sequence
  Synthetic oligonucleotide
ttctatgctaggtccctatcgcgatccggttgat

SEQ ID NO: 206126 - DNA, 35 bp, Artificial Sequence
  Synthetic oligonucleotide
tcaccgccatatatccccttttatgagggacatcg

SEQ ID NO: 206127 - DNA, 35 bp, Artificial Sequence
  Synthetic oligonucleotide
gatgccttactgacgcgcctacatatgctacagat

SEQ ID NO: 206128 - DNA, 38 bp, Artificial Sequence
  Synthetic oligonucleotide
cttccgatccctagttcgcagtcacgcttttcatgtca

SEQ ID NO: 206129 - DNA, 35 bp, Artificial Sequence
  Synthetic oligonucleotide
gctccttacgatttcccttagcctccacgttctag

SEQ ID NO: 206130 - DNA, 31 bp, Artificial Sequence
  Synthetic oligonucleotide
tgagggcgccggttacccgtctctgaccgat

SEQ ID NO: 206131 - DNA, 35 bp, Artificial Sequence
  Synthetic oligonucleotide
gccatatacacctcgctttgtgaccaccatcgtct

SEQ ID NO: 206132 - DNA, 35 bp, Artificial Sequence
  Synthetic oligonucleotide
aggagtacagtatcggaacgccctaccgcctcgag

SEQ ID NO: 206133 - DNA, 38 bp, Artificial Sequence
  Synthetic oligonucleotide
gtagtcgccaaaaggttatacattgagccttagattca

SEQ ID NO: 206134 - DNA, 37 bp, Artificial Sequence
  Synthetic oligonucleotide
gtttgcgcccggtttaccatcccctcgtcagggggca

SEQ ID NO: 206135 - DNA, 35 bp, Artificial Sequence
  Synthetic oligonucleotide
tgcctatctgaggtgtgccagtatcaggagcgcat

SEQ ID NO: 206136 - DNA, 36 bp, Artificial Sequence
  Synthetic oligonucleotide
catgttcggccgtgaatggggtctcccctcctacca

SEQ ID NO: 206137 - DNA, 35 bp, Artificial Sequence
  Synthetic oligonucleotide
gctccgtctatccatcgagagagcacatggccaag

SEQ ID NO: 206138 - DNA, 37 bp, Artificial Sequence
  Synthetic oligonucleotide
gggcatgactcaagctggtttccattcttccacacca

SEQ ID NO: 206139 - DNA, 32 bp, Artificial Sequence
  Synthetic oligonucleotide
acgacacccgtttccacctggtgtatccatga

SEQ ID NO: 206140 - DNA, 36 bp, Artificial Sequence
  Synthetic oligonucleotide
ttctaccgccatacaacagattcatcgtagcgcatt

SEQ ID NO: 206141 - DNA, 35 bp, Artificial Sequence
  Synthetic oligonucleotide
gtcccttcaacagtatctaaacttatttgctctta

SEQ ID NO: 206142 - DNA, 35 bp, Artificial Sequence
  Synthetic oligonucleotide
gtctcgagtcgtatagccctcgtctattttagcag

SEQ ID NO: 206143 - DNA, 35 bp, Artificial Sequence
  Synthetic oligonucleotide
tacgtctattcctcttcctacacgtaagggtctca

SEQ ID NO: 206144 - DNA, 35 bp, Artificial Sequence
  Synthetic oligonucleotide
tcatctgctgcctggccgatgtcttttgtgtacat

SEQ ID NO: 206145 - DNA, 37 bp, Artificial Sequence
  Synthetic oligonucleotide
gtctaccgggaccgatagaggtgttttctctggtagt

SEQ ID NO: 206146 - DNA, 35 bp, Artificial Sequence
  Synthetic oligonucleotide
tttcgtggatatactattaactggagccacatttt

SEQ ID NO: 206147 - DNA, 37 bp, Artificial Sequence
  Synthetic oligonucleotide
gcattccatcgccttggaatttacgtgtccatcgaca

SEQ ID NO: 206148 - DNA, 35 bp, Artificial Sequence
  Synthetic oligonucleotide
gctaaaccccggtacatcgtaccgatagtgcctag

SEQ ID NO: 206149 - DNA, 37 bp, Artificial Sequence
  Synthetic oligonucleotide
gtgaaatgcccggtccacgttttcgggtcccccccca

SEQ ID NO: 206150 - DNA, 37 bp, Artificial Sequence
  Synthetic oligonucleotide
gcacacgaatttgttaaaatctcagcaccaattaggt

SEQ ID NO: 206151 - DNA, 35 bp, Artificial Sequence
  Synthetic oligonucleotide
cacccgaccgcgttccgccccttttcagtatcgaa

SEQ ID NO: 206152 - DNA, 35 bp, Artificial Sequence
  Synthetic oligonucleotide
ctaaccgtcttatatcatcacgtcccgcccagtcg

SEQ ID NO: 206153 - DNA, 38 bp, Artificial Sequence
  Synthetic oligonucleotide
aattcgtcactcgttgtgtgtcgccggtgcccaattga

SEQ ID NO: 206154 - DNA, 36 bp, Artificial Sequence
  Synthetic oligonucleotide
ctctgctatccggggatcgtgaatcgttttagcact

SEQ ID NO: 206155 - DNA, 35 bp, Artificial Sequence
  Synthetic oligonucleotide
ccaagggtgttatgctctttttcggatgctgcccg

SEQ ID NO: 206156 - DNA, 36 bp, Artificial Sequence
  Synthetic oligonucleotide
gtcctcaccctacgaaaggtgtctcgggattattat

SEQ ID NO: 206157 - DNA, 38 bp, Artificial Sequence
  Synthetic oligonucleotide
aatctccaggggactctgagcgcatccctgttttgtca

SEQ ID NO: 206158 - DNA, 35 bp, Artificial Sequence
  Synthetic oligonucleotide
gatcgatttactctctcgtattcgggagttctaag

SEQ ID NO: 206159 - DNA, 36 bp, Artificial Sequence
  Synthetic oligonucleotide
ggagctccatagtgtagcctttccgctacgtagctt

SEQ ID NO: 206160 - DNA, 35 bp, Artificial Sequence
  Synthetic oligonucleotide
tccactgcggaccttcttatagtccatagtgtgcg

SEQ ID NO: 206161 - DNA, 35 bp, Artificial Sequence
  Synthetic oligonucleotide
tcatggttccgcacgcgagtggtatgctgctgtat

SEQ ID NO: 206162 - DNA, 37 bp, Artificial Sequence
  Synthetic oligonucleotide
gtgaatggtaacgcacgttcttgaggaccggatccca

SEQ ID NO: 206163 - DNA, 37 bp, Artificial Sequence
  Synthetic oligonucleotide
gccacctctgcacgtcacttgtaacttcctttcatca

SEQ ID NO: 206164 - DNA, 35 bp, Artificial Sequence
  Synthetic oligonucleotide
ttcactaagtacgtgttgacaccctgcatttatca

SEQ ID NO: 206165 - DNA, 35 bp, Artificial Sequence
  Synthetic oligonucleotide
tttcaaaagctcttttggctggaacctccgcctcg

SEQ ID NO: 206166 - DNA, 35 bp, Artificial Sequence
  Synthetic oligonucleotide
cgattagcttgccctaagcattctcattaccgcca

SEQ ID NO: 206167 - DNA, 27 bp, Artificial Sequence
  Synthetic oligonucleotide
tgcatcacctgccccaaatcaaaggcg

SEQ ID NO: 206168 - DNA, 38 bp, Artificial Sequence
  Synthetic oligonucleotide
acacgctgaagcccttcccaacgcgacgttcttcatca

SEQ ID NO: 206169 - DNA, 35 bp, Artificial Sequence
  Synthetic oligonucleotide
acctatacaccatcaggaaagacctaacctcgtta

SEQ ID NO: 206170 - DNA, 36 bp, Artificial Sequence
  Synthetic oligonucleotide
actcggcttccctctttgccacattcctgtactaca

SEQ ID NO: 206171 - DNA, 35 bp, Artificial Sequence
  Synthetic oligonucleotide
gcgatccgtcccatgaggtacctcaatatactgat

SEQ ID NO: 206172 - DNA, 35 bp, Artificial Sequence
  Synthetic oligonucleotide
atcctaaacgctatttgggctcacctcaacggtct

SEQ ID NO: 206173 - DNA, 37 bp, Artificial Sequence
  Synthetic oligonucleotide
tgctattggacgggtccaatccagattcggtaggtga

SEQ ID NO: 206174 - DNA, 36 bp, Artificial Sequence
  Synthetic oligonucleotide
gaccggtccggtgttactactttttctgtcgataca

SEQ ID NO: 206175 - DNA, 35 bp, Artificial Sequence
  Synthetic oligonucleotide
ttcaatgccgaccgtaaacgggttctgaatcacgt

SEQ ID NO: 206176 - DNA, 38 bp, Artificial Sequence
  Synthetic oligonucleotide
gctttccaatgttgggtggcaacaccgccctcttttga

SEQ ID NO: 206177 - DNA, 28 bp, Artificial Sequence
  Synthetic oligonucleotide
atatccgagcaatgttcgctttttcgag

SEQ ID NO: 206178 - DNA, 35 bp, Artificial Sequence
  Synthetic oligonucleotide
tctaaaatcgggttcaatctgtcataatgcgggtg

SEQ ID NO: 206179 - DNA, 35 bp, Artificial Sequence
  Synthetic oligonucleotide
catataccccaagctgtatgcagatgtcgcttcat

SEQ ID NO: 206180 - DNA, 36 bp, Artificial Sequence
  Synthetic oligonucleotide
ggagccccgtcatacggaggggccacatccgattct

SEQ ID NO: 206181 - DNA, 38 bp, Artificial Sequence
  Synthetic oligonucleotide
gtccgtctgcatgctcaaacgggactattaatctatga

SEQ ID NO: 206182 - DNA, 35 bp, Artificial Sequence
  Synthetic oligonucleotide
gtctgtccccctctgttcaagtcacgtttgcttct

SEQ ID NO: 206183 - DNA, 35 bp, Artificial Sequence
  Synthetic oligonucleotide
tcattggcgcagtactctagccccttttcttcatt

SEQ ID NO: 206184 - DNA, 35 bp, Artificial Sequence
  Synthetic oligonucleotide
gctccccactcaatatcggtattacaagcacgacg

SEQ ID NO: 206185 - DNA, 38 bp, Artificial Sequence
  Synthetic oligonucleotide
tctgcacatggccgtccgagaaggacccccaatgatca

SEQ ID NO: 206186 - DNA, 36 bp, Artificial Sequence
  Synthetic oligonucleotide
ggctacacagcctggggtctcgcttcctgcctctga

SEQ ID NO: 206187 - DNA, 35 bp, Artificial Sequence
  Synthetic oligonucleotide
tctgcggacttcctgcccgaacagtcatacacgct

SEQ ID NO: 206188 - DNA, 37 bp, Artificial Sequence
  Synthetic oligonucleotide
gtaggaaattggcccccatctcctcaacttacatcgt

SEQ ID NO: 206189 - DNA, 38 bp, Artificial Sequence
  Synthetic oligonucleotide
gcttgatcgtcgcaaaagttcgtcccgccaaccttgcc

SEQ ID NO: 206190 - DNA, 35 bp, Artificial Sequence
  Synthetic oligonucleotide
cccgctaaacattacccggatcgtcaggtccccca

SEQ ID NO: 206191 - DNA, 35 bp, Artificial Sequence
  Synthetic oligonucleotide
accaccacgctgatagttgtacagtctggccgggt

SEQ ID NO: 206192 - DNA, 36 bp, Artificial Sequence
  Synthetic oligonucleotide
gcggcatttcaactcgtcccaaacacgaacgatcaa

SEQ ID NO: 206193 - DNA, 37 bp, Artificial Sequence
  Synthetic oligonucleotide
gccgacacgatagtgctgtatttcgctcttcgcccca

SEQ ID NO: 206194 - DNA, 29 bp, Artificial Sequence
  Synthetic oligonucleotide
ccccaacgcctttgccgataggcgagact

SEQ ID NO: 206195 - DNA, 35 bp, Artificial Sequence
  Synthetic oligonucleotide
taccgtgtggtggtgatactttatgcggtttacaa

SEQ ID NO: 206196 - DNA, 37 bp, Artificial Sequence
  Synthetic oligonucleotide
tttggactggactacatggtattcgccttattgaagt

SEQ ID NO: 206197 - DNA, 36 bp, Artificial Sequence
  Synthetic oligonucleotide
ctatgctggcttacgtgtacgcccctacctcgacat

SEQ ID NO: 206198 - DNA, 35 bp, Artificial Sequence
  Synthetic oligonucleotide
ccatacctctttgagtctcctgaatactgatagtc

SEQ ID NO: 206199 - DNA, 36 bp, Artificial Sequence
  Synthetic oligonucleotide
gagtctgccccgtggaagggtaatgacctgcgccca

SEQ ID NO: 206200 - DNA, 36 bp, Artificial Sequence
  Synthetic oligonucleotide
ccccgcaccagcactatatgtgcatggtcacagtca

SEQ ID NO: 206201 - DNA, 35 bp, Artificial Sequence
  Synthetic oligonucleotide
gcggtgaaattgctctttgtatttcgcttaaggcg

SEQ ID NO: 206202 - DNA, 35 bp, Artificial Sequence
  Synthetic oligonucleotide
cctagttggcggacaggccagtccagaagcattct

SEQ ID NO: 206203 - DNA, 35 bp, Artificial Sequence
  Synthetic oligonucleotide
agcctaggcgctcaaccatcatccgttatggctta

SEQ ID NO: 206204 - DNA, 37 bp, Artificial Sequence
  Synthetic oligonucleotide
gccgactacgcgcctcgataaccggttttactcccgt

SEQ ID NO: 206205 - DNA, 36 bp, Artificial Sequence
  Synthetic oligonucleotide
acaaatgtcacctttgtatgcgctattagcctcact

SEQ ID NO: 206206 - DNA, 35 bp, Artificial Sequence
  Synthetic oligonucleotide
cgccgtacagtaagtcagccggatgcttgctaaac

SEQ ID NO: 206207 - DNA, 36 bp, Artificial Sequence
  Synthetic oligonucleotide
tggttttatagcaatccacacgtgacgcgtcaaccc

SEQ ID NO: 206208 - DNA, 35 bp, Artificial Sequence
  Synthetic oligonucleotide
tagggagtgccgcattttgctcggccgatttctct

SEQ ID NO: 206209 - DNA, 36 bp, Artificial Sequence
  Synthetic oligonucleotide
gggcctgaaaggggccgctgtgttcactcggttaaa

SEQ ID NO: 206210 - DNA, 35 bp, Artificial Sequence
  Synthetic oligonucleotide
ctgcatcatggaagtaaagagaaatctgatggctg

SEQ ID NO: 206211 - DNA, 38 bp, Artificial Sequence
  Synthetic oligonucleotide
tggagcacatgacctttagcggtccttttactctctgt

SEQ ID NO: 206212 - DNA, 37 bp, Artificial Sequence
  Synthetic oligonucleotide
tactgaactttcatgtcctctcgccggtcaaatatca

SEQ ID NO: 206213 - DNA, 38 bp, Artificial Sequence
  Synthetic oligonucleotide
gttataacgcggacggaattctgggaaattgtccctca

SEQ ID NO: 206214 - DNA, 35 bp, Artificial Sequence
  Synthetic oligonucleotide
tatgcagttggccgcatatctatgcactataacct

SEQ ID NO: 206215 - DNA, 35 bp, Artificial Sequence
  Synthetic oligonucleotide
tgcgaccagtgctaaatttcaatctcacgacacgg

SEQ ID NO: 206216 - DNA, 35 bp, Artificial Sequence
  Synthetic oligonucleotide
ctcactctgagcgcttagacgcttgtgtgaacgcg

SEQ ID NO: 206217 - DNA, 36 bp, Artificial Sequence
  Synthetic oligonucleotide
tgttaggccaacatagggtcaaaccttagaagctca

SEQ ID NO: 206218 - DNA, 35 bp, Artificial Sequence
  Synthetic oligonucleotide
agccaattctaccggcataaagaccgaatttagaa

SEQ ID NO: 206219 - DNA, 35 bp, Artificial Sequence
  Synthetic oligonucleotide
ctcacccgtagccgactcgactactgatggattac

SEQ ID NO: 206220 - DNA, 38 bp, Artificial Sequence
  Synthetic oligonucleotide
gtaccaaacgtaatcctctatactgatattctctctgt

SEQ ID NO: 206221 - DNA, 35 bp, Artificial Sequence
  Synthetic oligonucleotide
ctacatcatcgcatctccggacatcggtgcctttg

SEQ ID NO: 206222 - DNA, 35 bp, Artificial Sequence
  Synthetic oligonucleotide
gaacatgataggtcatctcgtatttctcgcgtgca

SEQ ID NO: 206223 - DNA, 35 bp, Artificial Sequence
  Synthetic oligonucleotide
cccggcgagccacgggctgtacgagcaagtcgcac

SEQ ID NO: 206224 - DNA, 35 bp, Artificial Sequence
  Synthetic oligonucleotide
gtggctgattcttgtaacaccggattcggctcctc

SEQ ID NO: 206225 - DNA, 35 bp, Artificial Sequence
  Synthetic oligonucleotide
aatcattacatctaacccctcggatatgttcgtaa

SEQ ID NO: 206226 - DNA, 36 bp, Artificial Sequence
  Synthetic oligonucleotide
tatagcatgggttgccccttcccctgttacatcgca

SEQ ID NO: 206227 - DNA, 35 bp, Artificial Sequence
  Synthetic oligonucleotide
atgtaaacagactgccccttacgtactccgtagca

SEQ ID NO: 206228 - DNA, 37 bp, Artificial Sequence
  Synthetic oligonucleotide
catgaacgcgagtgtgctggcgtagatccttctcagt

SEQ ID NO: 206229 - DNA, 35 bp, Artificial Sequence
  Synthetic oligonucleotide
cgctctccactgtttaaggccaacttgcactgccc

SEQ ID NO: 206230 - DNA, 36 bp, Artificial Sequence
  Synthetic oligonucleotide
gatctcctgttctcttcaccgcagtttcacgttcca

SEQ ID NO: 206231 - DNA, 35 bp, Artificial Sequence
  Synthetic oligonucleotide
ttaggatatcccatctattccagcggtttatggca

SEQ ID NO: 206232 - DNA, 35 bp, Artificial Sequence
  Synthetic oligonucleotide
ccctgcatgctcaacaggtacatatccgcccttcg

SEQ ID NO: 206233 - DNA, 35 bp, Artificial Sequence
  Synthetic oligonucleotide
gctgagtcgatttatgtcgaatctggtcgctttag

SEQ ID NO: 206234 - DNA, 35 bp, Artificial Sequence
  Synthetic oligonucleotide
acacgcttttgatccacattataaggcacgaaggt

SEQ ID NO: 206235 - DNA, 36 bp, Artificial Sequence
  Synthetic oligonucleotide
acgacttactagtagcacattcacggacagccccgt

SEQ ID NO: 206236 - DNA, 38 bp, Artificial Sequence
  Synthetic oligonucleotide
gtctggactccgaactctcagggggtatttacgtatca

SEQ ID NO: 206237 - DNA, 37 bp, Artificial Sequence
  Synthetic oligonucleotide
tgcaatatcccacggtgacggaatgcgaacttctgca

SEQ ID NO: 206238 - DNA, 35 bp, Artificial Sequence
  Synthetic oligonucleotide
aactaacgatacttgtgtttgcattgacagcctcg

SEQ ID NO: 206239 - DNA, 35 bp, Artificial Sequence
  Synthetic oligonucleotide
ttccgatcgtcctctttcctggagctctatcacct

SEQ ID NO: 206240 - DNA, 36 bp, Artificial Sequence
  Synthetic oligonucleotide
ggtctacaccaacaacaccgtgtgtttccactctat

SEQ ID NO: 206241 - DNA, 35 bp, Artificial Sequence
  Synthetic oligonucleotide
gcttacgaggtctgtgatattccaaggcgtaggcc

SEQ ID NO: 206242 - DNA, 35 bp, Artificial Sequence
  Synthetic oligonucleotide
tctgtcacggctcccaagcattgcctggacattcc

SEQ ID NO: 206243 - DNA, 35 bp, Artificial Sequence
  Synthetic oligonucleotide
gaggttccaacgctcttactatacccttagcgttc

SEQ ID NO: 206244 - DNA, 36 bp, Artificial Sequence
  Synthetic oligonucleotide
aactcgccgttgtatttcgaaggccccgctccttaa

SEQ ID NO: 206245 - DNA, 35 bp, Artificial Sequence
  Synthetic oligonucleotide
gggggttttataaatgatcggcaaaattttttcat

SEQ ID NO: 206246 - DNA, 36 bp, Artificial Sequence
  Synthetic oligonucleotide
ttgttgcctctaagtatctgctcacgtagtgcgaat

SEQ ID NO: 206247 - DNA, 35 bp, Artificial Sequence
  Synthetic oligonucleotide
gctatggctataccggaagtaccatggtgttctag

SEQ ID NO: 206248 - DNA, 35 bp, Artificial Sequence
  Synthetic oligonucleotide
ggccgactctgtaggtgacccattgttgaccttcc

SEQ ID NO: 206249 - DNA, 36 bp, Artificial Sequence
  Synthetic oligonucleotide
tttcgacggagacttcccggtactacacgttgacca

SEQ ID NO: 206250 - DNA, 35 bp, Artificial Sequence
  Synthetic oligonucleotide
accgctgccccgttacctccaagtgatacccgcat

SEQ ID NO: 206251 - DNA, 37 bp, Artificial Sequence
  Synthetic oligonucleotide
tggtacccttggggtccagaagccgatccctcatgca

SEQ ID NO: 206252 - DNA, 38 bp, Artificial Sequence
  Synthetic oligonucleotide
tttcgtcctctggctctagggtgcctctgaggtactca

SEQ ID NO: 206253 - DNA, 35 bp, Artificial Sequence
  Synthetic oligonucleotide
atcattgtcggttcgatcccttgcggaggtgatct

SEQ ID NO: 206254 - DNA, 35 bp, Artificial Sequence
  Synthetic oligonucleotide
ccgtgcgatattttcgatcccgggctcagcctgac

SEQ ID NO: 206255 - DNA, 35 bp, Artificial Sequence
  Synthetic oligonucleotide
ttcatacatcgggaagacgtgtcacacgtgggcgt

SEQ ID NO: 206256 - DNA, 36 bp, Artificial Sequence
  Synthetic oligonucleotide
attcactacgtgcgtatcaaggtgcgccccgatcca

SEQ ID NO: 206257 - DNA, 35 bp, Artificial Sequence
  Synthetic oligonucleotide
gttcgtgccggcgaaatcgccgtgggtcgacctcc

SEQ ID NO: 206258 - DNA, 35 bp, Artificial Sequence
  Synthetic oligonucleotide
aacgcttttccataccccgatatccataccgacag

SEQ ID NO: 206259 - DNA, 35 bp, Artificial Sequence
  Synthetic oligonucleotide
agtagtcgtacccctagcgtcccttcacccctcct

SEQ ID NO: 206260 - DNA, 35 bp, Artificial Sequence
  Synthetic oligonucleotide
ccgctctgccatgctgctcccactgcaccttagta

SEQ ID NO: 206261 - DNA, 35 bp, Artificial Sequence
  Synthetic oligonucleotide
aactacaacgtaattagcaaggggtccactgaggt

SEQ ID NO: 206262 - DNA, 36 bp, Artificial Sequence
  Synthetic oligonucleotide
gcatgcttcagcccactcgacccgtgtttgttttag

SEQ ID NO: 206263 - DNA, 37 bp, Artificial Sequence
  Synthetic oligonucleotide
cccttatagaggttgatcatccacgtggatccgtagt

SEQ ID NO: 206264 - DNA, 36 bp, Artificial Sequence
  Synthetic oligonucleotide
gcttcggtatgcccctttgcatgtgggataataaaa

SEQ ID NO: 206265 - DNA, 35 bp, Artificial Sequence
  Synthetic oligonucleotide
cccgccgagccacgggctgtacgagcaagtcacac

SEQ ID NO: 206266 - DNA, 35 bp, Artificial Sequence
  Synthetic oligonucleotide
agtcgtgcctcaccctcccataaggccacctcacc

SEQ ID NO: 206267 - DNA, 35 bp, Artificial Sequence
  Synthetic oligonucleotide
cgaggaagcattagacgattttgtcctgtattccc

SEQ ID NO: 206268 - DNA, 35 bp, Artificial Sequence
  Synthetic oligonucleotide
gtgctgcactatgctgtgtattaaggcttcctctg

SEQ ID NO: 206269 - DNA, 35 bp, Artificial Sequence
  Synthetic oligonucleotide
ttgtcttcgcatcctctgtcaaattacctatgtct

SEQ ID NO: 206270 - DNA, 37 bp, Artificial Sequence
  Synthetic oligonucleotide
tatgcgtgtcccagccctacggtaattccaattcagt

SEQ ID NO: 206271 - DNA, 35 bp, Artificial Sequence
  Synthetic oligonucleotide
tatgcaatcattcttttccgcttcacgcaatcttg

SEQ ID NO: 206272 - DNA, 38 bp, Artificial Sequence
  Synthetic oligonucleotide
gttcgctccacgcacagacttactatcacctgctctca

SEQ ID NO: 206273 - DNA, 37 bp, Artificial Sequence
  Synthetic oligonucleotide
atgcacccatccagatcagtaccggtgaatcagacca

SEQ ID NO: 206274 - DNA, 35 bp, Artificial Sequence
  Synthetic oligonucleotide
gctagtcacttacagtgacgttactgtcttgagca

SEQ ID NO: 206275 - DNA, 35 bp, Artificial Sequence
  Synthetic oligonucleotide
agttctcactatagtcacggggccggacaaacccc

SEQ ID NO: 206276 - DNA, 35 bp, Artificial Sequence
  Synthetic oligonucleotide
tcacaggatgttatactgtcaaactcgctctattt

SEQ ID NO: 206277 - DNA, 35 bp, Artificial Sequence
  Synthetic oligonucleotide
gcacggttctatccacttcccacacttctcgcgtg

SEQ ID NO: 206278 - DNA, 33 bp, Artificial Sequence
  Synthetic oligonucleotide
cttgcagccgttttgactaatcaccgtaccgcc

SEQ ID NO: 206279 - DNA, 36 bp, Artificial Sequence
  Synthetic oligonucleotide
actttagacatcgacaggcggagattttttatttca

SEQ ID NO: 206280 - DNA, 36 bp, Artificial Sequence
  Synthetic oligonucleotide
gacgacgagcaccagagctcttctgttgcgaaaaat

SEQ ID NO: 206281 - DNA, 35 bp, Artificial Sequence
  Synthetic oligonucleotide
cgtgcgctgcgctctacatttgagtttctttcgag

SEQ ID NO: 206282 - DNA, 37 bp, Artificial Sequence
  Synthetic oligonucleotide
tctgtttagcggggcgtgtcggtcatcaacgctccca

SEQ ID NO: 206283 - DNA, 38 bp, Artificial Sequence
  Synthetic oligonucleotide
tgtttacgacttacgtggtgtctggttgtttatcctgt

SEQ ID NO: 206284 - DNA, 36 bp, Artificial Sequence
  Synthetic oligonucleotide
gccctatcgattcccagttgattgacgaaccataca

SEQ ID NO: 206285 - DNA, 37 bp, Artificial Sequence
  Synthetic oligonucleotide
taggacttatgaatacctgatctgattcccagggcca

SEQ ID NO: 206286 - DNA, 35 bp, Artificial Sequence
  Synthetic oligonucleotide
ttgggcatctcattaatgaccactaaggagttgag

SEQ ID NO: 206287 - DNA, 36 bp, Artificial Sequence
  Synthetic oligonucleotide
gtgttcttagtgcccaagctaaaacgtccatggtca

SEQ ID NO: 206288 - DNA, 38 bp, Artificial Sequence
  Synthetic oligonucleotide
tcttaagctgtcaaagcacggacatttgcgctttctca

SEQ ID NO: 206289 - DNA, 35 bp, Artificial Sequence
  Synthetic oligonucleotide
tccaaggctagtgattccctctagagtggtaccgt

SEQ ID NO: 206290 - DNA, 35 bp, Artificial Sequence
  Synthetic oligonucleotide
agtgggtggaagcgtaattagtgctgataagactc

SEQ ID NO: 206291 - DNA, 35 bp, Artificial Sequence
  Synthetic oligonucleotide
gtcaccgtgggcgacatgctaaattcttctctcca

SEQ ID NO: 206292 - DNA, 36 bp, Artificial Sequence
  Synthetic oligonucleotide
ttgaccgtaagtcccgcccatttagcatcatggcca

SEQ ID NO: 206293 - DNA, 35 bp, Artificial Sequence
  Synthetic oligonucleotide
aatactggatcccgcgtccctgagaatgcgaatag

SEQ ID NO: 206294 - DNA, 35 bp, Artificial Sequence
  Synthetic oligonucleotide
tactttcccgtcgtgcaccgacccttattcctcgt

SEQ ID NO: 206295 - DNA, 35 bp, Artificial Sequence
  Synthetic oligonucleotide
tccacccttcttgccgtcccatatcgctgactgct

SEQ ID NO: 206296 - DNA, 35 bp, Artificial Sequence
  Synthetic oligonucleotide
ccgccccgcacagataacaagctctgtggatacag

SEQ ID NO: 206297 - DNA, 35 bp, Artificial Sequence
  Synthetic oligonucleotide
gatctccgtgtgttttttgctatgctgttagcaaa

SEQ ID NO: 206298 - DNA, 36 bp, Artificial Sequence
  Synthetic oligonucleotide
acttacactgggatgtcgtgacgtctcacctcacct

SEQ ID NO: 206299 - DNA, 37 bp, Artificial Sequence
  Synthetic oligonucleotide
tctgggcgtagatgactacgaccggctccatctttgt

SEQ ID NO: 206300 - DNA, 35 bp, Artificial Sequence
  Synthetic oligonucleotide
ctctttagtgccattatgttcagccacaactatac

SEQ ID NO: 206301 - DNA, 37 bp, Artificial Sequence
  Synthetic oligonucleotide
gtccacacgctcatctacccgccctcccgggttagga

SEQ ID NO: 206302 - DNA, 34 bp, Artificial Sequence
  Synthetic oligonucleotide
gttccccatgtaagcgttgaagctcaaacatagt

SEQ ID NO: 206303 - DNA, 34 bp, Artificial Sequence
  Synthetic oligonucleotide
atacaaacgttgacaatgatgtccccggccccaa

SEQ ID NO: 206304 - DNA, 35 bp, Artificial Sequence
  Synthetic oligonucleotide
accctcgttatcctcagagagtgcgtggacagggt

SEQ ID NO: 206305 - DNA, 38 bp, Artificial Sequence
  Synthetic oligonucleotide
aaaaatagcaacgacagtgctcaggcgtgaccgggtca

SEQ ID NO: 206306 - DNA, 35 bp, Artificial Sequence
  Synthetic oligonucleotide
cgtctagtgccctttcccatcggagagatcctgtg

SEQ ID NO: 206307 - DNA, 38 bp, Artificial Sequence
  Synthetic oligonucleotide
ttcgctgctgggtcgtaaacgtagcttttacgcattca

SEQ ID NO: 206308 - DNA, 36 bp, Artificial Sequence
  Synthetic oligonucleotide
cgatcccatcagtaggatcacgaggcgcttgtattg

SEQ ID NO: 206309 - DNA, 35 bp, Artificial Sequence
  Synthetic oligonucleotide
accgggtttccgtcccaatgccgtgcatccgcaag

SEQ ID NO: 206310 - DNA, 35 bp, Artificial Sequence
  Synthetic oligonucleotide
ggctcccccacatttcgcgatggacaagcaattcc

SEQ ID NO: 206311 - DNA, 38 bp, Artificial Sequence
  Synthetic oligonucleotide
tttacctgcctgaatgcgtcctcattcgctcctcctgg

SEQ ID NO: 206312 - DNA, 37 bp, Artificial Sequence
  Synthetic oligonucleotide
agtcacgtgcggtctggcttacatgctctaatgtaaa

SEQ ID NO: 206313 - DNA, 36 bp, Artificial Sequence
  Synthetic oligonucleotide
tcgctacaggcgaccatgagcctggtagccgaaaat

SEQ ID NO: 206314 - DNA, 38 bp, Artificial Sequence
  Synthetic oligonucleotide
gccgattgagatacttccaccgacctaggtttagctgt

SEQ ID NO: 206315 - DNA, 35 bp, Artificial Sequence
  Synthetic oligonucleotide
ctgtgctaccgtatcgtaagtacgcgtcgcattac

SEQ ID NO: 206316 - DNA, 37 bp, Artificial Sequence
  Synthetic oligonucleotide
ggcgcccttcacgtgcacagattacggccctctatga

SEQ ID NO: 206317 - DNA, 35 bp, Artificial Sequence
  Synthetic oligonucleotide
cgccatgccctcatcctcgtagggaacacgattcc

SEQ ID NO: 206318 - DNA, 36 bp, Artificial Sequence
  Synthetic oligonucleotide
tgatttcacacgggtcgagcatgaagcgagaaagaa

SEQ ID NO: 206319 - DNA, 35 bp, Artificial Sequence
  Synthetic oligonucleotide
cctgacctagcgtctcttcatagtcggtttgtctt

SEQ ID NO: 206320 - DNA, 35 bp, Artificial Sequence
  Synthetic oligonucleotide
atgtaggatgcatcgcatatactttatatggtcgt

SEQ ID NO: 206321 - DNA, 33 bp, Artificial Sequence
  Synthetic oligonucleotide
ccgcccttacctaatgatgaccctatgttcctg

SEQ ID NO: 206322 - DNA, 36 bp, Artificial Sequence
  Synthetic oligonucleotide
aattcccatcgatgacctgatttgccacgccaacca

SEQ ID NO: 206323 - DNA, 35 bp, Artificial Sequence
  Synthetic oligonucleotide
tgacttccattcctccccgttgacgattgtgtcat

SEQ ID NO: 206324 - DNA, 35 bp, Artificial Sequence
  Synthetic oligonucleotide
gctctccgtgatcatccacctccaaagctctcaca

SEQ ID NO: 206325 - DNA, 36 bp, Artificial Sequence
  Synthetic oligonucleotide
tgtccaaaccagctggaagaggattccacgctgtca

SEQ ID NO: 206326 - DNA, 35 bp, Artificial Sequence
  Synthetic oligonucleotide
cgctctctagtagacgaccgtctaccattaccctg

SEQ ID NO: 206327 - DNA, 35 bp, Artificial Sequence
  Synthetic oligonucleotide
gcattccaatgcattacctagaattgccgtgatgc

SEQ ID NO: 206328 - DNA, 36 bp, Artificial Sequence
  Synthetic oligonucleotide
atactgcatcacgatctatttgtatttggtctgcca

SEQ ID NO: 206329 - DNA, 35 bp, Artificial Sequence
  Synthetic oligonucleotide
tttgcaccatactatccgtgtatagctagtatccc

SEQ ID NO: 206330 - DNA, 36 bp, Artificial Sequence
  Synthetic oligonucleotide
ttcgactcaacttagctcaccggtcactccggtcca

SEQ ID NO: 206331 - DNA, 36 bp, Artificial Sequence
  Synthetic oligonucleotide
aaggcttggtccaccgaagacgatttgacctcagaa

SEQ ID NO: 206332 - DNA, 35 bp, Artificial Sequence
  Synthetic oligonucleotide
cactcacaactaaagtcagtttgtcccgcctccca

SEQ ID NO: 206333 - DNA, 37 bp, Artificial Sequence
  Synthetic oligonucleotide
actcacgtcatacctgttgaccgcgcatccaccctca

SEQ ID NO: 206334 - DNA, 36 bp, Artificial Sequence
  Synthetic oligonucleotide
tagcccgtcgccccttggttcattgacattatctct

SEQ ID NO: 206335 - DNA, 35 bp, Artificial Sequence
  Synthetic oligonucleotide
tgcgaccgcgtccgcgtaagttcggacctgtttcc

SEQ ID NO: 206336 - DNA, 38 bp, Artificial Sequence
  Synthetic oligonucleotide
tcaaccgactcattcgtccgcacgccccttacatttca

SEQ ID NO: 206337 - DNA, 36 bp, Artificial Sequence
  Synthetic oligonucleotide
ccgtcagtccttctgcacctaaggaccggtccgcag

SEQ ID NO: 206338 - DNA, 35 bp, Artificial Sequence
  Synthetic oligonucleotide
gcgcccttatgcccgagtgactatagcacgcttat

SEQ ID NO: 206339 - DNA, 35 bp, Artificial Sequence
  Synthetic oligonucleotide
gacggcactatttccgaaccatgtacgttcaagca

SEQ ID NO: 206340 - DNA, 36 bp, Artificial Sequence
  Synthetic oligonucleotide
agcctgcccaggcctcccgtgctttcgtcaaacctg

SEQ ID NO: 206341 - DNA, 38 bp, Artificial Sequence
  Synthetic oligonucleotide
atgggactgtaagtcttggcttcgttttacattcgtca

SEQ ID NO: 206342 - DNA, 35 bp, Artificial Sequence
  Synthetic oligonucleotide
gtggctgattcttgtaacaccggattcggctccgt

SEQ ID NO: 206343 - DNA, 36 bp, Artificial Sequence
  Synthetic oligonucleotide
gtccatgctcgtcactctttacatcgttcgatcatg

SEQ ID NO: 206344 - DNA, 35 bp, Artificial Sequence
  Synthetic oligonucleotide
ggccgacatcgttgattggcggtccgcattttaca

SEQ ID NO: 206345 - DNA, 36 bp, Artificial Sequence
  Synthetic oligonucleotide
tccggctctaagctccgccttccctgtatactcgat

SEQ ID NO: 206346 - DNA, 36 bp, Artificial Sequence
  Synthetic oligonucleotide
gatgcaatccaatcctgatcttctctgtgatagctt

SEQ ID NO: 206347 - DNA, 35 bp, Artificial Sequence
  Synthetic oligonucleotide
gggcgagcaatcttagtactttcctgcatgttgca

SEQ ID NO: 206348 - DNA, 37 bp, Artificial Sequence
  Synthetic oligonucleotide
ggcttactgtactggacagcacgaaccggaccttaga

SEQ ID NO: 206349 - DNA, 35 bp, Artificial Sequence
  Synthetic oligonucleotide
ccgggcaaatctcgtcccatttactacatatctag

SEQ ID NO: 206350 - DNA, 35 bp, Artificial Sequence
  Synthetic oligonucleotide
gccgtcctcatgaaatggtctcaggggattcaaca

SEQ ID NO: 206351 - DNA, 35 bp, Artificial Sequence
  Synthetic oligonucleotide
tgatatacgcgatgtaaggttttccggattaacaa

SEQ ID NO: 206352 - DNA, 37 bp, Artificial Sequence
  Synthetic oligonucleotide
caagaagagtcctccacgttatttacccgcccaccgt

SEQ ID NO: 206353 - DNA, 38 bp, Artificial Sequence
  Synthetic oligonucleotide
tgagtaaacggtctgagtgctacgataaccggggttca

SEQ ID NO: 206354 - DNA, 35 bp, Artificial Sequence
  Synthetic oligonucleotide
ccctcctcctcggtcattcacgctcctaccgtcta

SEQ ID NO: 206355 - DNA, 37 bp, Artificial Sequence
  Synthetic oligonucleotide
cgtgctgtggcgcatattcttgatcttgtgccaaggt

SEQ ID NO: 206356 - DNA, 35 bp, Artificial Sequence
  Synthetic oligonucleotide
tgacctctgtcagttagaattgcatgtaccaagcg

SEQ ID NO: 206357 - DNA, 35 bp, Artificial Sequence
  Synthetic oligonucleotide
aattagctcgcgaacatccttattggaggttgtct

SEQ ID NO: 206358 - DNA, 37 bp, Artificial Sequence
  Synthetic oligonucleotide
taccctctaaaccgtggacgggaaggtatgtacctgt

SEQ ID NO: 206359 - DNA, 36 bp, Artificial Sequence
  Synthetic oligonucleotide
aacattcccgctgacgtatatcgaccgtggataact

SEQ ID NO: 206360 - DNA, 38 bp, Artificial Sequence
  Synthetic oligonucleotide
cgttcatgctcagaggtcattcattgcaagggagttga

SEQ ID NO: 206361 - DNA, 35 bp, Artificial Sequence
  Synthetic oligonucleotide
aatggttgtcacgtttttattgttccttatttcgt

SEQ ID NO: 206362 - DNA, 35 bp, Artificial Sequence
  Synthetic oligonucleotide
acgctgccgtaaggcgtatccttggcctcttccat

SEQ ID NO: 206363 - DNA, 34 bp, Artificial Sequence
  Synthetic oligonucleotide
tacgtaaatggaacacctccttttattgcatggc

SEQ ID NO: 206364 - DNA, 37 bp, Artificial Sequence
  Synthetic oligonucleotide
atacctgcccaactgcatcaactgtgttcccaagtca

SEQ ID NO: 206365 - DNA, 35 bp, Artificial Sequence
  Synthetic oligonucleotide
gcggtgcagatacggaacgctatttgcatacacaa

SEQ ID NO: 206366 - DNA, 36 bp, Artificial Sequence
  Synthetic oligonucleotide
ttgcttgcccggccataaccacgatcttgttctcta

SEQ ID NO: 206367 - DNA, 38 bp, Artificial Sequence
  Synthetic oligonucleotide
tcgtccatattagcccgccgatggtagttcaccagtgt

SEQ ID NO: 206368 - DNA, 35 bp, Artificial Sequence
  Synthetic oligonucleotide
ccaattgaccggatggtcatctggctccgctctag

SEQ ID NO: 206369 - DNA, 38 bp, Artificial Sequence
  Synthetic oligonucleotide
ttatgccccgtgcgcggaaatctccatcgaatggttgt

SEQ ID NO: 206370 - DNA, 35 bp, Artificial Sequence
  Synthetic oligonucleotide
tttacctgggcaatcaacaaatggggggctatgtt

SEQ ID NO: 206371 - DNA, 36 bp, Artificial Sequence
  Synthetic oligonucleotide
ctagacgtagtccctcgggtccgaggtcacctgtca

SEQ ID NO: 206372 - DNA, 38 bp, Artificial Sequence
  Synthetic oligonucleotide
tccaacgggcgggtagtatcgattccgcttgttcttca

SEQ ID NO: 206373 - DNA, 35 bp, Artificial Sequence
  Synthetic oligonucleotide
cttggcctttatagactgaaatacgacaatttgat

SEQ ID NO: 206374 - DNA, 37 bp, Artificial Sequence
  Synthetic oligonucleotide
gcatttgggagctcccttctaaacagttctctttcgt

SEQ ID NO: 206375 - DNA, 35 bp, Artificial Sequence
  Synthetic oligonucleotide
gaacgcatgatagagggcgtcagccgctctcccgg

SEQ ID NO: 206376 - DNA, 36 bp, Artificial Sequence
  Synthetic oligonucleotide
ctgagtccacatcgagtgacaccatagatattacca

SEQ ID NO: 206377 - DNA, 36 bp, Artificial Sequence
  Synthetic oligonucleotide
tacagtaggagttaataccccggttcacgttgagaa

SEQ ID NO: 206378 - DNA, 36 bp, Artificial Sequence
  Synthetic oligonucleotide
ataattagccacgggaattgcacacagccacctcaa

SEQ ID NO: 206379 - DNA, 38 bp, Artificial Sequence
  Synthetic oligonucleotide
gcgtaaccgaccgtgaactaggcacaccttaatcttgg

SEQ ID NO: 206380 - DNA, 36 bp, Artificial Sequence
  Synthetic oligonucleotide
acctgtgtccgatgaacttaacttttaatcacccca

SEQ ID NO: 206381 - DNA, 35 bp, Artificial Sequence
  Synthetic oligonucleotide
ccatcgtcgctggtagcgactttaccccttggcct

SEQ ID NO: 206382 - DNA, 37 bp, Artificial Sequence
  Synthetic oligonucleotide
tgggggctaacacgcggctcctttagcgcctcaagca

SEQ ID NO: 206383 - DNA, 35 bp, Artificial Sequence
  Synthetic oligonucleotide
tcaacgagagatcagataccttgttcatgtacctg

SEQ ID NO: 206384 - DNA, 35 bp, Artificial Sequence
  Synthetic oligonucleotide
tgttttgaatgcctgagtttaggaagttcttaaca

SEQ ID NO: 206385 - DNA, 31 bp, Artificial Sequence
  Synthetic oligonucleotide
tgagggctccggttacccgtctctgaccgac

SEQ ID NO: 206386 - DNA, 35 bp, Artificial Sequence
  Synthetic oligonucleotide
ccttgccctgcaagtctcttactggtgattgcaag

SEQ ID NO: 206387 - DNA, 36 bp, Artificial Sequence
  Synthetic oligonucleotide
tactgattaccgtggtttgttcccgtgtgtccgtgg

SEQ ID NO: 206388 - DNA, 35 bp, Artificial Sequence
  Synthetic oligonucleotide
tttttcctactacgcgatacgcaaccgcgctatca

SEQ ID NO: 206389 - DNA, 35 bp, Artificial Sequence
  Synthetic oligonucleotide
attacctatagcacagattaccgggaggtttgcag

SEQ ID NO: 206390 - DNA, 36 bp, Artificial Sequence
  Synthetic oligonucleotide
ggtcgcgccacgtggtcctcgcttgtcgcaacctgt

SEQ ID NO: 206391 - DNA, 36 bp, Artificial Sequence
  Synthetic oligonucleotide
aggaattccggctatgacatttattagaccgctccc

SEQ ID NO: 206392 - DNA, 36 bp, Artificial Sequence
  Synthetic oligonucleotide
gtgccctggctgatcctttcgcttaaagacagatga

SEQ ID NO: 206393 - DNA, 34 bp, Artificial Sequence
  Synthetic oligonucleotide
gtgctttgaccccgcgcccactactgtttcttca

SEQ ID NO: 206394 - DNA, 35 bp, Artificial Sequence
  Synthetic oligonucleotide
tagtgtggtcagacccctgctcttttctttcatcc

SEQ ID NO: 206395 - DNA, 35 bp, Artificial Sequence
  Synthetic oligonucleotide
ccgggatcgcctcttaataatcgcgccgcaattcc

SEQ ID NO: 206396 - DNA, 37 bp, Artificial Sequence
  Synthetic oligonucleotide
cgcactacagcagaattgtcacgctcaaatctataca

SEQ ID NO: 206397 - DNA, 36 bp, Artificial Sequence
  Synthetic oligonucleotide
gatgcttacggtgtctagtatcggctccccccagtg

SEQ ID NO: 206398 - DNA, 36 bp, Artificial Sequence
  Synthetic oligonucleotide
tgcgcaccatcgagttacgctctgggacagttggca

SEQ ID NO: 206399 - DNA, 36 bp, Artificial Sequence
  Synthetic oligonucleotide
ttcgtgccaccgtacagctagacgggacgttcccca

SEQ ID NO: 206400 - DNA, 35 bp, Artificial Sequence
  Synthetic oligonucleotide
taagcgcgctcctggcggacatcataaacaagcat

SEQ ID NO: 206401 - DNA, 36 bp, Artificial Sequence
  Synthetic oligonucleotide
tgacacatcgtcgcggaaacctagatggttagagca

SEQ ID NO: 206402 - DNA, 36 bp, Artificial Sequence
  Synthetic oligonucleotide
catgataaccgcacttcagcgctttttcaattggtg

SEQ ID NO: 206403 - DNA, 35 bp, Artificial Sequence
  Synthetic oligonucleotide
ggttgggctccttcctagctacacgtcaattctcg

SEQ ID NO: 206404 - DNA, 38 bp, Artificial Sequence
  Synthetic oligonucleotide
acacgctgaagcccttcccaacgcgacgttcttcatgt

SEQ ID NO: 206405 - DNA, 35 bp, Artificial Sequence
  Synthetic oligonucleotide
agccccggaatttgtgcttaggtggtaatcatctt

SEQ ID NO: 206406 - DNA, 35 bp, Artificial Sequence
  Synthetic oligonucleotide
tacgtcccaacttttagctgtccacttgagacgcc

SEQ ID NO: 206407 - DNA, 38 bp, Artificial Sequence
  Synthetic oligonucleotide
tttgacgtaccttctttcctcttttggcttagctgtca

SEQ ID NO: 206408 - DNA, 36 bp, Artificial Sequence
  Synthetic oligonucleotide
tagactccccggcgtcacgcaaacaatccgagcagt

SEQ ID NO: 206409 - DNA, 36 bp, Artificial Sequence
  Synthetic oligonucleotide
tcatctgtggcctacgccttcagtaacagtgcggca

SEQ ID NO: 206410 - DNA, 37 bp, Artificial Sequence
  Synthetic oligonucleotide
cccacatagggtttgcaagctatttattgaggtggca

SEQ ID NO: 206411 - DNA, 37 bp, Artificial Sequence
  Synthetic oligonucleotide
gcggcaatgttcgagcctcttatgttctgttacatca

SEQ ID NO: 206412 - DNA, 34 bp, Artificial Sequence
  Synthetic oligonucleotide
gaagacggaactcgaaatctactctattaaaccc

SEQ ID NO: 206413 - DNA, 36 bp, Artificial Sequence
  Synthetic oligonucleotide
ccctacggggaatgagcactttgtacagatgcgcca

SEQ ID NO: 206414 - DNA, 30 bp, Artificial Sequence
  Synthetic oligonucleotide
taccgttacccttgtacatcggctctctat

SEQ ID NO: 206415 - DNA, 36 bp, Artificial Sequence
  Synthetic oligonucleotide
tggggtgacgtacactttcttctcatcttattattg

SEQ ID NO: 206416 - DNA, 35 bp, Artificial Sequence
  Synthetic oligonucleotide
gacagccacctgaattctaaactgtttatacgtaa

SEQ ID NO: 206417 - DNA, 37 bp, Artificial Sequence
  Synthetic oligonucleotide
ttcatctaggtcctaaccgatctcgttaggcacttgt

SEQ ID NO: 206418 - DNA, 36 bp, Artificial Sequence
  Synthetic oligonucleotide
cacacgaaaagtgtgagtttaatcaagaaaaaagca

SEQ ID NO: 206419 - DNA, 38 bp, Artificial Sequence
  Synthetic oligonucleotide
gccatcccggatgcttgtcagacaggtcgacctgctca

SEQ ID NO: 206420 - DNA, 36 bp, Artificial Sequence
  Synthetic oligonucleotide
acccgattcaggaccccactctctgcgaccgtcgct

SEQ ID NO: 206421 - DNA, 35 bp, Artificial Sequence
  Synthetic oligonucleotide
catcccacataattcacatgttggtgctacggcag

SEQ ID NO: 206422 - DNA, 38 bp, Artificial Sequence
  Synthetic oligonucleotide
ctagacatgatcttgattgccgggtctcgttcccttca

SEQ ID NO: 206423 - DNA, 36 bp, Artificial Sequence
  Synthetic oligonucleotide
gccttgtatatgtaggttatccttgttttttgctca

SEQ ID NO: 206424 - DNA, 35 bp, Artificial Sequence
  Synthetic oligonucleotide
ggtactaagactaccttccgtattagcgatacccc

SEQ ID NO: 206425 - DNA, 36 bp, Artificial Sequence
  Synthetic oligonucleotide
gcccgatacgacaggccttgattaatgaaccttgag

SEQ ID NO: 206426 - DNA, 37 bp, Artificial Sequence
  Synthetic oligonucleotide
gccctcaccagcctcgaattgtacccctcaaacgcgt

SEQ ID NO: 206427 - DNA, 36 bp, Artificial Sequence
  Synthetic oligonucleotide
aacttggatacagatcgcatacaatttaaagcaaat

SEQ ID NO: 206428 - DNA, 36 bp, Artificial Sequence
  Synthetic oligonucleotide
gtctcatagtttggtttcaatcgtgttccgtaatga

SEQ ID NO: 206429 - DNA, 36 bp, Artificial Sequence
  Synthetic oligonucleotide
ttaccactgttacttgtaagccggcccttttatgaa

SEQ ID NO: 206430 - DNA, 35 bp, Artificial Sequence
  Synthetic oligonucleotide
gccactcaccaggaatctctgaatacagagatctc

SEQ ID NO: 206431 - DNA, 36 bp, Artificial Sequence
  Synthetic oligonucleotide
ctggctctttatagatccgtcatcttactaggttca

SEQ ID NO: 206432 - DNA, 35 bp, Artificial Sequence
  Synthetic oligonucleotide
tatcaaagggccatcacatgggtaataacgacact

SEQ ID NO: 206433 - DNA, 38 bp, Artificial Sequence
  Synthetic oligonucleotide
gctgagggtctcttgcgatctacgacccattgttctgg

SEQ ID NO: 206434 - DNA, 35 bp, Artificial Sequence
  Synthetic oligonucleotide
tgtgctggtccctatgacgatcgtgactattccag

SEQ ID NO: 206435 - DNA, 36 bp, Artificial Sequence
  Synthetic oligonucleotide
cgatcgcgcgtatgcgtaccgtactttggtgtataa

SEQ ID NO: 206436 - DNA, 37 bp, Artificial Sequence
  Synthetic oligonucleotide
gcggtacgcagcatccgactaatggcccattgctgca

SEQ ID NO: 206437 - DNA, 35 bp, Artificial Sequence
  Synthetic oligonucleotide
ggccacccttcttattaggtgtgtcccattggcct

SEQ ID NO: 206438 - DNA, 36 bp, Artificial Sequence
  Synthetic oligonucleotide
gctacgtgcgtcatggggcctcctgtgtgtttccca

SEQ ID NO: 206439 - DNA, 36 bp, Artificial Sequence
  Synthetic oligonucleotide
atgtggcccgaatccacgcgtgataggattaacaaa

SEQ ID NO: 206440 - DNA, 37 bp, Artificial Sequence
  Synthetic oligonucleotide
tgaagtgatgcaacgcttggttcggaatcttacacgt

SEQ ID NO: 206441 - DNA, 35 bp, Artificial Sequence
  Synthetic oligonucleotide
agcaattactgatgactatttagtctcgaccatgg

SEQ ID NO: 206442 - DNA, 35 bp, Artificial Sequence
  Synthetic oligonucleotide
tttccgcggcctgggcttggttgtaccccttctag

SEQ ID NO: 206443 - DNA, 36 bp, Artificial Sequence
  Synthetic oligonucleotide
gctgatcggaggaattatattttctttgtccgataa

SEQ ID NO: 206444 - DNA, 25 bp, Artificial Sequence
  Synthetic oligonucleotide
gtcccttctcacttttctcgtttca

SEQ ID NO: 206445 - DNA, 35 bp, Artificial Sequence
  Synthetic oligonucleotide
tatacctcgctgggacgactaggctccacaacact

SEQ ID NO: 206446 - DNA, 36 bp, Artificial Sequence
  Synthetic oligonucleotide
cacaccttaaaattccactggttcgtccgccctcca

SEQ ID NO: 206447 - DNA, 36 bp, Artificial Sequence
  Synthetic oligonucleotide
tacctagggccggccctgggatattttacaccgcgg

SEQ ID NO: 206448 - DNA, 36 bp, Artificial Sequence
  Synthetic oligonucleotide
acgcttagtggttgtcgattttagtcctggcaagaa

SEQ ID NO: 206449 - DNA, 35 bp, Artificial Sequence
  Synthetic oligonucleotide
ctaccccccgctgcatcatgtgtttgattgttgct

SEQ ID NO: 206450 - DNA, 36 bp, Artificial Sequence
  Synthetic oligonucleotide
tgcacccacagtttcggtgatgggttccctgtcaat

SEQ ID NO: 206451 - DNA, 37 bp, Artificial Sequence
  Synthetic oligonucleotide
tagtcggtctatttttcccttagtccctgaggttggt

SEQ ID NO: 206452 - DNA, 35 bp, Artificial Sequence
  Synthetic oligonucleotide
aaacccgagtaacgatttcgtgccgaacgtgccct

SEQ ID NO: 206453 - DNA, 35 bp, Artificial Sequence
  Synthetic oligonucleotide
taacgatagggccctgattgaaagattgtgtagaa

SEQ ID NO: 206454 - DNA, 35 bp, Artificial Sequence
  Synthetic oligonucleotide
atacgccggtactgcctcatgacagtctgccctat

SEQ ID NO: 206455 - DNA, 36 bp, Artificial Sequence
  Synthetic oligonucleotide
attgcgttgtccccttctgcacattcccaattcaga

SEQ ID NO: 206456 - DNA, 35 bp, Artificial Sequence
  Synthetic oligonucleotide
catgtcgagggtctcatcttccggtgttgcttcat

SEQ ID NO: 206457 - DNA, 36 bp, Artificial Sequence
  Synthetic oligonucleotide
tcttgtttgagcttttccagtgagtcctgcatcaat

SEQ ID NO: 206458 - DNA, 35 bp, Artificial Sequence
  Synthetic oligonucleotide
gcctacggtgagagctacaacgacacgatgcccac

SEQ ID NO: 206459 - DNA, 35 bp, Artificial Sequence
  Synthetic oligonucleotide
tacgtatttcgcacacacctacgatacgcgtgact

SEQ ID NO: 206460 - DNA, 38 bp, Artificial Sequence
  Synthetic oligonucleotide
agtactctgcgagacggtttctctcttacccgctgtca

SEQ ID NO: 206461 - DNA, 35 bp, Artificial Sequence
  Synthetic oligonucleotide
ccctagtcaccccggggccttgcatgaaaaccgct

SEQ ID NO: 206462 - DNA, 35 bp, Artificial Sequence
  Synthetic oligonucleotide
gcgtccacagagcatgcggattcgtccatgactag

SEQ ID NO: 206463 - DNA, 36 bp, Artificial Sequence
  Synthetic oligonucleotide
cccacgcgtaggacgtggtatgtaaatggccctcag

SEQ ID NO: 206464 - DNA, 37 bp, Artificial Sequence
  Synthetic oligonucleotide
gcgccggcgcgttctaaccgacgctttaggacctcca

SEQ ID NO: 206465 - DNA, 36 bp, Artificial Sequence
  Synthetic oligonucleotide
gccaggtatcagctgtgacaaaaatgggtgggtgca

SEQ ID NO: 206466 - DNA, 37 bp, Artificial Sequence
  Synthetic oligonucleotide
agcgcggccgagctcgtatcgccggttttgcctacca

SEQ ID NO: 206467 - DNA, 25 bp, Artificial Sequence
  Synthetic oligonucleotide
ttttcgggtttgtcaatcgttccgt

SEQ ID NO: 206468 - DNA, 35 bp, Artificial Sequence
  Synthetic oligonucleotide
ggtccaatgacaccaatgggctccgataggtttaa

SEQ ID NO: 206469 - DNA, 35 bp, Artificial Sequence
  Synthetic oligonucleotide
ccatggctatccggattccccctgttcactcagcg

SEQ ID NO: 206470 - DNA, 35 bp, Artificial Sequence
  Synthetic oligonucleotide
agtaccatctacctcgctgatatcacctctgtatt

SEQ ID NO: 206471 - DNA, 35 bp, Artificial Sequence
  Synthetic oligonucleotide
tttctggtaatccaaggcgttacggggagcccttt

SEQ ID NO: 206472 - DNA, 35 bp, Artificial Sequence
  Synthetic oligonucleotide
tccgcctgttcatacgagttttatgcggaatcgct

SEQ ID NO: 206473 - DNA, 35 bp, Artificial Sequence
  Synthetic oligonucleotide
gttggtggcgctgctagattatttttcgaccctaa

SEQ ID NO: 206474 - DNA, 35 bp, Artificial Sequence
  Synthetic oligonucleotide
ccgccgaggaacaccagactcgttatctggtgagg

SEQ ID NO: 206475 - DNA, 35 bp, Artificial Sequence
  Synthetic oligonucleotide
gcatccactacgactggacccgttaggccttacat

SEQ ID NO: 206476 - DNA, 35 bp, Artificial Sequence
  Synthetic oligonucleotide
ccaccctagtgaccgccgctcgtgagcttactacc

SEQ ID NO: 206477 - DNA, 36 bp, Artificial Sequence
  Synthetic oligonucleotide
ttccgcatcacagtatcgttcgtcttctgactgtca

SEQ ID NO: 206478 - DNA, 36 bp, Artificial Sequence
  Synthetic oligonucleotide
aattagctacggcctcttatttcccagtgctgcgca

SEQ ID NO: 206479 - DNA, 88 bp, Artificial Sequence
  Synthetic oligonucleotide
ctagcatgactgcagtacgtatatgcgatgctagctcgaagcgtgtgcagtccctctgtctcttatacacatctgacgctgccgacga

SEQ ID NO: 206480 - DNA, 88 bp, Artificial Sequence
  Synthetic oligonucleotide
tcgtcggcagcgtcagatgtgtataagagacagaatagggaaatgcgacaatgattcaagtacccagtacgtactgcagtcatgctag

SEQ ID NO: 206481 - DNA, 89 bp, Artificial Sequence
  Synthetic oligonucleotide
ctagcatgactgcagtacgtgtccagctcgcaattacactagtttgccagtaaaagctgtctcttatacacatctgacgctgccgacga

SEQ ID NO: 206482 - DNA, 88 bp, Artificial Sequence
  Synthetic oligonucleotide
tcgtcggcagcgtcagatgtgtataagagacagagggactgcacacgcttcgagctagcatcgcatatacgtactgcagtcatgctag

SEQ ID NO: 206483 - DNA, 88 bp, Artificial Sequence
  Synthetic oligonucleotide
ctagcatgactgcagtacgttccggagtccataagactacggatagctttgaccgctgtctcttatacacatctgacgctgccgacga

SEQ ID NO: 206484 - DNA, 89 bp, Artificial Sequence
  Synthetic oligonucleotide
tcgtcggcagcgtcagatgtgtataagagacagtatctacacttttgtttccgaaacgcgatgtgcatgacgtactgcagtcatgctag

SEQ ID NO: 206485 - DNA, 89 bp, Artificial Sequence
  Synthetic oligonucleotide
ctagcatgactgcagtacgtcatgcacatcgcgtttcggaaacaaaagtgtagatactgtctcttatacacatctgacgctgccgacga

SEQ ID NO: 206486 - DNA, 88 bp, Artificial Sequence
  Synthetic oligonucleotide
tcgtcggcagcgtcagatgtgtataagagacagagtgtatgaggaatccgaggtcacacgtcgtgtggacgtactgcagtcatgctag

SEQ ID NO: 206487 - DNA, 88 bp, Artificial Sequence
  Synthetic oligonucleotide
ctagcatgactgcagtacgtccacacgacgtgtgacctcggattcctcatacactctgtctcttatacacatctgacgctgccgacga

SEQ ID NO: 206488 - DNA, 89 bp, Artificial Sequence
  Synthetic oligonucleotide
tcgtcggcagcgtcagatgtgtataagagacagcttttactggcaaactagtgtaattgcgagctggacacgtactgcagtcatgctag

SEQ ID NO: 206489 - DNA, 88 bp, Artificial Sequence
  Synthetic oligonucleotide
ctagcatgactgcagtacgtactgggtacttgaatcattgtcgcatttccctattctgtctcttatacacatctgacgctgccgacga

SEQ ID NO: 206490 - DNA, 88 bp, Artificial Sequence
  Synthetic oligonucleotide
tcgtcggcagcgtcagatgtgtataagagacagcggtcaaagctatccgtagtcttatggactccggaacgtactgcagtcatgctag

SEQ ID NO: 206491 - DNA, 35 bp, Artificial Sequence
  Synthetic oligonucleotide
gggggccccttttgttttctttttgttatttttgc

SEQ ID NO: 206492 - DNA, 38 bp, Artificial Sequence
  Synthetic oligonucleotide
ggcttcctgggggtttttgtaattgtattttctgttga

SEQ ID NO: 206493 - DNA, 35 bp, Artificial Sequence
  Synthetic oligonucleotide
accctttaggtgttttttttggttttcatttttta

SEQ ID NO: 206494 - DNA, 35 bp, Artificial Sequence
  Synthetic oligonucleotide
ttcgccgtttttgttttgttgtcttaggttacctc

SEQ ID NO: 206495 - DNA, 35 bp, Artificial Sequence
  Synthetic oligonucleotide
tgctgggtggtttgtttttttatttggtgcattct

SEQ ID NO: 206496 - DNA, 36 bp, Artificial Sequence
  Synthetic oligonucleotide
gccgtgattcatttgagggttccttgtttgatttta

SEQ ID NO: 206497 - DNA, 38 bp, Artificial Sequence
  Synthetic oligonucleotide
ttaggtatgccacgtgcctaattggggtttttgtttga

SEQ ID NO: 206498 - DNA, 35 bp, Artificial Sequence
  Synthetic oligonucleotide
tgtcatctcacctaaccacacaacctactacctca

SEQ ID NO: 206499 - DNA, 38 bp, Artificial Sequence
  Synthetic oligonucleotide
ttcaatctacactggtatttcgcctcctcgctgggtga

SEQ ID NO: 206500 - DNA, 35 bp, Artificial Sequence
  Synthetic oligonucleotide
ggtcctccggcgcatattccttaccgtaaattata

SEQ ID NO: 206501 - DNA, 36 bp, Artificial Sequence
  Synthetic oligonucleotide
ttgtttccaactcttgaatttcttggtacttgtcca

SEQ ID NO: 206502 - DNA, 38 bp, Artificial Sequence
  Synthetic oligonucleotide
tggactctctcctctgcctctgtgatagcggtttttga

SEQ ID NO: 206503 - DNA, 35 bp, Artificial Sequence
  Synthetic oligonucleotide
cttgaattcccatgtctctcctgcccccctcacta

SEQ ID NO: 206504 - DNA, 37 bp, Artificial Sequence
  Synthetic oligonucleotide
ttctgaggctcaccactttgcacaaacttttcaccga

SEQ ID NO: 206505 - DNA, 36 bp, Artificial Sequence
  Synthetic oligonucleotide
gggtttattctgcttatcctttcgttttcttgttga

SEQ ID NO: 206506 - DNA, 38 bp, Artificial Sequence
  Synthetic oligonucleotide
atgccaccactgatcgctaagttaccccaactgtttga
